United States Patent 11,602,557 (BUNYAVIRALES VACCINE) - sequence listing, part 11

SEQ ID NO: 12752 - RNA, 3594 nt, Artificial Sequence
  derived and/or modified CDS sequence (opt1) from RVFV(73HB1230)__DQ380221.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcaggucggccgcgagacgauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggcgugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagaaggagcugaaguccuucgacaucagccagugccccaagaucggcggccacggguccaagaagugcaccggcgacgccgccuucugcagcgccuacgagugcaccgcccaguacgccaacgccuacugcucccacgccaacgggagcggcaucgugcagauccagguguccgggguguggaagaagccgcugugcgugggcuacgagcgggucguggugaagcgcgagcugagcgcgaagcccauccagcgggucgagcccugcacgaccugcaucaccaagugcgagccccacggccugguggugcgcuccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccggguccugaagugccucaagaucgcgccccgcaaggugcugaacccccugauguggaucaccgccuucauccgguggguguacaagaagauggucgcccgcguggccgacaacaucaaccaggugaaccgcgagaucggguggauggagggcggccagcucguccuggggaacccggcccccaucccccggcacgcccccaucccgcgcuacagcaccuaccugaugcugcuccugaucguguccuacgccagcgccugcuccgagcugauccaggcgagcucccggaucaccacgugcagcaccgagggcgugaacaccaagugccgccucuccgggaccgcccugauccgggccggcagcgucggggccgaggccugccugaugcucaagggcgugaaggaggaccagacgaaguuccugaagaucaagaccgugagcuccgagcugagcugccgcgagggccaguccuacuggaccgggagcuucucccccaagugccucagcucccggcgcugccaccuggucggcgagugccacgugaaccggugccugagcuggcgcgacaacgagaccuccgcggaguucagcuucgugggggaguccaccaucaugcgggagaacaagugcuucgagcagugcggcggguggggcugcggcugcuucaacgucaaccccagcugccucuucgugcacacguaccugcaguccgugcgcaaggaggcccugcgggucuucaacugcaucgacugggugcacaagcucacccuggagaucaccgacuucgacgggagcguguccaccaucgaccugggcgccagcuccagccgcuucacgaacuggggguccgucagccucagccuggacgccgagggcaucuccgggagcaacuccuucagcuucaucgagucccccggcaagggcuacgccaucguggacgagccguucagcgagaucccccggcagggguuccugggcgagauccgcugcaacuccgagagcuccgugcucagcgcgcacgaguccugccugcgggcccccaaccugaucagcuacaagcccaugaucgaccagcucgagugcaccaccaaccugaucgacccguucgucguguucgagcgcgggucccugccccagacccggaacgacaagacguucgccgccagcaagggcaaccgcggggugcaggccuucuccaagggcagcguccaggcggaccucacccugauguucgacaacuucgagguggacuucgugggcgccgccgucuccugcgacgccgcguuccugaaccucaccgggugcuacagcugcaacgccggcgcccgcgugugccuguccaucaccagcacggggaccggcacccugagcgcccacaacaaggacggcucccuccacaucguccugcccagcgagaacgggaccaaggaccagugccagauccugcacuucacggugcccgagguggaggaggaguucauguacuccugcgacggcgacgagcggccgcuccuggucaaggggacccugaucgccaucgaccccuucgacgaccgccgggaggcgggcggggagagcaccguggugaaccccaaguccggcagcuggaacuucuucgacugguucuccggccucaugagcugguucgggggcccccugaagaccauccugcucaucugccuguacgucgcccuguccaucggccucuucuuccugcugaucuaccucgggcgcacggggcugagcaagauguggcuggccgccaccaagaaggccuccuga

SEQ ID NO: 12753 - RNA, 3594 nt, Artificial Sequence
  derived and/or modified CDS sequence (opt1) from RVFV(73HB1449)__DQ380211.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagaacccgagcaccgagaucacccugaaguaccccggcaucagccaguccagcgggggcgacaucggcgugcacauggcccacgacgaccaguccgucagcuccaagaucguggcgcacugcccgccccaggaccccugccucgugcacgggugcaucgucugcgcccacggccugaucaacuaccagugccacacggcccugagcgccuucgugguggucuucguguucuccagcaucgccaucaucugccucgcgauccuguaccgcgugcugaagugccucaagaucgcgccccggaagguccugaacccccugauguggaucaccgccuucauccgcuggguguacaagaagaugguggcccgcgucgccgacaacaucaaccaggugaaccgggagaucggguggauggagggcggccagcucgugcuggggaacccggcccccaucccccgccacgcccccaucccgcgguacuccaccuaccugaugcugcuccugaucgucagcuacgccuccgccugcagcgagcugauccaggcguccagccgcaucaccacgugcuccaccgagggcgugaacaccaagugccggcucagcgggaccgcccugauccgcgccggcuccgugggggccgaggccugccugaugcucaagggcgucaaggacgaccagacgaaguuccugaagaucaagaccgugagcagcgagcuguccugccgggagggccagagcuacuggaccggguccuucagccccaagugccucuccagccgccggugccaccuggugggcgagugccacgucaaccgcugccuguccuggcgggacaacgagaccagcgcggaguucuccuucgugggggagagcaccacgaugcgcgagaacaagugcuucgagcagugcggcggguggggcugcggcugcuucaacgugaaccccuccugccucuucguccacaccuaccugcagagcgugcggaaggaggcccugcgcguguucaacugcaucgacuggguccacaagcucacccuggagaucaccgacuucgacggguccgugagcacgaucgaccugggcgccuccagcucccgguucaccaacugggggagcgugucccucagccuggacgccgagggcaucagcggguccaacagcuucuccuucaucgagagccccggcaagggcuacgccaucgucgacgagccguucuccgagaucccccgccagggguuccugggcgagauccggugcaacagcgaguccagcgugcucuccgcgcacgagagcugccugcgcgcccccaaccugaucuccuacaagcccaugaucgaccagcucgagugcaccaccaaccugaucgacccguucguggucuucgagcgggggagccugccccagacgcgcaacgagaagaccuucgccgccuccaagggcaaccgcggggugcaggccuucagcaagggcuccgugcaggcggaccucacccugauguucgacaacuucgaggucgacuucgugggcgccgccgugagcugcgacgccgcguuccugaaccucaccgggugcuacuccugcaacgccggcgcccgggucugccugagcaucacguccaccgggaccggcacccugagcgcccacaacaaggacggcagccuccacaucgugcugcccuccgagaacgggacgaaggaccagugccagauccugcacuucaccguccccgagguggaggaggaguucauguacagcugcgacggcgacgagcgcccgcuccuggugaaggggacccugaucgccaucgaccccuucgacgaccggcgcgaggcgggcggggaguccaccgucgugaaccccaagagcggcuccuggaacuucuucgacugguucagcggccucauguccugguucgggggcccccugaagacgauccugcucaucugccuguacguggcccugagcaucgggcuguucuuccugcugaucuaccucggccggaccgggcuguccaagauguggcuggccgccaccaagaaggccagcuga

SEQ ID NO: 12754 - RNA, 3594 nt, Artificial Sequence
  derived and/or modified CDS sequence (opt1) from RVFV(ZH-548M12)__M25276.1__GP
auguacgugcugcucaccauccugaccagcguccuggugugcgaggccaucauccgcgugucccucagcuccacgcgggaggagaccugcuucggcgacagcaccaaccccgagaugaucgagggggccugggacucccugcgcgaggaggagaugccggaggagcugagcugcuccaucagcggcauccgggaggucaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucgugcgcugcgagcggcgccgggacgccaagcagaucggccgcaagaccauggcggggaucgccaugaccguccugcccgcccuggccguguucgcgcucgcccccguggucuucgccgaggacccccaccuccggaaccgccccggcaaggggcacaacuacaucgacggcaugacccaggaggacgccacgugcaagccggugaccuacgccggggcgugcagcuccuucgacgugcugcuggagaagggcaaguucccccuguuccagagcuacgcccaccaccggacccugcucgaggccguccacgacaccaucaucgccaaggccgacccgcccuccugcgaccugcugagcgcgcacggcaaccccugcaugaaggagaagcucgugaugaagacgcacugccccaacgacuaccaguccgcccaccaccugaacaacgacgggaagauggccagcgugaagugcccgcccaaguacgagcugaccgaggacugcaacuucugccgccagaugaccggcgccucccucaagaaggggagcuacccccugcaggaccuguucugccagagcuccgaggacgacggcagcaagcucaagaccaagaugaagggcgucugcgaggugggggugcaggcccugaagaagugcgacggccagcuguccacggcgcacgaggucgugcccuucgccguguucaagaacagcaagaaggucuaccucgacaagcuggaccugaagaccgaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcacgggcgacgccgccuucugcagcgccuacgagugcaccgcgcaguacgccaacgccuacugcucccacgccaacgggagcggcaucgugcagauccaggucuccgggguguggaagaagccgcucugcgucggcuacgagcgcgugguggucaagcgggagcugagcgcgaagcccauccagcgcguggagcccugcacgaccugcaucaccaagugcgagccccacggccuggugguccgguccaccggguucaagaucagcuccgccguggccugcgccagcggcgugugcgucaccgggucccagagcccgagcaccgagaucacgcucaaguaccccggcaucucccagagcuccgggggcgacaucggcgugcacauggcccacgacgaccagagcguguccagcaagaucgucgcgcacugcccgccccaggaccccugccuggugcacgacugcaucgugugcgcccacgggcugaucaacuaccagugccacaccgcccucuccgccuucgucgugguguucgucuucagcuccaucgccaucaucugccuggcgauccuguaccgcgugcucaagugccugaagaucgcgccccggaaggugcugaacccccucauguggaucaccgccuucauccgcuggaucuacaagaagauggucgcccgcguggccgacaacaucaaccaggugaaccgggagaucggcuggauggagggcgggcagcugguccugggcaacccggcgcccaucccccgccacgcccccaucccgcgguacagcaccuaccugaugcuccugcugaucguguccuacgccagcgccugcuccgagcucauccaggcgagcucccgcaucacgaccugcagcaccgagggggugaacaccaagugccggcuguccggcacggcccugauccgcgccgggagcgucggcgccgaggccugccucaugcugaagggggugaaggaggaccagaccaaguuccugaagcucaagaccgugagcuccgagcugagcugccgggagggccaguccuacuggaccggcagcuucucccccaagugccugagcucccgccggugccaccucgucggggagugccacgugaaccgcugccugagcuggcgggacaacgagaccuccgcggaguucagcuucgugggcgaguccacgaccaugcgcgagaacaagugcuucgagcagugcgggggcugggggugcggcugcuucaacgucaaccccagcugccuguucgugcacaccuaccuccaguccgugcggaaggaggcccugcgcgucuucaacugcaucgacugggugcacaagcugacccucgagaucacggacuucgacggcagcguguccaccaucgaccugggggccagcuccagccgguucaccaacuggggcuccgucagccugagccucgacgccgaggggaucuccggcagcaacuccuucagcuucaucgagucccccgggaagggcuacgccaucguggacgagccguucagcgagaucccccgccagggcuuccugggggagauccggugcaacuccgagagcuccgugcugagcgcgcacgaguccugccuccgcgcccccaaccugaucagcuacaagcccaugaucgaccagcuggagugcaccacgaaccucaucgacccguucgucguguucgagcggggcucccugccccagacccgcaacgacaagaccuucgccgccagcaaggggaaccgcggcgugcaggccuucuccaaggggagcguccaggcggaccugacccucauguucgacaacuucgagguggacuucgugggcgccgccgucuccugcgacgccgcguuccugaaccugacgggcugcuacagcugcaacgccggggcccgggugugccucuccaucaccagcaccggcaccgggagccuguccgcccacaacaaggacggcagccugcacaucgugcuccccuccgagaacggcacgaaggaccagugccagauccugcacuucaccguccccgagguggaggaggaguucauguacagcugcgacggggacgagcgcccgcugcucgucaagggcacccugaucgccaucgaccccuucgacgaccggcgcgaggccgggggcgaguccaccguggugaaccccaagagcggguccuggaacuucuucgacugguucagcggccugauguccugguucggcgggccccucaagacgauccugcugaucugccucuacgucgcccugagcaucggccuguucuuccuccugaucuaccucgggggcaccgggcuguccaagauguggcuggccgccaccaagaaggccagcuga

SEQ ID NO: 12755 - RNA, 3594 nt, Artificial Sequence
  derived and/or modified CDS sequence (opt1) from RVFV(ZINGA J83 R1)__KU978776.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccugaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgggugcaucgucugcgcccacggccugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggguguaccgcaagaugguggcccgggucgccgacaacaucaaccaggugaaccgcgagaucggguggauggagggcggccagcuggugcuggggaacccggcccccaucccccggcacguccccaucccgcgcuacagcaccuaccugaugcuccugcugaucguguccuacgccagcgccugcuccgagcucauccaggccagcucccggaucaccacgugcagcaccgagggcgugaacaccaagugccgccuguccgggaccgcgcugauccgggccggcagcgucggggccgaggccugccucaugcugaagggcgugaaggaggaccagacgaaguuccugaagaucaagaccgugagcuccgagcucagcugccgcgagggccaguccuacuggaccgggagcuucucccccaagugccugagcucccggcgcugccaccuggucggcgagugccacgugaaccggugccucagcuggcgcgacaacgagaccuccgccgaguucagcuucgugggggaguccaccacgaugcgggagaacaagugcuucgagcagugcggcggguggggcugcggcugcuucaacgucaaccccagcugccuguucgugcacaccuaccugcaguccgugcgcaaggaggcgcuccgggucuucaacugcaucgacugggugcacaagcugacccuggagaucaccgacuucgacgggagcguguccacgaucgaccucggcgccagcuccagccgcuucaccaacuggggguccgucagccugagccuggacgccgagggcaucuccgggagcaacuccuucagcuucaucgagucccccggcaagggcuacgccaucguggacgagccguucagcgagaucccccggcagggguuccucggcgagauccgcugcaacuccgagagcuccgugcugagcgcccacgaguccugccugcgggcgcccaaccucaucagcuacaagcccaugaucgaccagcuggagugcaccaccaaccugaucgacccguucgucguguucgagcgcgggucccucccccagacgcgcaacgacaagaccuucgccgccagcaagggcaaccgcggggugcaggccuucuccaagggcagcguccaggccgaccugacccugauguucgacaacuucgagguggacuucgugggcgcggccgucuccugcgacgccgccuuccucaaccugaccgggugcuacagcugcaacgcgggcgcccgggugugccuguccaucacgagcaccgggaccggcacccucagcgcccacaacaaggacggcucccugcacaucguccugcccagcgagaacgggacgaaggaccagugccagauccuccacuucaccgugcccgagguggaggaggaguucauguacuccugcgacggcgacgagcggccgcugcugguccgcgggacccucaucgccaucgaccccuucgacgaccggcgcgaggccggcggggagagcaccguggugaaccccaaguccggcagcuggaacuucuucgacugguucuccggccugaugagcugguucgggggcccccugaagacgauccuccugaucugccuguacgucgcgcucuccaucgggcuguucuuccugcucaucuaccugggccggaccgggcugagcaagauguggcucgccgccaccaagaaggccuccuga

SEQ ID NO: 12756 - RNA, 3594 nt, Artificial Sequence
  derived and/or modified CDS sequence (opt1) from RVFV(Sudan 28-2010)__JQ820491.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgugaacaccaagugccggcucuccgggaccgcccugauccgcgccggcagcgucggggccgaggccugccugaugcucaagggcgugaaggaggaccagacgaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgcggaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucgucguguucgagcgggggucccugccccagacgcgcaacgacaagaccuucgccgccagcaagggcaaccgcggggugcaggccuucuccaagggcagcguccaggcggaccucacccugauguucgacaacuucgagguggacuucgugggcgccgccgucuccugcgacgccgcguuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgccaucgaccccuucgacgaccggcgcgaggcgggcggggagagcaccguggugaaccccaaguccggcagcuggaacuucuucgacugguucuccggccucaugagcugguucgggggcccccugaagacgauccugcucaucugccuguacgucgugcuguccaucgggcuguucuuccugcugaucuaccucggccggaccgggcugagcaagauguggcuggccgccaccaagaaggccuccuga

SEQ ID NO: 12757 - RNA, 3594 nt, Artificial Sequence
  derived and/or modified CDS sequence (opt1) from RVFV(2007001292)__EU574046.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacagcaccuaccugaugcugcuccugaucgucuccuacgccagcgcgugcuccgagcugauccaggccagcucccgcaucacgaccugcagcaccgagggcgugaacaccaagugccggcucuccgggacggcccugauccgcgccggcagcgugggggccgaggcgugccugaugcucaagggcgucaaggaggaccagaccaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgccgaguucagcuucgugggggaguccacgaccaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucacggacuucgacgggagcguguccaccaucgaccugggcgccagcuccagccgguucaccaacuggggguccgugagccucagccuggacgccgagggcaucuccgggagcaacuccuucagcuucaucgagucccccggcaagggcuacgcgaucgucgacgagccguucagcgagaucccccgccagggguuccugggcgagauccggugcaacuccgagagcuccgugcucagcgcccacgaguccugccugcgcgcccccaaccuggugagcuacaagcccaugaucgaccagcucgagugcaccacgaaccugaucgacccguucgucguguucgagcgggggucccugccccagacccgcaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucacggggugcuacagcugcaacgccggcgcccgggugugccuguccaucaccagcaccgggaccggcacgcugagcgcccacaacaaggacggcucccuccacaucguccugcccagcgagaacgggaccaaggaccagugccagauccugcacuucaccgugcccgagguggaggaggaguucauguacuccugcgacggcgacgagcgcccgcuccuggucaaggggacccugaucgcgaucgaccccuucgacgaccggcgcgaggccggcggggagagcacgguggugaaccccaaguccggcagcuggaaccucuucgacugguucuccggccugaugagcugguucgggggcccccugaagaccauccuccugaucugccuguacgucgcccucuccaucgggcuguucuuccugcucaucuaccugggccggaccgggcugagcaagauguggcucgccgccaccaagaaggcguccuga

SEQ ID NO: 12758 - RNA, 3594 nt, Artificial Sequence
  derived and/or modified CDS sequence (opt1) from RVFV(Sudan 85-2010)__JQ820488.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgugaacaccaagugccggcucuccgggaccgcccugauccgcgccggcagcgucggggccgaggccugccugaugcucaagggcgugaaggaggaccagacgaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgcggaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucgucguguucgagcgggggucccugccccagacgcgcaacgagaagaccuucgccgccagcaagggcaaccgcggggugcaggccuucuccaagggcagcguccaggcggaccucacccugauguucgacaacuucgagguggacuucgugggcgccgccgucuccugcgacgccgcguuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgccaucgaccccuucgacgaccggcgcgaggcgggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccggaccgggcugagcaagauguggcuggccgccaccaagaaggccuccuga

SEQ ID NO: 12759 - RNA, 3594 nt, Artificial Sequence
  derived and/or modified CDS sequence (opt1) from RVFV(2007002060)__EU574039.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgcaaggacgccaagcagaucggccgggagaccauggcggggaucgccaugaccgugcugcccgcccuggccgucuucgcgcucgcccccgugguguucgccgaggacccccaccuccgcaaccggcccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccgcacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccggcagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgcgagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgggucguggugaagcgcgagcucagcgcgaagcccauccagcgggucgagcccugcacgaccugcaucaccaagugcgagccccacggccugguggugcgcuccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccggguccugaagugccucaagaucgcgccccgcaaggugcugaacccccugauguggaucaccgccuucauccgguggguguacaagaagauggucgcccgcguggccgacaacaucaaccaggugaaccgcgagaucggguggauggagggcggccagcucgcccuggggaacccggcccccaucccccggcacgcccccaucccgcgcuacagcaccuaccugaugcugcuccugaucgucuccuacgccagcgcgugcuccgagcugauccaggccagcucccggaucacgaccugcagcaccgagggcgugaacaccaagugccgccucuccgggacggcccugauccgggccggcagcgugggggccgaggcgugccugaugcucaagggcgucaaggaggaccagaccaaguuccugaagaucaagaccgugagcuccgagcugagcugccgcgagggccaguccuacuggaccgggagcuucucccccaagugccucagcucccggcgcugccaccuggugggcgagugccacgucaaccggugccugagcuggcgcgacaacgagaccuccgccgaguucagcuucgugggggaguccacgaccaugcgggagaacaagugcuucgagcagugcggcggguggggcugcggcugcuucaacgugaaccccagcugccucuucguccacaccuaccugcaguccgugcgcaaggaggcccugcggguguucaacugcaucgacuggguccacaagcucacccuggagaucacggacuucgacgggagcguguccaccaucgaccugggcgccagcuccagccgcuucaccaacuggggguccgugagccucagccuggacgccgagggcaucuccgggagcaacuccuucagcuucaucgagucccccggcaagggcuacgcgaucgucgacgagccguucagcgagaucccccggcagggguuccugggcgagauccgcugcaacuccgagagcuccgugcucagcgcccacgaguccugccugcgggcccccaaccuggugagcuacaagcccaugaucgaccagcucgagugcaccacgaaccugaucgacccguucgucguguucgagcgcgggucccugccccagacccggaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucacggggugcuacagcugcaacgccggcgcccgcgugugccuguccaucaccagcaccgggaccggcacgcugagcgcccacaacaaggacggcucccuccacaucguccugcccagcgagaacgggaccaaggaccagugccagauccugcacuucaccgugcccgagguggaggaggaguucauguacuccugcgacggcgacgagcggccgcuccuggucaaggggacccugaucgcgaucgaccccuucgacgaccgccgggaggccggcggggagagcacgguggugaaccccaaguccggcagcuggaacuucuucgacugguucuccggccucaugagcugguucgggggcccccugaagaccauccugcucaucugccuguacgucgcccuguccaucgggcuguucuuccugcugaucuaccucggccgcaccgggcugagcaagauguggcuggccgccaccaagaaggcguccuga

SEQ ID NO: 12760 - RNA, 3594 nt, Artificial Sequence
  derived and/or modified CDS sequence (opt1) from RVFV(2007002476)__EU574036.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcguccugaagugccucaagaucgcgccccggaaggugcugaacccccugauguggaucaccgccuucaucaaguggguguacaagaagauggucgcccgcguggccgacaacaucaaccaggugaaccgcgagaucggguggauggagggcggccagcucgcccuggggaacccggcccccaucccccggcacgcccccaucccgcgcuacagcaccuaccugaugcugcuccugaucgucuccuacgccagcgcgugcuccgagcugauccaggccagcucccggaucacgaccugcagcaccgagggcgugaacaccaagugccgccucuccgggacggcccugauccgggccggcagcgugggggccgaggcgugccugaugcucaagggcgucaaggaggaccagaccaaguuccugaagaucaagaccgugagcuccgagcugagcugccgcgagggccaguccuacuggaccgggagcuucucccccaagugccucagcucccggcgcugccaccuggugggcgagugccacgucaaccggugccugagcuggcgcgacaacgagaccuccgccgaguucagcuucgugggggaguccacgaccaugcgggagaacaagugcuucgagcagugcggcggguggggcugcggcugcuucaacgugaaccccagcugccucuucguccacaccuaccugcaguccgugcgcaaggaggcccugcggguguucaacugcaucgacuggguccacaagcucacccuggagaucacggacuucgacgggagcguguccaccaucgaccugggcgccagcuccagccgcuucaccaacuggggguccgugagccucagccuggacgccgagggcaucuccgggagcaacuccuucagcuucaucgagucccccggcaagggcuacgcgaucgucgacgagccguucagcgagaucccccggcagggguuccugggcgagauccgcugcaacuccgagagcuccgugcucagcgcccacgaguccugccugcgggcccccaaccuggugagcuacaagcccaugaucgaccagcucgagugcaccacgaaccugaucgacccguucgucguguucgagcgcgggucccugccccagacccggaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucacggggugcuacagcugcaacgccggcgcccgcgugugccuguccaucaccagcaccgggaccggcacgcugagcgcccacaacaaggacggcucccuccacaucguccugcccagcgagaacgggaccaaggaccagugccagauccugcacuucaccgugcccgagguggaggaggaguucauguacuccugcgacggcgacgagcggccgcuccuggucaaggggacccugaucgcgaucgaccccuucgacgaccgccgggaggccggcggggagagcacgguggugaaccccaaguccggcagcuggaacuucuucgacugguucuccggccucaugagcugguucgggggcccccugaagaccauccugcucaucugccuguacgucgcccuguccaucgggcuguucuuccugcugaucuaccucggccgcaccgggcugagcaagauguggcuggccgccaccaagaaggcguccuga

SEQ ID NO: 12761 - RNA, 3594 nt, Artificial Sequence
  derived and/or modified CDS sequence (opt1) from RVFV(2269/74)__DQ380222.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcagcacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccguggccaucaucugccucgcgauccuguacaagguccugaagugccucaagaucgcccccaagaaggugcugaacccccugauguggaucaccgccuucauccgcuggguguacaagaagauggucgcccggguggccgacaacaucaaccaggugaaccgcgagaucggguggauggagggcggccagcucgcgcuggggaacccggcccccaucccccgccacgcccccaucccgcgguacagcaccuaccugaugcugcuccugaucgucuccuacgccagcgcgugcuccgagcugauccaggccagcucccgcaucaccacgugcagcaccgagggcgugaacaccaagugccggcucuccgggaccgcccugauccgcgccggcagcgugggggccgaggcgugccugaugcucaagggcgucaaggaggaccagacgaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgccgaguucagcuucgugggggaguccaccacgaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucaccgacuucgacgggagcguguccacgaucgaccugggcgccagcuccagccgguucaccaacuggggguccgugagccucagccuggacgccgagggcaucuccgggagcaacuccuucagcuucaucgagucccccggcaagggcuacgcgaucgucgacgagccguucagcgagaucccccgccagggguuccugggcgagauccggugcaacuccgagagcuccgugcucagcgcccacgaguccugccugcgcgcccccaaccugaucagcuacaagcccaugaucgaccagcucgagugcaccaccaaccugaucgacccguucguggucuucgagcgggggucccugccccagacgcgcaacgacaagaccuucgccgccagcaagggcaaccgcggggugcaggcguucuccaagggcagcgugcaggccgaccucacccugauguucgacaacuucgaggucgacuucgugggcgccgccguguccugcgacgcggccuuccugaaccucaccgggugcuacagcugcaacgccggcgcccgggucugccuguccaucacgagcaccgggaccggcacccugagcgcccacaacaaggacggcucccuccacaucgugcugcccagcgagaacgggacgaaggaccagugccagauccugcacuucaccguccccgagguggaggaggaguucauguacuccugcgacggcgacgagcgcccgcuccuggugaaggggacccugaucgcgaucgaccccuucgacgaccggcgcgaggccggcggggagagcaccgucgugaaccccaaguccggcagcuggaacuucuucgacugguucuccggccucaugagcugguucgggggcccccugaagacgauccugcucaucugccuguacguggcccuguccaucgggcuguucuuccugcugaucuaccucggccggaccgggcugagcaagauguggcuggccgccaccaagaaggcguccuga

SEQ ID NO: 12762 - RNA, 3594 nt, Artificial Sequence
  derived and/or modified CDS sequence (opt1) from RVFV(SA-51 (Van Wyck))__DQ380195.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccgcggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcggguggucgugaagcgcgagcucagcgcgaagcccauccagcggguggagcccugcacgaccugcaucaccaagugcgagccccacggccuggucgugcgcuccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccguggccaucaucugccucgcgauccuguacaagguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacagcaccuaccugaugcugcuccugaucgucuccuacgccagcgcgugcuccgagcugauccaggccagcucccgcaucaccacgugcagcaccgagggcgugaacaccaagugccggcucuccgggaccgcccugauccgcgccggcagcgugggggccgaggcgugccugaugcucaagggcgucaaggaggaccagacgaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgccgaguucagcuucgugggggaguccaccacgaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggaggugaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgcgaucguggacgagccguucagcgagaucccccgccagggguuccugggcgagauccggugcaacuccgagagcuccgugcucagcgcccacgaguccugccugcgcgcccccaaccugaucagcuacaagcccaugaucgaccagcucgagugcaccaccaaccugaucgacccguucgucguguucgagcgggggucccugccccagacgcgcaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgcgaucgaccccuucgacgaccggcgcgaggccggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccggaccgggcugagcaagauguggcuggccgccaccaagaaggcguccuga

SEQ ID NO: 12763 - RNA, 3594 nt, Artificial Sequence
  derived and/or modified CDS sequence (opt1) from RVFV(OS-8)__DQ380185.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcgucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccgucgccaucaucugccucgcgauccuguacaaggugcugaagugccucaagaucgcgccccgcaaggugcugaacccccugauguggaucaccgccuucauccggugggucuacaagaagaugguggcccgcguggccgacaacaucaaccaggucaaccgcgagaucggguggauggagggcggccagcucgcccuggggaacccggcccccaucccccggcacgcccccaucccgcgcuacagcaccuaccugaugcugcuccugaucguguccuacgccagcgcgugcuccgagcugauccaggccagcucccggaucaccacgugcagcaccgagggcgugaacaccaagugccgccucuccgggaccgcccugauccgggccggcagcgucggggccgaggcgugccugaugcucaagggcgugaaggaggaccagacgaaguuccugcgcaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgcgaucguggacgagccguucagcgagaucccccgccagggguuccugggcgagauccggugcaacuccgagagcuccgugcucagcgcccacgaguccugccugcgcgcccccaaccugaucagcuacaagcccaugaucgaccagcucgagugcaccaccaaccugaucgacccguucgucguguucgagcgggggucccugccccagacgcgcaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucagcgggugcuacuccugcaacgccggcgcccgggugugccugagcaucaccagcacggggaccggcacccuguccgcccacaacaaggacggcagccuccacaucguccugcccuccgagaacgggaccaaggaccagugccagauccugcacuucacggugcccgagguggaggaggaguucauguacagcugcgacggcgacgagcgcccgcuccuggucaaggggacccugaucgcgaucgaccccuucgacgaccggcgcgaggccggcggggaguccaccguggugaaccccaagagcggcuccuggaacuucuucgacugguucagcggccucauguccugguucgggggcccccugaagaccauccugcucaucugccuguacgucgcccugagcaucgggcuguucuuccugcugaucuaccucggccggacggggcuguccaagauguggcuggccgccaccaagaaggcgagcuga

SEQ ID NO: 12764 - RNA, 3594 nt, Artificial Sequence
  derived and/or modified CDS sequence (opt1) from RVFV(BIME-01)__KX609032.1__GP
auguacgugcugcucaccauccugaucagcguccuggugugcgaggccaucauccgcgugucccucagcuccacccgggaggagacgugcuucggcgacagcaccaaccccgagaugaucgagggggccugggacucccugcgcgaggaggagaugccggaggagcugagcugcuccaucagcggcauccgggaggucaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucgugcgcugcgagcggcgccgggacgccaagcagaucggccgcgagaccauggcggggaucgccaugaccguccugcccgcccuggccguguucgcgcucgcccccguggucuucgccgaggacccccaccuccggaaccgccccggcaaggggcacaacuacaucgacggcaugacccaggaggacgcgaccugcaagccggugacguacgccggggccugcagcuccuucgacgugcugcucgagaagggcaaguucccccuguuccagagcuacgcccaccaccggacccugcucgaggccguccacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgucugcgaggugggggugcaggcccucaagaagugcgacggccagcuguccaccgcgcacgaggucgugcccuucgccguguucaagaacagcaagaaggucuaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgucggcuacgagcgcgugguggucaagcgggagcucagcgcgaagcccauccagcgcguggagcccugcacgaccugcaucaccaagugcgagccccacggccuggugguccgguccaccggguucaagaucagcuccgccguggccugcgccagcggcgugugcgucaccgggucccagagcccgagcaccgagaucacccugaaguaccccggcaucucccagagcuccgggggcgacaucggcgugcacauggcccacgacgaccagagcguguccagcaagaucgucgcgcacugcccgccccaggaccccugccucgugcacgggugcaucgugugcgcccacggccugaucaacuaccagugccacacggcccuguccgccuucgucgugguguucgucuucagcuccguggccaucaucugccucgcgauccuguacaaggugcugcgcugccucaagaucgcccccaagaagguccugaacccccugauguggaucaccgccuucauccgguggguguacaagaagaugguggcccgcgucgccgacaacaucaaccaggugaaccgcgagaucggguggauggagggcggccagcucgcgcuggggaacccggcccccaucccccggcacgcccccaucccgcgcuacagcaccuaccugaugcugcuccugaucaucuccuacgccagcgcgugcuccgagcugauccaggccagcucccggaucaccacgugcagcaccgagggcgugaacaccaagugccgccucuccgggaccgcccugauccgggccggcagcgucggggccgaggcgugccugaugcucaagggcgugaaggaggaccagacgaaguuccugaagaucaagaccgugagcuccgagcugagcugccgcgagggccaguccuacuggaccgggagcuucucccccaagugccucagcucccggcgcugccaccuggucggcgagugccacgugaaccggugccugagcuggcgcgacaacgagaccuccgccgaguucagcuucgugggggaguccaccacgaugcgggagaacaagugcuucgagcagugcggcggguggggcugcggcugcuucaacgucaaccccagcugccucuucgugcacaccuaccugcaguccgugcgcaaggaggcccugcgggucuucaacugcaucgacugggugcacaagcucacccuggagaucaccgacuucgacgggagcguguccacgaucgaccugggcgccagcuccagccgcuucaccaacuggggguccgucagccucagccuggacgccgagggcaucuccgggagcaacuccuucagcuucaucgagucccccggcaagggcuacgcgaucguggacgagccguucagcgagaucccccggcagggguuccugggcgagauccgcugcaacuccgagagcuccgugcucagcgcccacgaguccugccugcgggcccccaaccugaucagcuacaagcccaugaucgaccagcucgagugcaccaccaaccugaucgacccguucgucguguucgagcgcgggucccugccccagacgcggaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucaccgggugcuacagcugcaacgccggcgcccgcgugugccuguccaucacgagcaccgggaccggcacccugagcgcccacaacaaggacggcucccuccacaucgugcugcccagcgagaacgggacgaaggaccagugccagauccugcacuucaccguccccgagguggaggaggaguucauguacuccugcgacggcgacgagcggccgcuccuggucaaggggacccugaucgcgaucgaccccuucgacgaccgccgggaggccggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccgcaccgggcugagcaagauguggcuggccgccaccaagaaggcguccuga

SEQ ID NO: 12765 - RNA, 3594 nt, Artificial Sequence
  derived and/or modified CDS sequence (opt1) from RVFV(Kenya 83 (21445))__DQ380198.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaagaaccccgagaacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcgauccuguaccgcgugcugaagugccucaagaucgcgccccggaagguccugaacccccugauguggaucaccgccuucauccgcuggguguacaagaagaugguggcccgcgucgccgacaacaucaaccaggugaaccgggagaucggguggauggagggcggccagcucgcccuggggaacccggcccccaucccccgccacgcccccaucccgcgguacagcaccuaccugaugcugcuccugaucguguccuacgccagcgcgugcuccgagcugauccaggccagcucccgcaucaccacgugcagcaccgagggcgucaacaccaagugccggcucuccgggaccgcccugauccgcgccggcagcgugggggccgaggcgugccugaugcucaagggcgugaaggaggaccagacgaaguuccugaagaucaagaccgucagcuccgagcugagcugccgggagggccaguccuacuggaccgggagcuucucccccaagugccucagcucccgccggugccaccuggugggcgagugccacgugaaccgcugccugagcuggcgggacaacgagaccuccgccgaguucagcuucgucggggaguccaccacgaugcgcgagaacaagugcuucgagcagugcggcggguggggcugcggcugcuucaacgugaaccccagcugccucuucgugcacaccuaccugcaguccguccggaaggaggcccugcgcguguucaacugcaucgacugggugcacaagcucacccuggagaucaccgacuucgacgggagcgucuccacgaucgaccugggcgccagcuccagccgguucaccaacuggggguccgugagccucagccuggacgccgagggcaucuccgggagcaacuccuucagcuucaucgagucccccggcaagggcuacgcgaucguggacgagccguucagcgagaucccccgccagggguuccugggcgagauccggugcaacuccgagagcuccguccucagcgcccacgaguccugccugcgcgcccccaaccugaucagcuacaagcccaugaucgaccagcucgagugcaccaccaaccugaucgacccguucgugguguucgagcgggggucccugccccagacgcgcaacgacaagaccuucgccgccagcaagggcaaccgcgggguccaggcguucuccaagggcagcgugcaggccgaccucacccugauguucgacaacuucgagguggacuucgucggcgccgccguguccugcgacgcggccuuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgaggucgaggaggaguucauguacuccugcgacggcgacgagcgcccgcuccuggugaaggggacccugaucgcgaucgaccccuucgacgaccggcgcgaggccggcggggagagcaccguggucaaccccaaguccggcagcuggaacuucuucgacugguucuccggccucaugagcugguucgggggcccccugaagacgauccugcucaucugccuguacguggcccuguccaucgggcuguucuuccugcugaucuaccucggccggaccgggcugagcaagauguggcuggccgccaccaagaaggcguccuga

SEQ ID NO: 12766 - RNA, 3594 nt, Artificial Sequence
  derived and/or modified CDS sequence (opt1) from RVFV(2007000253)__JF326192.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacagcaccuaccugaugcugcuccugaucgucuccuacgccagcgcgugcuccgagcugauccaggccagcucccgcaucacgaccugcagcaccgagggcgugaacaccaagugccggcucuccgggacggcccugauccgcgccggcagcgccggggcggaggccugccugaugcucaagggcgugaaggaggaccagaccaaguuccugaagaucaagaccgucagcuccgagcugagcugccgggagggccaguccuacuggaccgggagcuucucccccaagugccucagcucccgccggugccaccuggugggcgagugccacgugaaccgcugccugagcuggcgggacaacgagaccuccgccgaguucagcuucgucggggaguccacgaccaugcgcgagaacaagugcuucgagcagugcggcggguggggcugcggcugcuucaacgugaaccccagcugccucuucgugcacaccuaccugcaguccguccggaaggaggcccugcgcguguucaacugcaucgacugggugcacaagcucacccuggagaucacggacuucgacgggagcgucuccaccaucgaccugggcgccagcuccagccgguucaccaacuggggguccgugagccucagccuggacgcggagggcaucuccgggagcaacuccuucagcuucaucgagucccccggcaagggcuacgccaucguggacgagccguucagcgagaucccccgccagggguuccugggcgagauccggugcaacuccgagagcuccguccucagcgcccacgaguccugccugcgcgcccccaaccuggugagcuacaagcccaugaucgaccagcucgagugcaccacgaaccugaucgacccguucguggucuucgagcgggggucccugccccagacccgcaacgacaagaccuucgccgcgagcaagggcaaccgcggggugcaggccuucuccaagggcagcgugcaggccgaccucacccugauguucgacaacuucgaggucgacuucgugggcgccgcgguguccugcgacgccgccuuccugaaccucacggggugcuacagcugcaacgccggcgcccgggucugccuguccaucaccagcaccgggaccggcacgcugagcgcgcacaacaaggacggcucccuccacaucgugcugcccagcgagaacgggaccaaggaccagugccagauccugcacuucaccguccccgagguggaggaggaguucauguacuccugcgacggcgacgagcgcccgcuccuggugaaggggacccugaucgccaucgaccccuucgacgaccggcgcgaggccggcggggagagcacggucgugaaccccaaguccggcagcuggaacuucuucgacugguucuccggccucaugagcugguucgggggcccccugaagaccauccugcucaucugccuguacguggcccuguccaucgggcuguucuuccugcugaucuaccucggccggaccgggcugagcaagauguggcuggccgcgaccaagaaggccuccuga

SEQ ID NO: 12767 - RNA, 3594 nt, Artificial Sequence
  derived and/or modified CDS sequence (opt1) from RVFV(200803166)__JF311381.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucaagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacagcaccuaccugaugcugcuccugaucguguccuacgccaccgccugcagcgagcugauccaggcguccagccgcaucacgaccugcuccaccgagggcgugaacaccaagugccggcucagcgggacggcccugauccgcgccggcuccgucggggccgaggccugccugaugcucaagggcgugaaggaggaccagaccaaguuccugaagaucaagaccgugagcagcgagcuguccugccgggagggccagagcuacuggaccggguccuucagccccaagugccucuccagccgccggugccaccuggucggcgagugccacgugaaccgcugccuguccuggcgggacaacgagaccagcgcggaguucuccuucgugggggagagcacgaccaugcgcgagaacaagugcuucgagcagugcggcggguggggcugcggcugcuucaacgucaaccccuccugccucuucgugcacaccuaccugcagagcgugcggaaggaggcccugcgcgucuucaacugcaucgacugggugcacaagcucacccuggagaucacggacuucgacggguccgugagcaccaucgaccugggcgccuccagcucccgguucaccaacugggggagcgucucccucagccuggacgccgagggcaucagcggguccaacagcuucuccuucaucgagagccccggcaagggcuacgccaucguggacgagccguucuccgagaucccccgccagggguuccugggcgagauccggugcaacagcgaguccagcgugcucuccgcgcacgagagcugccugcgcgcccccaaccugaucuccuacaagcccaugaucgaccagcucgagugcaccacgaaccugaucgacccguucgucguguucgagcgggggagccugccccagacccgcaacgacaagaccuucgccgccuccaagggcaaccgcggggugcaggccuucagcaagggcuccguccaggcggaccucacccugauguucgacaacuucgagguggacuucgugggcgccgccgucagcugcgacgccgcguuccugaaccucacggggugcuacuccugcaacgccggcgcccgggugugccugagcaucaccuccaccgggaccggcacgcugagcgcccacaacaaggacggcagccuccacgucgugcugcccuccgagaacgggaccaaggaccagugccagauccugcacuucaccgugcccgaggucgaggaggaguucauguacagcugcgacggcgacgagcgcccgcuccuggugaaggggacccugaucgccaucgaccccuucgacgaccggcgcgaggcgggcggggaguccacgguggucaaccccaagagcggcuccuggaacuucuucgacugguucagcggccucauguccugguucgggggcccccugaagaccauccugcucaucugccuguacguggcccugagcaucgggcuguucuuccugcugaucuaccucggccggaccgggcuguccaagauguggcuggccgccaccaagaaggccagcuga

SEQ ID NO: 12768 - RNA, 3594 nt, Artificial Sequence
  derived and/or modified CDS sequence (opt1) from RVFV(2007001107)__EU574047.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccaaccaggagcucuaccgcgcgcugaaggccaucaucgccgccgacgggcugaacaacaucacgugccacggcaagaaccccgaggacaagaucagccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcuccagcuucgacgugcugcucgagaagggcaaguucccccuguuccaguccuacgcccaccaccggacccugcucgaggccgugcacgacaccaucaucgccaaggccgacccgcccagcugcgaccugcaguccgcgcacggcaaccccugcaugaaggagaagcuggucaugaagacccacugccccaacgacuaccagagcgcccacuaccucaacaacgacgggaagauggccuccgugaagugcccgcccaaguacgagcugacggaggacugcaacuucugccgccagaugaccggcgccagccugaagaagggguccuacccccuccaggaccuguucugccagagcagcgaggacgacggcuccaagcugaagaccaagaugaagggcgugugcgaggucggggugcaggcccucaagaagugcgacggccagcugagcaccgcgcacgaggugguccccuucgccguguucaagaacuccaagaagguguaccuggacaagcucgaccugaagacggaggagaaccugcuccccgacagcuucgucugcuucgagcacaaggggcaguacaagggcaccauggacuccgggcagaccaagcgggagcucaagagcuucgacaucucccagugccccaagaucggcggccacgggagcaagaagugcaccggcgacgccgccuucugcuccgccuacgagugcacggcgcaguacgccaacgccuacugcagccacgccaacggguccggcaucgugcagauccaggucagcgggguguggaagaagccgcugugcgugggcuacgagcgcgucguggugaagcgggagcuguccgcgaagcccauccagcgcgucgagcccugcacgaccugcaucaccaagugcgagccccacggccugguggugcggagcaccggguucaagaucuccagcgccgucgccugcgccuccggcgugugcgugaccgggagccaguccccgagcaccgagaucacccugaaguaccccggcaucagccaguccagcgggggcgacaucggcguccacauggcccacgacgaccaguccgugagcuccaagaucguggcgcacugcccgccccaggaccccugccucguccacgggugcaucgugugcgcccacggccugaucaacuaccagugccacacggcccugagcgccuucguggucaucuucguguucuccagcaccgccaucaucugccucgcggugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacuccaccuaccugaugcugcuccugaucgucagcuacgccuccgcgugcagcgagcugauccaggccuccagccgcaucacgaccugcuccaccgagggcgugaacaccaagugccggcucagcgggacggcccugauccgcgccggcuccgugggggccgaggcgugccugaugcucaagggcgucaaggaggaccagaccaaguuccugaagaucaagaccgugagcagcgagcuguccugccgggagggccagagcuacuggaccggguccuucagccccaagugccucuccagccgccggugccaccuggugggcgagugccacgucaaccgcugccuguccuggcgggacaacgagaccagcgccgaguucuccuucgugggggagagcacgaccaugcgcgagaacaagugcuucgagcagugcggcggguggggcugcggcugcuucaacgugaaccccuccugccucuucguccacaccuaccugcagagcgugcggaaggaggcccugcgcguguucaacugcaucgacuggguccacaagcucacccuggagaucacggacuucgacggguccgugagcaccaucgaccugggcgccuccagcucccgguucaccaacugggggagcgugucccucagccuggacgccgagggcaucagcggguccaacagcuucuccuucaucgagagccccggcaagggcuacgcgaucgucgacgagccguucuccgagaucccccgccagggguuccugggcgagauccggugcaacagcgaguccagcgugcucuccgcccacgagagcugccugcgcgcccccaaccugguguccuacaagcccaugaucgaccagcucgagugcaccacgaaccugaucgacccguucgucguguucgagcgggggagccugccccagacccgcaacgacaagaccuucgccgccuccaagggcaaccgcggggugcaggcguucagcaagggcuccguccaggccgaccucacccugauguucgacaacuucgagguggacuucgugggcgccgccgucagcugcgacgcggccuuccugaaccucacggggugcuacuccugcaacgccggcgcccgggugugccugagcaucaccuccaccgggaccggcacgcugagcgcccacaacaaggacggcagccuccacaucguccugcccuccgagaacgggaccaaggaccagugccagauccugcacuucaccgugcccgagguggaggaggaguucauguacagcugcgacggcgacgagcgcccgcuccuggucaaggggacccugaucgcgaucgaccccuucgacgaccggcgcgaggccggcggggaguccacgguggugaaccccaagagcggcuccuggaacuucuucgacugguucagcggccucauguccugguucgggggcccccugaagaccauccugcucaucugccuguacgucgcccugagcaucgggcuguucuuccugcugaucuaccucggccggaccgggcuguccaagauguggcuggccgccaccaagaaggcgagcuga

SEQ ID NO: 12769 - RNA, 3594 nt, Artificial Sequence
  derived and/or modified CDS sequence (opt1) from RVFV(ANK-3837)__DQ380215.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaagcuggacagcgggcagaccaagcgggagcugaaguccuucgacaucagccagugccccaagaucggcggccacggguccaagaagugcaccggcgacgccgccuucugcagcgccuacgagugcaccgcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugacggggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgggugcaucgucugcgcccacggccugaucaacuaccagugccacaccgcccucuccgccuucgugguggucuucguguucagcuccaucgccaucaucugccuggcgauccuguaccgcgugcucaagugccugaagaucgcgccccggaagguccugaacccccucauguggaucacggccuucauccgcuggguguaccgcaagaugguggcccgggucgccgacaacaucaaccaggugaaccgcgagaucggguggauggagggcggccagcuggugcuggggaacccggcccccaucccccggcacguccccaucccgcgcuacagcaccuaccugaugcuccugcugaucguguccuacgccagcgccugcuccgagcucauccaggccagcucccggaucacgaccugcagcaccgagggcgugaacaccaagugccgccuguccgggaccgcgcugauccgggccggcagcgucggggccgaggccugccucaugcugaagggcgugaaggaggaccagaccaaguuccugaagaucaagacggugagcuccgagcucagcugccgcgagggccaguccuacuggaccgggagcuucucccccaagugccugagcucccggcgcugccaccuggucggcgagugccacgugaaccggugccucagcuggcgcgacaacgagaccuccgccgaguucagcuucgugggggaguccaccaccaugcgggagaacaagugcuucgagcagugcggcggguggggcugcggcugcuucaacgucaaccccagcugccuguucgugcacacguaccugcaguccgugcgcaaggaggcgcuccgggucuucaacugcaucgacugggugcacaagcugacccuggagaucaccgacuucgacgggagcguguccaccaucgaccucggcgccagcuccagccgcuucacgaacuggggguccgucagccugagccuggacgccgagggcaucuccgggagcaacuccuucagcuucaucgagucccccggcaagggcuacgccaucguggacgagccguucagcgagaucccccggcagggguuccucggcgagauccgcugcaacuccgagagcuccgugcugagcgcccacgaguccugccugcgggcgcccaaccucaucagcuacaagcccaugaucgaccagcuggagugcaccaccaaccugaucgacccguucgucguguucgagcgcgggucccucccccagacccgcaacgacaagacguucgccgccagcaagggcaaccgcggggugcaggccuucuccaagggcagcguccaggccgaccugacccugauguucgacaacuucgagguggacuucgugggcgcggccgucuccugcgacgccgccuuccucaaccugaccgggugcuacagcugcaacgcgggcgcccgggugugccuguccaucaccagcacggggaccggcacccucagcgcccacaacaaggacggcucccugcacaucguccugcccagcgagaacgggaccaaggaccagugccagauccuccacuucacggugcccgagguggaggaggaguucauguacuccugcgacggcgacgagcggccgcugcugguccgcgggacccucaucgccaucgaccccuucgacgaccggcgcgaggccggcggggagagcaccguggugaaccccaaguccggcagcuggaacuucuucgacugguucuccggccugaugagcugguucgggggcccccugaagaccauccuccugaucugccuguacgucgcgcucuccaucgggcuguucuuccugcucaucuaccugggccggacggggcugagcaagauguggcucgccgccaccaagaaggccuccuga

SEQ ID NO: 12770 - RNA, 3594 nt, Artificial Sequence
  derived and/or modified CDS sequence (opt1) from RVFV(OS-1)__DQ380186.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcagcgcgacgccaagcagaucggccgggagaccauggcggggaucgccaugaccgugcugcccgcccuggccguguucgcgcucgcccccgucguguucgccgaggacccccaccuccgcaaccggcccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccgcacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccggcagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgcgagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcgucgugcagauccaggucuccgggguguggaagaagccgcugugcgugggcuacgagcgggucguggugaagcgcgagcucagcgcgaagcccauccagcgggucgagcccugcacgaccugcaucaccaagugcgagccccacggccugguggugcgcuccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccgucgccaucaucugccucgcgauccuguacaaggugcugaagugccucaagaucgcgccccggaaggugcugaacccccugauguggaucaccgccuucauccgcugggucuacaagaagaugguggcccggguggccgacaacaucaaccaggucaaccgcgagaucggguggauggagggcggccagcucgcccuggggaacccggcccccaucccccgccacgcccccaucccgcgguacagcaccuaccugaugcugcuccugaucguguccuacgccagcgcgugcuccgagcugauccaggccagcucccgcaucaccacgugcagcaccgagggcgugaacaccaagugccggcucuccgggaccgcccugauccgcgccggcagcgucggggccgaggcgugccugaugcucaagggcgugaaggaggaccagacgaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugaaggucuucaacugcaucgacugggugcacaagcucacccuggagaucaccgacuucgacgggagcguguccacgaucgaccugggcgccagcuccagccgcuucaccaacuggggguccgucagccucagccuggacgccgagggcaucuccgggagcaacuccuucagcuucaucgagucccccggcaagggcuacgcgaucguggacgagccguucagcgagaucccccggcagggguuccugggcgagauccgcugcaacuccgagagcuccgugcucagcgcccacgaguccugccugcgggcccccaaccugaucagcuacaagcccaugaucgaccagcucgagugcaccaccaaccugaucgacccguucgucguguucgagcgcgggucccugccccagacgcggaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgcgaucgaccccuucgacgaccgccgggaggccggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccgcaccgggcugagcaagauguggcuggccgccaccaagaaggcguccuga

SEQ ID NO: 12771 - RNA, 3594 nt, Artificial Sequence
  derived and/or modified CDS sequence (opt1) from RVFV(Sudan 2V-2007)__JQ820490.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugcuccguccacgggugcaucgugugcgcccacggccucaucaacuaccagugccacacggcccugagcgccuucguggucguguucguguucuccagcaucgccaucaucugccuggcgauccucuaccgcguccugaagugccugaagaucgcgccccggaaggugcucaacccccugauguggaucaccgccuucauccgcuggguguacaagaagauggucgcccgcguggccgacaacaucaaccaggugaaccgggagaucggguggauggagggcggccagcugguccucgggaacccggcccccaucccccgccacgcccccaucccgcgguacuccaccuaccugaugcugcugcucaucgugagccacgccuccgccugcagcgagcugauccaggcguccagccgcaucaccacgugcuccaccgagggcgugaacaccaagugccggcugagcgggaccgcccucauccgcgccggcagcgucggggccgaggccugccugaugcugaagggcgugaaggaggaccagacgaaguuccucaagaucaagaccguguccagcgagcuguccugccgggagggccagagcuacuggaccggguccuucagccccaagugccuguccagccgccggugccaccucgucggcgagugccacgugaaccgcugccuguccuggcgggacaacgagaccagcgcggaguucuccuucgugggggagagcaccacgaugcgcgagaacaagugcuucgagcagugcggcggguggggcugcggcugcuucaacgucaaccccuccugccuguucgugcacaccuaccuccagagcgugcggaaggaggcccugcgcgucuucaacugcaucgacugggugcacaagcugacccucgagaucaccgacuucgacggguccgugagcacgaucgaccugggcgccuccagcucccgguucaccaacugggggagcgucagccugucccucgacgccgagggcaucagcggguccaacagcuucuccuucaucgagagccccggcaagggcuacgccaucguggacgagccguucuccgagaucccccgccagggguuccugggcgagauccggugcaacagcgaguccagcgugcuguccgcgcacgagagcugccuccgcgcccccaaccugaucuccuacaagcccaugaucgaccagcuggagugcaccaccaaccucaucgacccguucgucguguucgagcgggggagccugccccagacgcgcaacgacaagaccuucgccgccuccaagggcaaccgcggggugcaggccuucagcaagggcuccguccaggcggaccugacccucauguucgacaacuucgagguggacuucgugggcgccgccgucagcugcgacgccgcguuccugaaccugaccgggugcuacuccugcaacgccggcgcccgggugugccucagcaucacgagcaccgggaccggcacccuguccgcccacaacaaggacggcagccugcacaucguccuccccuccgagaacgggacgaaggaccagugccagauccugcacuucaccgugcccgagguggaggaggaguucauguacagcugcgacggcgacgagcgcccgcugcucgucaaggggacccugauggccaucgaccccuucgacgaccggcgcgaggcgggcggggaguccaccguggugaaccccaagagcggcuccuggaacuucuucgacugguucagcggccugauguccugguucgggggcccccucaagacgauccugcugaucugccucuacgucgcccugagcaucgggcuguucuuccuccugaucuaccugggccggaccgggcucuccaagauguggcuggccgccaccaagaaggccagcuga

SEQ ID NO: 12772 - RNA, 3594 nt, Artificial Sequence
  derived and/or modified CDS sequence (opt1) from RVFV(200803162)__JF311377.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucgccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcgcacgacgaccagagcguguccagcaagaucguggcccacugcccgccccaggaccccugccucguccacgacugcaucgugugcgcccacgggcugaucaacuaccagugccacaccgcccuguccgccuucguggucaucuucguguucagcuccacggcgaucaucugccucgccgugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggcuggauggagggcgggcagcucgcccugcgcaacccggcccccaucccccggcacgcccccaucccgcgcuacagcaccuaccugaugcugcuccugaucgucuccuacgcgagcgccugcuccgagcugauccaggccagcucccggaucaccacgugcagcaccgagggcgugaacaccaagugccgccucuccgggaccgcccugauccgggccggcagcgugggggcggaggccugccugaugcucaagggcgucaaggaggaccagacgaaguuccugaagaucaagaccgugagcuccgagcugagcugccgcgaggggcaguccuacuggaccggcagcuucucccccaagugccucagcucccggcgcugccaccuggugggcgagugccacgucaaccggugccugagcuggcgcgacaacgagaccuccgccgaguucagcuucgugggggaguccaccacgaugcgggagaacaagugcuucgagcagugcggcggguggggcugcgggugcuucaacgugaaccccagcugccucuucguccacaccuaccugcaguccgugcgcaaggaggcccugcggguguucaacugcaucgacuggguccacaagcucacccuggagaucaccgacuucgacggcagcguguccacgaucgaccugggcgccagcuccagccgcuucaccaacuggggguccgugagccucagccuggacgcggagggcaucuccgggagcaacuccuucagcuucaucgagucccccggcaagggguacgccaucgucgacgagccguucagcgagaucccccggcagggcuuccugggcgagauccgcugcaacuccgagagcuccgugcucagcgcccacgaguccugccugcgggcccccaaccuggugagcuacaagcccaugaucgaccagcucgagugcaccaccaaccugaucgacccguucgucguguucgagcgcgggucccugccccagacgcgcaacgacaagaccuucgccgcgagcaagggcaaccgcggggugcaggccuucuccaagggcagcguccaggccgaccucacccugauguucgacaacuucgagguggacuucgugggggccgcggucuccugcgacgccgccuuccugaaccucaccggcugcuacagcugcaacgccggcgcccgggugugccuguccaucacgagcaccgggaccggcacccugagcgcgcacaacaaggacgggucccuccacaucguccugcccagcgagaacggcacgaaggaccagugccagauccugcacuucaccgugcccgagguggaggaggaguucauguacuccugcgacggcgacgagcggccgcuccuggucaaggggacccugaucgccaucgaccccuucgacgaccgccgggaggccggcggggagagcaccguggugaaccccaaguccggcagcuggaacuucuucgacugguucuccgggcucaugagcugguucggcggcccccugaagacgauccugcucaucugccuguacgucgcccuguccaucgggcuguucuuccugcugaucuaccucggccgcaccgggcugagcaagauguggcuggccgcgaccaagaaggccuccuga

SEQ ID NO: 12773 - RNA, 3594 nt, Artificial Sequence
  derived and/or modified CDS sequence (opt1) from RVFV(2007001811)__EU574040.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgugaacaccaagugccggcucuccgggaccgcccugauccgcgccggcagcgucggggccgaggccugccugaugcucaagggcgugaaggaggaccagacgaaguuccugaugaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgcggaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucgucguguucgagcgggggucccugccccagacgcgcaacgagaagaccuucgccgccagcaagggcaaccgcggggugcaggccuucuccaagggcagcguccaggcggaccucacccugauguucgacaacuucgagguggacuucgugggcgccgccgucuccugcgacgccgcguuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgccaucgaccccuucgacgaccggcgcgaggcgggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccggaccgggcugagcaagauguggcuggccgccaccaagaaggccuccuga

SEQ ID NO: 12774 - RNA, 3594 nt, Artificial Sequence
  derived and/or modified CDS sequence (opt1) from RVFV(clone 13)__DQ380213.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaagcacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagaacccgagcaccgagaucacccugaaguaccccggcaucagccaguccagcgggggcgacaucggcgugcacauggcccacgacgaccaguccgucagcuccaagaucguggcgcacugcccgccccaggaccccugccucgugcacgggugcaucgucugcgcccacggccugaucaacuaccagugccacacggcccugagcgccuucgugguggucuucguguucuccagcaucgccaucaucugccucgcgauccuguaccgcgugcugaagugccucaagaucgcgccccggaagguccugaacccccugauguggaucaccgccuucauccgcuggguguacaagaagaugguggcccgcgucgccgacaacaucaaccaggugaaccgggagaucggguggauggagggcggccagcucgugcuggggaacccggcccccaucccccgccacgcccccaucccgcgguacuccaccuaccugaugcugcuccugaucgucagcuacgccuccgccugcagcgagcugauccaggcguccagccgcaucaccacgugcuccaccgagggcgugaacaccaagugccggcucagcgggaccgcccugauccgcgccggcuccgugggggccgaggccugccugaugcucaagggcgucaaggacgaccagacgaaguuccugaagaucaagaccgugagcagcgagcuguccugccgggagggccagagcuacuggaccggguccuucagccccaagugccucuccagccgccggugccaccuggugggcgagugccacgucaaccgcugccuguccuggcgggacaacgagaccagcgcggaguucuccuucgugggggagagcaccacgaugcgcgagaacaagugcuucgagcagugcggcggguggggcugcggcugcuucaacgugaaccccuccugccucuucguccacaccuaccugcagagcgugcggaaggaggcccugcgcguguucaacugcaucgacuggguccacaagcucacccuggagaucaccgacuucgacggguccgugagcacgaucgaccugggcgccuccagcucccgguucaccaacugggggagcgugucccucagccuggacgccgagggcaucagcggguccaacagcuucuccuucaucgagagccccggcaagggcuacgccaucgucgacgagccguucuccgagaucccccgccagggguuccugggcgagauccggugcaacagcgaguccagcgugcucuccgcgcacgagagcugccugcgcgcccccaaccugaucuccuacaagcccaugaucgaccagcucgagugcaccaccaaccugaucgacccguucguggucuucgagcgggggagccugccccagacgcgcaacgagaagaccuucgccgccuccaagggcaaccgcggggugcaggccuucagcaagggcuccgugcaggcggaccucacccugauguucgacaacuucgaggucgacuucgugggcgccgccgugagcugcgacgccgcguuccugaaccucaccgggugcuacuccugcaacgccggcgcccgggucugccugagcaucacguccaccgggaccggcacccugagcgcccacaacaaggacggcagccuccacaucgugcugcccuccgagaacgggacgaaggaccagugccagauccugcacuucaccguccccgagguggaggaggaguucauguacagcugcgacggcgacgagcgcccgcuccuggugaaggggacccugaucgccaucgaccccuucgacgaccggcgcgaggcgggcggggaguccaccgucgugaaccccaagagcggcuccuggaacuucuucgacugguucagcggccucauguccugguucgggggcccccugaagacgauccugcucaucugccuguacguggcccugagcaucgggcuguucuuccugcugaucuaccucggccggaccgggcuguccaagauguggcuggccgccaccaagaaggccagcuga

SEQ ID NO: 12775 - RNA, 3594 nt, Artificial Sequence
  derived and/or modified CDS sequence (opt1) from RVFV(MP12)__Z30318.1__GP
auguacgugcugcucaccauccugaccagcguccuggugugcgaggccaucauccgcgugucccucagcuccacgcgggaggagaccugcuucggcgacagcaccaaccccgagaugaucgagggggccugggacucccugcgcgaggaggagaugccggaggagcugagcugcuccaucagcggcauccgggaggucaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucgugcgcugcgagcggcgccgggacgccaagcagaucggccgcaagaccauggcggggaucgccaugaccguccugcccgcccuggccguguucgcgcucgcccccguggucuucgccgaggacccccaccuccggaaccgccccggcaaggggcacaacuacaucgacggcaugacccaggaggacgccacgugcaagccggugaccuacgccggggcgugcagcuccuucgacgugcugcuggagaagggcaaguucccccuguuccagagcuacgcccaccaccggacccugcucgaggccguccacgacaccaucaucgccaaggccgacccgcccuccugcgaccugcugagcgcgcacggcaaccccugcaugaaggagaagcucgugaugaagacgcacugccccaacgacuaccaguccgcccaccaccugaacaacgacgggaagauggccagcgugaagugcccgcccaaguacgagcugaccgaggacugcaacuucugccgccagaugaccggcgccucccucaagaaggggagcuacccccugcaggaccuguucugccagagcuccgaggacgacggcagcaagcucaagaccaagaugaagggcgucugcgaggugggggugcaggcccugaagaagugcgacggccagcuguccacggcgcacgaggucgugcccuucgccguguucaagaacagcaagaaggucuaccucgacaagcuggaccugaagaccgaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcacgggcgacgccgccuucugcagcgccuacgagugcaccgcgcaguacgccaacgccuacugcucccacgccaacgggagcggcaucgugcagauccaggucuccgggguguggaagaagccgcucugcgucggcuacgagcgcgugguggucaagcgggagcugagcgcgaagcccauccagcgcguggagcccugcacgaccugcaucaccaagugcgagccccacggccuggugguccgguccaccggguucaagaucagcuccgccguggccugcgccagcggcgugugcgucaccgggucccagagcccgagcaccgagaucacgcucaaguaccccggcaucucccagagcuccgggggcgacaucggcgugcacauggcccacgacgaccagagcguguccagcaagaucgucgcgcacugcccgccccaggaccccugccuggugcacgacugcaucgugugcgcccacgggcugaucaacuaccagugccacaccgcccucuccgccuucgucgugguguucgucuucagcuccaucgccaucaucugccuggcgauccuguaccgcgugcucaagugccugaagaucgcgccccggaaggugcugaacccccucauguggaucaccgccuucauccgcuggaucuacaagaagauggucgcccgcguggcccacaacaucaaccaggugaaccgggagaucggcuggauggagggcgggcagcugguccugggcaacccggcgcccaucccccgccacgcccccaucccgcgguacagcaccuaccugaugcuccugcugaucguguccuacgccagcgccugcuccgagcucauccaggcgagcucccgcaucacgaccugcagcaccgagggggugaacaccaagugccggcuguccggcacggcccugauccgcgccgggagcgucggcgccgaggccugccucaugcugaagggggugaaggaggaccagaccaaguuccugaagcucaagaccgugagcuccgagcugagcugccgggagggccaguccuacuggaccggcagcuucucccccaagugccugagcucccgccggugccaccucgucggggagugccacgugaaccgcugccugagcuggcgggacaacgagaccuccgcggaguucagcuucgugggcgaguccacgaccaugcgcgagaacaagugcuucgagcagugcgggggcugggggugcggcugcuucaacgucaaccccagcugccuguucgugcacaccuaccuccaguccgugcggaaggaggcccugcgcgucuucaacugcaucgacugggugcacaagcugacccucgagaucacggacuucgacggcagcguguccaccaucgaccugggggccagcuccagccgguucaccaacuggggcuccgucagccugagccucgacgccgaggggaucuccggcagcaacuccuucagcuucaucgagucccccgggaagggcuacgccaucguggacgagccguucagcgagaucccccgccagggcuuccugggggagauccggugcaacuccgagagcuccgugcugagcgcgcacgaguccugccuccgcgcccccaaccugaucagcuacaagcccaugaucgaccagcuggagugcaccacgaaccucaucgacccguucgucguguucgagcggggcucccugccccagacccgcaacgacaagaccuucgccgccagcaaggggaaccgcggcgugcaggccuucuccaaggggagcguccaggcggaccugacccucauguucgacaacuucgagguggacuucgugggcgccgccgucuccugcgacgccgcguuccugaaccugacgggcugcuacagcugcaacgccggggcccgggugugccucuccaucaccagcaccggcaccgggagccuguccgcccacaacaaggacggcagccugcacaucgugcuccccuccgagaacggcacgaaggaccagugccagauccugcacuucaccguccccgagguggaggaggaguucauguacagcugcgacggggacgagcgcccgcugcucgucaagggcacccugaucgccaucgaccccuucgacgaccggcgcgaggccgggggcgaguccaccguggugaaccccaagagcggguccuggaacuucuucgacugguucagcggccugauguccugguucggcgggccccucaagacgauccugcugaucugccucuacgucgcccugagcaucggccuguucuuccuccugaucuaccucgggggcaccgggcuguccaagauguggcuggccgccaccaagaaggccagcuga

SEQ ID NO: 12776 - RNA, 3594 nt, Artificial Sequence
  derived and/or modified CDS sequence (opt1) from RVFV__JQ068143.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccaucgacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccguggccaucaucugccucgcgauccuguacaagguccugcgcugccucaagaucgcccccaagaaggugcugaacccccugauguggaucaccgccuucauccgguggguguacaagaagauggucgcccgcguggccgacaacaucaaccaggugaaccgcgagaucggguggauggagggcggccagcucgcgcuggggaacccggcccccaucccccggcacgcccccaucccgcgcuacagcaccuaccugaugcugcuccugaucaucuccuacgccagcgcgugcuccgagcugauccaggccagcucccggaucaccacgugcagcaccgagggcgucaacaccaagugccgccucuccgggaccgcccugauccgggccggcagcgugggggccgaggcgugccugaugcucaagggcgugaaggaggaccagacgaaguuccugaagaucaagaccgucagcuccgagcugagcugccgcgagggccaguccuacuggaccgggagcuucucccccaagugccucagcucccggcgcugccaccuggugggcgagugccacgugaaccggugccugagcuggcgcgacaacgagaccuccgccgaguucagcuucgucggggaguccaccacgaugcgggagaacaagugcuucgagcagugcggcggguggggcugcggcugcuucaacgugaaccccagcugccucuucgugcacaccuaccugcaguccguccgcaaggaggcccugcggguguucaacugcaucgacugggugcacaagcucacccuggagaucaccgacuucgacgggagcgucuccacgaucgaccugggcgccagcuccagccgcuucaccaacuggggguccgugagccucagccuggacgccgagggcaucuccgggagcaacuccuucagcuucaucgagucccccggcaagggcuacgcgaucguggacgagccguucagcgagaucccccggcagggguuccugggcgagauccgcugcaacuccgagagcuccguccucagcgcccacgaguccugccugcgggcccccaaccugaucagcuacaagcccaugaucgaccagcucgagugcaccaccaaccugaucgacccguucgugguguucgagcgcgggucccugccccagacgcggaacgacaagaccuucgccgccagcaagggcaaccgcgggguccaggcguucuccaagggcagcgugcaggccgaccucacccugauguucgacaacuucgagguggacuucgucggcgccgccguguccugcgacgcggccuuccugaaccucaccgggugcuacagcugcaacgccggcgcccgcgugugccuguccaucacgagcaccgggaccggcacccugagcgcccacaacaaggacggcucccuccacaucguccugcccagcgagaacgggacgaaggaccagugccagauccugcacuucaccgugcccgaggucgaggaggaguucauguacuccugcgacggcgacgagcggccgcuccuggugaaggggacccugaucgcgaucgaccccuucgacgaccgccgggaggccggcggggagagcaccguggucaaccccaaguccggcagcuggaacuucuucgacugguucuccggccucaugagcugguucgggggcccccugaagacgauccugcucaucugccuguacguggcccuguccaucgggcuguucuuccugcugaucuaccucggccgcaccgggcugagcaagauguggcuggccgccaccaagaaggcguccuga

SEQ ID NO: 12777 - RNA, 3594 nt, Artificial Sequence
  derived and/or modified CDS sequence (opt1) from RVFV(2007002445)__EU574037.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacagcaccuaccugaugcugcuccugaucgucuccuacgccagcgcgugcuccgagcugauccaggccagcucccgcaucacgaccugcagcaccgagggcgugaacaccaagugccggcucuccgggacggcccugauccgcgccggcagcgugggggccgaggcgugccugaugcucaagggcgucaaggaggaccagaccaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgccgaguucagcuucgugggggaguccacgaccaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucacggacuucgacgggagcguguccaccaucgaccugggcgccagcuccagccgguucaccaacuggggguccgugagccucagccuggacgccgagggcaucuccgggagcaacuccuucagcuucaucgagucccccggcaagggcuacgcgaucgucgacgagccguucagcgagaucccccgccagggguuccugggcgagauccggugcaacuccgagagcuccgugcucagcgcccacgaguccugccugcgcgcccccaaccuggugagcuacaagcccaugaucgaccagcucgagugcaccacgaaccugaucgacccguucgucguguucgagcgggggucccugccccagacccgcaacgagaagaccuucgccgccagcaagggcaaccgcggggugcaggcguucuccaagggcagcauccaggccgaccucacccugauguucgacaacuucgaggucgacuucgugggcgccgccguguccugcgacgcggccuuccugaaccucacggggugcuacagcugcaacgccggcgcccgggucugccuguccaucaccagcaccgggaccggcacgcugagcgcccacaacaaggacggcucccuccacaucgugcugcccagcgagaacgggaccaaggaccagugccagauccugcacuucaccguccccgagguggaggaggaguucauguacuccugcgacggcgacgagcgcccgcuccuggugaaggggacccugaucgcgaucgaccccuucgacgaccggcgcgaggccggcggggagagcacggucgugaaccccaaguccggcagcuggaacuucuucgacugguucuccggccucaugagcugguucgggggcccccugaagaccauccugcucaucugccuguacguggcccuguccaucgggcuguucuuccugcugaucuaccucggccggaccgggcugagcaagauguggcuggccgccaccaagaaggcguccuga

SEQ ID NO: 12778 - RNA, 3594 nt, Artificial Sequence
  derived and/or modified CDS sequence (opt1) from RVFV(2008/00101)__HE687306.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacagcaccuaccugaugcugcuccugaucgucuccuacgccagcgcgugcuccgagcugauccaggccagcucccgcaucacgaccugcagcaccgagggcgugaacaccaagugccggcucuccgggacggcccugauccgcgccggcagcgugggggccgaggcgugccugaugcucaagggcgucaaggaggaccagaccaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgccgaguucagcuucgugggggaguccacgaccaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucacggacuucgacgggagcguguccaccaucgaccugggcgccagcuccagccgguucaccaacuggggguccgugagccucagccuggacgccgagggcaucuccgggagcaacuccuucagcuucaucgagucccccggcaagggcuacgcgaucgucgacgagccguucagcgagaucccccgccagggguuccugggcgagauccggugcaacuccgagagcuccgugcucagcgcccacgaguccugccugcgcgcccccaaccuggugagcuacaagcccaugaucgaccagcucgagugcaccacgaaccugaucgacccguucgucguguucgagcgggggucccugccccagacccgcaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucacggggugcuacagcugcaacgccggcgcccgggugugccuguccaucaccagcaccgggaccggcacgcugagcgcccacaacaaggacggcucccuccacaucguccugcccagcgagaacgggaccaaggaccagugccagauccugcacuucaccgugcccgagguggaggaggaguucauguacuccugcgacggcgacgagcgcccgcuccuggucaaggggacccugaucgcgaucgaccccuucgacgaccggcgcgaggccggcggggagagcacgguggugaaccccaaguccggcagcuggaacuucuucgacugguucuccggccucaugagcugguucgggggcccccugaagaccacccugcucaucugccuguacgucgcccuguccaucgggcuguucuuccugcugaucuaccucggccggaccgggcugagcaagauguggcuggccgccacgaagaaggcguccuga

SEQ ID NO: 12779 - RNA, 3594 nt, Artificial Sequence
  derived and/or modified CDS sequence (opt1) from RVFV(Hv-B375)__DQ380218.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgagggcgagaugccggaggagcugagcugcuccaucagcgggauccgggaggugaagaccuccagccaggagcucuaccgcgcgcugaaggccaucaucgccgccgacggccugaacaacaucacgugccacgggaaggaccccgaggacaagaucucccucaucaagggcccgccccacaagaagcgggugggcaucguccgcugcgagcggcgccgggacgccaagcagaucgggcgcgagaccauggcgggcaucgccaugaccgugcugcccgcccuggccguguucgcgcucgcccccgucguguucgccgaggacccccaccuccggaaccgccccgggaagggccacaacuacaucgacgggaugacccaggaggacgcgaccugcaagccggugacguacgccggcgcgugcagcuccuucgacguccugcuggagaagggcaaguucccccuguuccagagcuacgcccaccaccggacccugcucgaggccgugcacgacaccaucaucgccaaggccgacccgcccuccugcgaccugcagagcgcgcacgggaaccccugcaugaaggagaagcuggugaugaagacccacugccccaacgacuaccaguccgcccacuaccucaacaacgacggcaagauggccagcgucaagugcccgcccaagaacgagcugacggaggacugcaacuucugccgccagaugaccggggccucccugaagaagggcagcuacccccuccaggaccuguucugccagagcuccgaggacgacggcagcaagcugaagaccaagaugaagggggugugcgaggugggcguccaggcccucaagaagugcgacgggcagcuguccaccgcgcacgagguggugcccuucgccgucuucaagaacagcaagaagguguaccuggacaagcucgaccugaagacggaggagaaccugcuccccgacuccuucgugugcuucgagcacaagggccaguacaaggggaccauggacagcggccagaccaagcgggagcugaaguccuucgacaucagccagugccccaagaucggcgggcacggcuccaagaagugcaccggggacgccgccuucugcagcgccuacgagugcacggcgcaguacgccaacgccuacugcucccacgccaacggcagcgggaucguccagauccagguguccggcgucuggaagaagccgcugugcgugggcuacgagcgcguggucgugaagcgggagcucagcgcgaagcccauccagcgcguggagcccugcacgaccugcaucaccaagugcgagccccacgggcuggucgugcgguccaccggcuucaagaucagcuccgccguggccugcgccagcggggucugcgugaccggcucccagagcccgagcaccgagaucacccugaaguaccccgggaucucccagagcuccggcggcgacaucggggugcacauggcccacgacgaccagagcgucuccagcaagaucguggcgcacugcccgccccaggaccccugccucgugcacggcugcaucgucugcgcccacgggcugaucaacuaccagugccacacggcccuguccgccuucgugguggucuucguguucagcuccaucgccaucaucugccucgcgauccuguaccgcgugcugaagugccucaagaucgcgccccggaagguccugaacccccugauguggaucaccgccuucauccgcuggguguacaagaagaugguggcccgcgucgccgacaacaucaaccaggugaaccgggagaucggcuggauggagggcgggcagcucgugcugggcaacccggcccccaucccccgccacgcccccaucccgcgguacagcaccuaccugaugcugcuccugaucgucuccuacgccagcgccugcuccgagcugauccaggcgagcucccgcaucaccacgugcagcaccgagggggugaacaccaagugccggcucuccggcaccgcccugauccgcgccgggagcgugggcgccgaggccugccugaugcucaagggcgucaaggaggaccagacgaaguuccugaagaucaagaccgugagcuccgagcugagcugccgggaggggcaguccuacuggaccggcagcuucucccccaagugccucagcucccgccggugccaccuggugggggagugccacgucaaccgcugccugagcuggcgggacaacgagaccuccgcggaguucagcuucgugggcgaguccaccacgaugcgcgagaacaagugcuucgagcagugcgggggcuggggcugcgggugcuucaacgugaaccccagcugccucuucguccacaccuaccugcaguccgugcggaaggaggcccugcgcguguucaacugcaucgacuggguccacaagcucacccuggagaucaccgacuucgacggcagcguguccacgaucgaccugggggccagcuccagccgguucaccaacuggggcuccgugagccucagccuggacgccgaggggaucuccggcagcaacuccuucagcuucaucgagucccccggcaagggguacgccaucgucgacgagccguucagcgagaucccccgccagggcuuccugggggagauccggugcaacuccgagagcuccgugcucagcgcgcacgaguccugccugcgcgcccccaaccugaucagcuacaagcccaugaucgaccagcucgagugcaccaccaaccugaucgacccguucguggucuucgagcggggcucccugccccagacgcgcaacgacaagaccuucgccgccagcaaggggaaccgcggcgugcaggccuucuccaagggcagcgugcaggcggaccucacccugauguucgacaacuucgaggucgacuucgugggggccgccguguccugcgacgccgcguuccugaaccucaccggcugcuacagcugcaacgccggggcccgggucugccuguccaucacgagcaccggcaccggcacccugagcgcccacaacaaggacgggucccuccacaucgugcugcccagcgagaacggcacgaaggaccagugccagauccugcacuucaccguccccgagguggaggaggaguucauguacuccugcgacggggacgagcgcccgcuccuggugaagggcacccugaucgccaucgaccccuucgacgaccggcgcgaggccgggggcgagagcaccgucgugaaccccaaguccggcagcuggaacuucuucgacugguucuccgggcucaugagcugguucggcgggccccugaagacgauccugcucaucugccuguacguggcccuguccaucggccucuucuuccugcugaucuaccucgggcggaccggccugagcaagauguggcuggccgccaccaagaaggccuccuga

SEQ ID NO: 12780 - RNA, 3594 nt, Artificial Sequence
  derived and/or modified CDS sequence (opt1) from RVFV(763/70)__DQ380188.1__GP
auguacgugcugcucaccauccugaucaccguccuggugugcgaggccgugauccgcgucagccucuccagcacgcgggaggagaccugcuucggcgacuccaccaaccccgagaugaucgagggggccugggacagccugcgcgaggaggagaugccggaggagcuguccugcagcaucuccggcauccgggaggugaagaccagcucccaggagcucuaccgcgcgcugaaggccaucaucgccgccgacgggcugaacaacaucacgugccacggcaaggaccccgaggacaagaucagccucgugaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgccacgugcaagccggucaccuacgccggggcgugcuccagcuucgacgugcugcuggagaagggcaaguucccccuguuccaguccuacgcccaccaccggacccugcucgaggccgugcacgacaccaucaucgccaaggccgacccgcccagcugcgaccugcaguccgcgcacggcaaccccugcaugaaggagaagcuggucaugaagacgcacugccccaacgacuaccagagcgcccacuaccucaacaacgacgggaagauggccuccgugaagugcccgcccaaguacggccugaccgaggacugcaacuucugccgccagaugaccggggccagccugaagaagggcuccuacccccuccaggaccuguucugccagagcagcgaggacgacggcuccaagcugaagaccaagaugaagggggugugcgaggucggcgugcaggcccucaagaagugcgacgggcagcugagcacggcgcacgaggugguccccuucgccguguucaagaacuccaagaagguguaccuggacaagcucgaccugaagaccgaggagaaccugcuccccgacagcuucgucugcuucgagcacaagggccaguacaaggggaccauggacuccggccagaccaagcgggagcucaagagcuucgacaucucccagugccccaagaucggcgggcacggcagcaagaagugcacgggggacgccgccuucugcuccgccuacgagugcaccgcgcaguacgccaacgccuacugcagccacgccaacggcuccgggaucgugcagauccaggucagcggcguguggaagaagccgcugugcgugggcuacgagcgcgucguggugaagcgggagcuguccgcgaagcccauccagcgcgucgagcccugcacgaccugcaucaccaagugcgagccccacgggcugguggugcggagcaccggcuucaagaucuccagcgccgucgccugcgccuccggggugugcgugaccggcagccaguccccgagcaccgagaucacgcugaaguaccccgggaucagccaguccagcggcggcgacaucgggguccacauggcccacgacgaccaguccgugagcuccaagaucguggcgcacugcccgccccaggaccccugccucguccacggcugcaucgugugcgcccacgggcugaucaacuaccagugccacaccgcccugagcgccuucguggucguguucguguucuccagcgucgccaucaucugccucgcgauccuguacaaggugcugaagugccucaagaucgcgccccgcaaggugcugaacccccugauguggaucaccgccuucauccggugggucuacaagaagaugguggcccgcguggccgacaacaucaaccaggucaaccgcgagaucggcuggauggagggcgggcagcucgcccugggcaacccggcccccaucccccggcacgcccccaucccgcgcuacuccaccuaccugaugcugcuccugaucgugagcuacgccuccgcgugcagcgagcugauccaggccuccagccggaucacgaccugcuccaccgagggggugaacaccaagugccgccucagcggcacggcccugauccgggccggguccgucggcgccgaggcgugccugaugcucaagggcgugaaggaggaccagaccaaguuccugaagaucaagaccgugagcagcgagcuguccugccgcgaggggcagagcuacuggaccggcuccuucagccccaagugccucuccagccggcgcugccaccuggucggggagugccacgugaaccggugccuguccuggcgcgacaacgagaccagcgccgaguucuccuucgugggcgagagcacgaccaugcgggagaacaagugcuucgagcagugcgggggcuggggcugcgggugcuucaacgucaaccccuccugccucuucgugcacaccuaccugcagagcgugcgcaaggaggcccugcgggucuucaacugcaucgacugggugcacaagcucacccuggagaucacggacuucgacggcuccgugagcaccaucgaccugggggccuccagcucccgcuucaccaacuggggcagcgucucccucagccuggacgccgaggggaucagcggcuccaacagcuucuccuucaucgagagccccggcaagggguacgcgaucguggacgagccguucuccgagaucccccggcagggcuuccugggggagauccgcugcaacagcgaguccagcgugcucuccgcccacgagagcugccugcgggcccccaaccugaucuccuacaagcccaugaucgaccagcucgagugcaccacgaaccugaucgacccguucgucguguucgagcgcggcagccugccccagacccggaacgacaagaccuucgccgccuccaaggggaaccgcggcgugcaggcguucagcaagggcuccguccaggccgaccucacccugauguucgacaacuucgagguggacuucgugggggccgccgucagcugcgacgcggccuuccugaaccucacgggcugcuacuccugcaacgccggggcccgcgugugccugagcaucaccuccaccggcaccggcacgcugagcgcccacaacaaggacgggagccuccacaucguccugcccuccgagaacggcaccaaggaccagugccagauccugcacuucaccgugcccgagguggaggaggaguucauguacagcugcgacggggacgagcggccgcuccuggucaagggcacccugaucgcgaucgaccccuucgacgaccgccgggaggccgggggcgaguccacgguggugaaccccaagagcggcuccuggaacuucuucgacugguucagcgggcucauguccugguucggcgggccccugaagaccauccugcucaucugccuguacgucgcccugagcaucggccucuucuuccugcugaucuaccucgggcgcaccggccuguccaagauguggcuggccgccaccaagaaggcgagcuga

SEQ ID NO: 12781 - RNA, 3594 nt, Artificial Sequence
  derived and/or modified CDS sequence (opt1) from RVFV(RVFBJ01/2016)__KX785331.1__GP
auguacgugcugcucaccauccugaucagcguccuggugugcgaggccaucauccgcgugucccucagcuccacccgggaggagacgugcuucggcgacagcaccaaccccgagaugaucgagggggccugggacucccugcgcgaggaggagaugccggaggagcugagcugcuccaucagcggcauccgggaggucaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucgugcgcugcgagcggcgccgggacgccaagcagaucggccgcgagaccauggcggggaucgccaugaccguccugcccgcccuggccguguucgcgcucgcccccguggucuucgccgaggacccccaccuccggaaccgccccggcaaggggcacaacuacaucgacggcaugacccaggaggacgcgaccugcaagccggugacguacgccggggccugcagcuccuucgacgugcugcucgagaagggcaaguucccccuguuccagagcuacgcccaccaccggacccugcucgaggccguccacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgugaagugcccgcccaagcacgagcugacggaggacugcaacuucugccgccagaugaccggcgccucccugaagaaggggagcuacccccuccaggaccuguucugccagagcuccgaggacgacggcagcaagcugaagaccaagaugaagggcgucugcgaggugggggugcaggcccucaagaagugcgacggccagcuguccaccgcgcacgaggucgugcccuucgccguguucaagaacagcaagaaggucuaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgucggcuacgagcgcgugguggucaagcgggagcucagcgcgaagcccauccagcgcguggagcccugcacgaccugcaucaccaagugcgagccccacggccuggugguccgguccaccggguucaagaucagcuccgccguggccugcgccagcggcgugugcgucaccgggucccagagcccgagcaccgagaucacccugaaguaccccggcaucucccagagcuccgggggcgacaucggcgugcacauggcccacgacgaccagagcguguccagcaagaucgucgcgcacugcccgccccaggaccccugccucgugcacgggugcaucgugugcgcccacggccugaucaacuaccagugccacacggcccuguccgccuucgucgugguguucgucuucagcuccguggccaucaucugccucgcgauccuguacaaggugcugcgcugccucaagaucgcccccaagaagguccugaacccccugauguggaucaccgccuucauccgguggguguacaagaagaugguggcccgcgucgccgacaacaucaaccaggugaaccgcgagaucggguggauggagggcggccagcucgcgcuggggaacccggcccccaucccccggcacgcccccaucccgcgcuacagcaccuaccugaugcugcuccugaucaucuccuacgccagcgcgugcuccgagcugauccaggccagcucccggaucaccacgugcagcaccgagggcgugaacaccaagugccgccucuccgggaccgcccugauccgggccggcagcgucggggccgaggcgugccugaugcucaagggcgugaaggaggaccagacgaaguuccugaagaucaagaccgugagcuccgagcugagcugccgcgagggccaguccuacuggaccgggagcuucucccccaagugccucagcucccggcgcugccaccuggucggcgagugccacgugaaccggugccugagcuggcgcgacaacgagaccuccgccgaguucagcuucgugggggaguccaccacgaugcgggagaacaagugcuucgagcagugcggcggguggggcugcggcugcuucaacgucaaccccagcugccucuucgugcacaccuaccugcaguccgugcgcaaggaggcccugcgggucuucaacugcaucgacugggugcacaagcucacccuggagaucaccgacuucgacgggagcguguccacgaucgaccugggcgccagcuccagccgcuucaccaacuggggguccgucagccucagccuggacgccgagggcaucuccgggagcaacuccuucagcuucaucgagucccccggcaagggcuacgcgaucguggacgagccguucagcgagaucccccggcagggguuccugggcgagauccgcugcaacuccgagagcuccgugcucagcgcccacgaguccugccugcgggcccccaaccugaucagcuacaagcccaugaucgaccagcucgagugcaccaccaaccugaucgacccguucgucguguucgagcgcgggucccugccccagacgcggaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucaccgggugcuacagcugcaacgccggcgcccgcgugugccuguccaucacgagcaccgggaccggcacccugagcgcccacaacaaggacggcucccuccacaucgugcugcccagcgagaacgggacgaaggaccagugccagauccugcacuucaccguccccgagguggaggaggaguucauguacuccugcgacggcgacgagcggccgcuccuggucaaggggacccugaucgcgaucgaccccuucgacgaccgccgggaggccggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccgcaccgggcugagcaagauguggcuggccgccaccaagaaggcguccuga

SEQ ID NO: 12782 - RNA, 3594 nt, Artificial Sequence
  derived and/or modified CDS sequence (opt1) from RVFV(Lunyo)__KU167026.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggucagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccgucgccaucaucugccucgcgauccuguacaaggugcugaagugccucaagaucgcgccccgcaaggugcugaacccccugauguggaucaccgccuucauccggugggucuacaagaagaugguggcccgcguggccgacaacaucaaccaggucaaccgcgagaucggguggauggagggcggccagcucgcccuggggaacccggcccccaucccccggcacgcccccaucccgcgcuacagcaccuaccugaugcugcuccugaucguguccuacgccagcgcgugcuccgagcugauccaggccagcucccggaucaccacgugcagcaccgagggcgugaacacccgcugccggcucuccgggaccgcccugauccgcgccggcagcgucggggccgaggcgugccugaugcucaagggcgugaaggaggaccagacgaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgcgaucguggacgagccguucagcgagaucccccgccagggguuccugggcgagauccggugcaacuccgagagcuccgugcucagcgcccacgaguccugccugcgcgcccccaaccugaucagcuacaagcccaugaucgaccagcucgagugcaccaccaaccugaucgacccguucgucguguucgagcgggggucccugccccagacgcgcaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgcgaucgaccccuucgacgaccggcgcgaggccggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccggaccgggcugagcaagauguggcuggccgccaccaagaaggcguccuga

SEQ ID NO: 12783 - RNA, 3594 nt, Artificial Sequence
  derived and/or modified CDS sequence (opt1) from RVFV(2007000234)__JF326191.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagauccgccgggagaccauggcgggcaucgccaugaccgugcugcccgcccuggccgucuucgcgcucgcccccgugguguucgccgaggacccccaccuccgcaaccggcccgggaagggccacaacuacaucgacgggaugacccaggaggacgcgaccugcaagccggucacguacgccggcgccugcagcuccuucgacgugcugcuggagaaggggaaguucccccuguuccagagcuacgcccaccaccgcacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacggcaagauggccagcgugaagugcccgcccaaguacgagcugacggaggacugcaacuucugccggcagaugaccggggccucccugaagaagggcagcuacccccuccaggaccuguucugccagagcuccgaggacgacgggagcaagcugaagaccaagaugaagggcgugugcgaggucggcgugcaggcccucaagaagugcgacgggcagcuguccaccgcgcacgaggugguccccuucgccguguucaagaacagcaagaagguguaccuggacaagcucgaccugaagacggaggagaaccugcuccccgacuccuucgucugcuucgagcacaagggccaguacaaggggaccauggacagcggccagaccaagcgcgagcugaaguccuucgacaucagccagugccccaagaucgggggccacggcuccaagaagugcaccggggacgccgccuucugcagcgccuacgagugcacggcgcaguacgccaacgccuacugcucccacgccaacggcagcgggaucgugcagauccaggucuccggcguguggaagaagccgcugugcgugggguacgagcgggucguggugaagcgcgagcucagcgcgaagcccauccagcgggucgagcccugcacgaccugcaucaccaagugcgagccccacggccugguggugcgcuccaccggcuucaagaucagcuccgccgucgccugcgccagcggggugugcgugaccggcucccagagcccgagcaccgagaucacccugaaguaccccgggaucucccagagcuccggcggggacaucggcguccacauggcccacgacgaccagagcguguccagcaagaucguggcgcacugcccgccccaggaccccugccucguccacggcugcaucgugugcgcccacgggcugaucaacuaccagugccacacggcccuguccgccuucguggucaucuucguguucagcuccaccgccaucaucugccucgcggugcuguaccggguccugaagugccucaagaucgcgccccgcaaggugcugaacccccugauguggaucaccgccuucauccgcuggguguacaagaagauggucgcccggguggccgacaacaucaaccaggugaaccgcgagaucggcuggauggagggcgggcagcucgcccugggcaacccggcccccaucccccggcacgcccccaucccgcgcuacagcaccuaccugaugcugcuccugaucgucuccuacgccagcgcgugcuccgagcugauccaggccagcucccggaucacgaccugcagcaccgagggggugaacaccaagugccgccucuccggcacggcccugauccgggccgggagcgugggcgccgaggcgugccugaugcucaagggggucaaggaggaccagaccaaguuccugaagaucaagaccgugagcuccgagcugagcugccgcgagggccaguccuacuggaccggcagcuucucccccaagugccucagcucccggcgcugccaccuggugggggagugccacgucaaccggugccugagcuggcgcgacaacgagaccuccgccgaguucagcuucgugggcgaguccacgaccaugcgggagaacaagugcuucgagcagugcgggggcugggggugcggcugcuucaacgugaaccccagcugccucuucguccacaccuaccugcaguccgugcgcaaggaggcccugcggguguucaacugcaucgacuggguccacaagcucacccuggagaucacggacuucgacggcagcguguccaccaucgaccugggggccagcuccagccgcuucaccaacuggggcuccgugagccucagccuggacgccgaggggaucuccggcagcaacuccuucagcuucaucgagucccccgggaagggcuacgcgaucgucgacgagccguucagcgagaucccccggcagggcuuccugggggagauccgcugcaacuccgagagcuccgugcucagcgcccacgaguccugccugcgggcccccaaccuggugagcuacaagcccaugaucgaccagcucgagugcaccacgaaccugaucgacccguucgucguguucgagcgcggcucccugccccagacccgcaacgacaagaccuucgccgccagcaaggggaaccggggcgugcaggcguucuccaaggggagcguccaggccgaccucacccugauguucgacaacuucgagguggacuucgugggcgccgccgucuccugcgacgcggccuuccugaaccucacgggcugcuacagcugcaacgccggggcccgcgugugccuguccaucaccagcaccggcaccgggacgcugagcgcccacaacaaggacggcucccuccacaucguccugcccagcgagaacggcaccaaggaccagugccagauccugcacuucaccgugcccgagguggaggaggaguucauguacuccugcgacggggacgagcggccgcuccuggucaagggcacccugaucgcgaucgaccccuucgacgaccgccgggaggccgggggcgagagcacgguggugaaccccaaguccgggagcuggaacuucuucgacugguucuccggccucaugagcugguucggcgggccccugaagaccauccugcucaucugccuguacgucgcccuguccaucggccucuucuuccugcugaucuaccucgggcgcaccggccugagcaagauguggcuggccgccaccaagaaggcguccuga

SEQ ID NO: 12784 - RNA, 3594 nt, Artificial Sequence
  derived and/or modified CDS sequence (opt1) from RVFV(KEN07-KUR340)__EF460404.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcaugcugaagugccucaagaucgcgccccggaucguccugaacccccugauguggaucaccgccuucauccgcuggguguacaagaagaugguggcccgcgucgccgacaacaucaaccaggugaaccgggagaucggguggauggagggcggccagcucgcccuggggaacccggcccccaucccccgccacgcccccaucccgcgguacagcaccuaccugaugcugcuccugaucguguccuacgccagcgcgugcuccgagcugauccaggccagcucccgcaucacgaccugcagcaccgagggcgucaacaccaagugccggcucuccgggacggcccugauccgcgccggcagcgugggggccgaggcgugccugaugcucaagggcgugaaggaggaccagaccaaguuccugaagaucaagaccgucagcuccgagcugagcugccgggagggccaguccuacuggaccgggagcuucucccccaagugccucagcucccgccggugccaccuggugggcgagugccacgugaaccgcugccugagcuggcgggacaacgagaccuccgccgaguucagcuucgucggggaguccacgaccaugcgcgagaacaagugcuucgagcagugcggcggguggggcugcggcugcuucaacgugaaccccagcugccucuucgugcacaccuaccugcaguccguccggaaggaggcccugcgcguguucaacugcaucgacugggugcacaagcucacccuggagaucacggacuucgacgggagcgucuccaccaucgaccugggcgccagcuccagccgguucaccaacuggggguccgugagccucagccuggacgccgagggcaucuccgggagcaacuccuucagcuucaucgagucccccggcaagggcuacgcgaucguggacgagccguucagcgagaucccccgccagggguuccugggcgagauccggugcaacuccgagagcuccguccucagcgcccacgaguccugccugcgcgcccccaaccuggugagcuacaagcccaugaucgaccagcucgagugcaccacgaaccugaucgacccguucguggucuucgagcgggggucccugccccagacccgcaacgacaagaccuucgccgccagcaagggcaaccgcggggugcaggcguucuccaagggcagcgugcaggccgaccucacccugauguucgacaacuucgaggucgacuucgugggcgccgccguguccugcgacgcggccuuccugaaccucacggggugcuacagcugcaacgccggcgcccgggucugccuguccaucaccagcaccgggaccggcacgcugagcgcccacaacaaggacggcucccuccacaucgugcugcccagcgagaacgggaccaaggaccagugccagauccugcacuucaccguccccgagguggaggaggaguucauguacuccugcgacggcgacgagcgcccgcuccuggugaaggggacccugaucgcgaucgaccccuucgacgaccggcgcgaggccggcggggagagcacggucgugaaccccaaguccggcagcuggaacuucuucgacugguucuccggccucaugagcugguucgggggcccccugaagaccauccugcucaucugccuguacguggcccuguccaucgggcuguucuuccugcugaucuaccucggccggaccgggcugagcaagauguggcuggccgccaccaagaaggcguccuga

SEQ ID NO: 12785 - RNA, 3594 nt, Artificial Sequence
  derived and/or modified CDS sequence (opt1) from RVFV(2373/74)__DQ380194.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugcuacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaugguggcgcacugcccgccccaggaccccugccucgugcacgggugcaucgucugcgcccacggccugaucaacuaccagugccacacggcccuguccgccuucgugguggucuucguguucagcuccguggccaucaucugccucgcgauccuguacaagguccugaagugccucaagaucgcgccccgcaaggugcugaacccccugauguggaucaccgccuucauccgguggguguacaagaagauggucgcccgcguggccgacaacaucaaccaggugaaccgcgagaucggguggauggagggcggccagcucgcccuggggaacccggcccccaucccccggcacgcccccaucccgcgcuacagcaccuaccugaugcugcuccugaucgucuccuacgccagcgcgugcuccgagcugauccaggccagcucccggaucaccacgugcagcaccgagggcgugaacaccaagugccgccucuccgggaccgcccugauccgggccggcagcgugggggccgaggcgugccugaugcucaagggcgucaaggaggaccagacgaaguuccugaagaucaagaccgugagcuccgagcugagcugccgcgagggccaguccuacuggaccgggagcuucucccccaagugccucagcucccggcgcugccaccuggugggcgagugccacgucaaccggugccugagcuggcgcgacaacgagaccuccgccgaguucagcuucgugggggaguccaccacgaugcgggagaacaagugcuucgagcagugcggcggguggggcugcggcugcuucaacgugaaccccagcugccucuucguccacaccuaccugcaguccgugcgcaaggaggcccugcggguguucaacugcaucgacuggguccacaagcucacccuggagaucaccgacuucgacgggagcguguccacgcuggaccucggcgccagcuccagccgcuucaccaacuggggguccgugagccugagccuggacgccgagggcaucuccgggagcaacuccuucagcuucaucgagucccccggcaagggcuacgcgaucgucgacgagccguucagcgagaucccccggcagggguuccucggcgagauccgcugcaacuccgagagcuccgugcugagcgcccacgaguccugccugcgggcccccaaccucaucagcuacaagcccaugaucgaccagcuggagugcaccaccaaccugaucgacccguucguggucuucgagcgcgggucccucccccagacgcggaacgagaagaccuucgccgccagcaagggcaaccgcggggugcaggcguucuccaagggcagcgugcaggccgaccugacccugauguucgacaacuucgaggucgacuucgugggcgccgccguguccugcgacgcggccuuccucaaccugaccgggugcuacagcugcaacgccggcgcccgcgucugccuguccaucacgagcaccgggaccggcacccucagcgcccacaacaaggacggcucccugcacaucgugcugcccagcgagaacgggacgaaggaccagugccagauccuccacuucaccguccccgagguggaggaggaguucauguacuccugcgacggcgacgagcggccgcugcuggugaaggggacccucaucgcgaucgaccccuucgacgaccgccgggaggccggcggggagagcaccgucgugaaccccaaguccggcagcuggaacuucuucgacugguucuccggccugaugagcugguucgggggcccccugaagacgauccuccugaucugccuguacguggcccucuccaucgggcuguucuuccugcucaucuaccugggccgcaccgggcugagcaagauguggcucgccgccaccaagaaggcguccuga

SEQ ID NO: 12786 - RNA, 3594 nt, Artificial Sequence
  derived and/or modified CDS sequence (opt1) from RVFV(200803169)__JF311384.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacagcaccuaccugaugcugcuccugaucgucuccuacgccagcgcgugcuccgagcugauccaggccagcucccgcaucacgaccugcagcaccgagggcgugaacaccaagugccggcucuccgggacggcccugauccgcgccggcagcgugggggccgaggcgugccugaugcucaagggcgucaagguggaccagaccaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgccgaguucagcuucgugggggaguccacgaccaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucacggacuucgacgggagcguguccaccaucgaccugggcgccagcuccagccgguucaccaacuggggguccgucagccucagccuggacgccgagggcaucuccgggagcaacuccuucagcuucaucgagucccccggcaagggcuacgcgaucguggacgagccguucagcgagaucccccgccagggguuccugggcgaggugcggugcaacuccgagagcuccguccucagcgcccacgaguccugccugcgcgcccccaaccuggugagcuacaagcccaugaucgaccagcucgagugcaccacgaaccugaucgacccguucguggucuucgagcgggggucccugccccagacccgcaacgacaagaccuucgccgccagcaagggcaaccgcggggugcaggcguucuccaagggcagcgugcaggccgaccucacccugauguucgacaacuucgaggucgacuucgugggcgccgccgucuccugcgacgcggccuuccugaaccucacggggugcuacagcugcaacgccggcgcccgggugugccuguccaucaccagcaccgggaccggcacgcugagcgcccacaacaaggacggcucccuccacaucgugcugcccagcgagaacgggaccaaggaccagugccagauccugcacuucaccguccccgagguggaggaggaguucauguacuccugcgacggcgacgagcgcccgcuccuggugaaggggacccugaucgcgaucgaccccuucgacgaccggcgcgaggccggcggggagagcacggucgugaaccccaaguccggcagcuggaacuucuucgacugguucuccggccucaugagcugguucgggggcccccugaagaccauccugcucaucugccuguacguggcccuguccaucgggcuguucuuccugcugaucuaccucggccggaccgggcugagcaagauguggcuggccgccaccaagaaggcguccuga

SEQ ID NO: 12787 - RNA, 3594 nt, Artificial Sequence
  derived and/or modified CDS sequence (opt1) from RVFV(200803167)__JF311382.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggaccugcaccuccggaaccgccccggcaaggggcacaacuacaucgacggcaugacccaggaggacgcgaccugcaagcccgucacguacgccggggccugcagcuccuucgacgugcugcuggagaagggcaaguucccgcuguuccagagcuacgcccaccaccggacccuccuggaggccgugcacgacaccaucaucgccaaggccgacccgcccuccugcgaccugcagagcgcgcacggcaaccccugcaugaaggagaagcucgucaugaagacccacugccccaacgacuaccaguccgcccacuaccugaacaacgacgggaagauggccagcgugaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgaggucggggugcaggcccugaagaagugcgacggccagcuguccaccgcgcacgaggugguccccuucgccguguucaagaacagcaagaagguguaccucgacaagcuggaccugaagacggaggagaaccuccugcccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccccucugcgugggcuacgagcgcgucguggugaagcgggagcugagcgcgaagccgauccagcgcgucgagcccugcacgaccugcaucaccaagugcgagccccacggccugguggugcgguccaccggguucaagaucagcuccgccgucgccugcgccagcggcgugugcgugaccgggucccagagccccagcaccgagaucgcccucaaguacccgggcaucucccagagcuccgggggcgacaucggcguccacauggcgcacgacgaccagagcguguccagcaagaucguggcccacugcccgccccaggaccccugccugguccacgggugcaucgugugcgcccacggccugaucaacuaccagugccacaccgcccucuccgccuucguggucguguucguguucagcuccaucgcgaucaucugccuggccauccuguaccgcguccucaagugccugaagaucgcgccccggaaggugcugaacccccucauguggaucacggccuucauccgcuggguguacaagaagauggucgcccgcguggccgacaacaucaaccaggugaaccgggagaucggguggauggagggcggccagcugguccuggggaaccccgccccgaucccccgccacgcccccaucccccgguacagcaccuaccugaugcuccugcugaucguguccuacgccagcgcgugcuccgagcucauccaggccagcucccgcaucacgaccugcagcaccgagggcgugaacaccaagugccggcuguccgggaccgcccugauccgcgccggcagcgucggggccgaggcgugccucaugcugaagggcgugaaggaggaccagaccaaguuccugaagaucaagacggugagcuccgagcucagcugccgggagggccaguccuacuggaccgggagcuucuccccgaagugccugagcucccgccggugccaccuggucggcgagugccacgugaaccgcugccucagcuggcgggacaacgagaccuccgccgaguucagcuucgugggggaguccaccaccaugcgcgagaacaagugcuucgagcagugcggcggguggggcugcggcugcuucaacgucaaccccagcugccuguucgugcacacguaccugcaguccgugcggaaggaggcccuccgcgucuucaacugcaucgacugggugcacaagcugacccuggagaucaccgacuucgacgggagcguguccaccaucgaccucggcgccagcuccagccgguucacgaacuggggguccgucagccugagccuggacgccgagggcaucuccgggagcaacuccuucagcuucaucgagucccccggcaagggcuacgcgaucguggacgagcccuucagcgagaucccgcgccagggguuccucggcgagauccggugcaacuccgagagcuccgugcugagcgcccacgaguccugccugcgcgcccccaaccucaucagcuacaagcccaugaucgaccagcuggagugcaccaccaaccugaucgaccccuucgucguguucgagcgggggucccucccgcagacccgcaacgacaagacguucgccgccagcaagggcaaccgcggggugcaggcguucuccaagggcagcguccaggccgaccugacccugauguucgacaacuucgagguggacuucgugggcgccgccgucuccugcgacgcggccuuccucaaccugaccgggugcuacagcugcaacgccggcgcccgggugugccuguccaucaccagcacggggaccggcacccucagcgcccacaacaaggacggcucccugcacaucguccugcccagcgagaacgggaccaaggaccagugccagauccuccacuucacggugcccgagguggaggaggaguucauguacuccugcgacggcgacgagcgcccccugcuggucaaggggacccucaucgcgaucgacccguucgacgaccggcgcgaggccggcggggagagcaccguggugaaccccaaguccggcagcuggaacuucuucgacugguucuccggccugaugagcugguucgggggcccccugaagaccaugcuccugaucugccuguacgucgcccucuccaucgggcuguucuuccugcucaucuaccugggccggacggggcugagcaagauguggcucgccgccaccaagaaggcguccuga

SEQ ID NO: 12788 - RNA, 3594 nt, Artificial Sequence
  derived and/or modified CDS sequence (opt1) from RVFV(Entebbe)__DQ380191.1__GP
auguacgcccugcucaccauccugaucagcgugcuggucugcgaggccgugauccgcgugucccucagcuccacccgggaggagacgugcuucggcgacagcaccaaccccgagaugaucgagggggcgugggacucccugcgcgaggaggagaugccggaggagcugagcugcuccaucagcggcauccgggaggucaagaccuccagccaggagcuccaccgcgcccugaaggccaucaucgccgccgacgggcugaacaacaucacgugccacggcaaggaccccgaggacaagaucucccucaucaaggggccgccccacaagaagcgggugggcgugguccgcugcgagcggcgccgggacgcgaagcagaucggccgcgagaccauggccgggaucgccaugaccgugcugcccgcccuggcgguguucgcccucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggcggacccgcccuccugcgaccugcagagcgcccacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcgcucaagaagugcgacggccagcuguccaccgcccacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaucaagcgggagcugaaguccuucgacaucagccagugccccaagaucggcggccacggguccaagaagugcaccggcgacgccgccuucugcagcgcguacgagugcaccgcccaguacgccaacgccuacugcucccacgcgaacgggagcggcaucguccagauccagguguccggggucuggaagaagccgcugugcgugggcuacgagcgcguggucgugaagcgggagcucagcgccaagcccauccagcgcguggagcccugcacgaccugcaucaccaagugcgagccccacggccuggucgugcgguccaccggguucaagaucagcuccgccguggccugcgccagcggcgucugcgugacggggucccagagcccgagcaccgagaucacccugaaguaccccggcaucucccagagcuccgggggcgacaucggcgugcacauggcgcacgacgaccagagcgucuccagcaagaucguggcccacugcccgccccaggaccccugccucgugcacgggugcaucgucugcgcccacggccugaucaacuaccagugccacaccgcccuguccgccuucgugguggucuucguguucagcuccguggcgaucaucugccucgccauccuguacaagguccugaagugccucaagaucgcgccccgcaaggugcugaacccccugauguggaucacggccuucauccgguggguguacaagaagauggucgcccgcguggccgacaacaucaaccaggugaaccgcgagaucggguggauggagggcggccagcucguccuggggaacccggcccccaucccccggcacgcccccaucccgcgcuacagcaccuaccugaugcugcuccugaucguguccuacgccagcgcgugcuccgagcugauccaggccagcucccggaucacgaccugcagcaccgagggcgugaacaccaagugccgccucuccgggaccgcccugauccgggccggcagcgucggggccgaggcgugccugaugcucaagggcgugaaggaggaccagaccaaguuccugaagaucaagacggugagcuccgagcugagcugccgcgagggccaguccuacuggaccgggagcuucucccccaagugccucagcucccggcgcugccaccuggucggcgagugccacgugaaccggugccugagcuggcgcgacaacgagaccuccgccgaguucagcuucgugggggaguccaccaccaugcgggagaacaagugcuucgagcagugcggcggguggggcugcggcugcuucaacgucaaccccagcugccucuucgugcacacguaccugcaguccgugcgcaaggaggcccugcgggucuucaacugcaucgacugggugcacaagcucacccuggagaucaccgacuucgacgggagcguguccaccgucgaccugggcgccagcuccagccgcuucacgaacuggggguccgugagccucagccuggacgccgagggcaucuccgggagcaacuccuucagcuucaucgagucccccggcaagggcuacgcgaucguggacgagccguucagcgagaucccccggcagggguuccugggcgagauccgcugcaacuccgagagcuccguccucagcgcccacgaguccugccugcgggcccccaaccugaucagcuacaagcccaugaucgaccagcucgagugcaccaccaaccugaucgacccguucgugguguucgagcgcgggucccugccccagacccggaacgacaagacguucgccgccagcaagggcaaccgcgggguccaggcguucuccaagggcagcgugcaggccgaccucacccugauguucgacaacuucgagguggacuucgucggcgccgccguguccugcgacgcggccuuccugaaccucaccgggugcuacagcugcaacgccggcgcccgcgucugccuguccaucaccagcacggggaccggcacccugagcgcccacaacaaggacggcucccuccacaucgugcugcccagcgagaacgggaccaaggaccagugccagauccugcacuucacggugcccgaggucgaggaggaguucauguacuccugcgacggcgacgagcggccgcuccuggugaaggggacccugaucgcgaucgaccccuucgacgaccgccgggaggccggcggggagagcaccguggucaaccccaaguccggcagcuggaacuucuucgacugguucuccggccucaugagcugguucgggggcccccugaagaccauccugcucaucugccuguacguggcccuguccaucgggcuguucuuccugcugaucuaccucggccgcacggggcugagcaagauguggcuggccgccaccaagaaggcguccuga

SEQ ID NO: 12789 - RNA, 3594 nt, Artificial Sequence
  derived and/or modified CDS sequence (opt1) from RVFV(25010-24)__KM210509.1__GP
auguacgugcugcucaccauccugaucagcguccuggugugcgaggccgugauccgcgucucccucagcuccacccgggaggagacgugcuucggcgacagcaccaaccccgagaugaucgagcgcgccugggacucccugcgggaggaggagaugccggaggagcugagcugcuccaucagcgggauccgcgaggugaagaccuccagccaggagcucuaccgggcgcugaaggccaucaucgccgccgacggccugaacaacaucacgugccacgggaaggaccccgaggacaagaucucccucaucaagggcccgccccacaagaagcgcguggggaucguccggugcgagcgccggcgcgacgccaagcaggucggccgggagacgauggcgggcaucgccaugaccgugcugcccgcccuggccgucuucgcgcucgcccccgugguguucgccgaggacccccaccuccgcaaccggcccgggaagggccacaacuacaucgacgggaugacccaggaggacgcgaccugcaagccggucacguacgccggcgcgugcagcuccuucgacgugcugcucgagaaggggaaguucccccuguuccagagcuacgcccaccaccgcacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacggcaagauggccagcgugaagugcccgcccaaguacgagcugacggaggacugcaacuucugccggcagaugaccggggccucccugaagaagggcagcuacccccuccaggaccuguucugccagagcuccgaggacgacgggagcaagcugaagaccaagaugaagggcgugugcgaggucggcgugcaggcccucaagaagugcgacgggcagcuguccaccgcgcacgaggugguccccuucgccguguucaagaacagcaagaagguguaccuggacaagcucgaccugaagacggaggagaaccugcuccccgacuccuucgucugcuucgagcacaagggccaguacaaggggaccauggacagcggccagaccaagcgcgagcugaaguccuucgacaucagccagugccccaagaucgggggccacggcuccaagaagugcaccggggacgccgccuucugcagcgccuacgagugcaccgcccaguacgccaacgccuacugcucccacgccaacggcagcgggaucgugcagauccagguguccggcguguggaagaagccgcugugcgugggguacgagcgggucguggugaagcgcgagcugagcgcgaagcccauccagcgggucgagcccugcacgaccugcaucaccaagugcgagccccacggccugaucgugcgcuccaccggcuucaagaucagcuccgccguggccugcgccagcggggucugcgugaccggcucccagagcccgagcaccgagaucacccugaaguaccccgggaucucccagagcuccggcggggacaucggcgugcacauggcccacgacgaccagagcgucuccagcaagaucguggcgcacugcccgccccaggaccccugccucgugcacggcugcaucgucugcgcccacgggcugaucaacuaccagugccacacggcccuguccgccuucgugguggucuucguguucagcuccguggccaucaucugccucgcgauccuguacaagguccugaagugccucaagaucgcccccaagaaggugcugaacccccugauguggaucaccgccuucauccgguggguguacaagaagauggucgcccgcguggccgacaacaucaaccaggugaaccgcgagaucggcuggauggagggcgggcagcucgcgcugggcaacccggcccccaucccccggcacgcccccaucccgcgcuacagcaccuaccugaugcugcuccugaucgucuccuacgccagcgcgugcuccgagcugauccaggccagcucccggaucaccacgugcagcaccgagggggugaacaccaagugccgccucuccggcaccgcccugauccgggccgggagcgugggcgccgaggcgugccugaugcucaagggggucaaggacgaccagacgaaguuccugaagaucaagaccgugagcuccgagcugagcugccgcgagggccaguccuacuggaccggcagcuucucccccaagugccucagcucccggcgcugccaccuggugggggagugccacgucaaccggugccugagcuggcgcgacaacgagaccuccgccgaguucagcuucgugggcgaguccaccacgaugcgggagaacaagugcuucgagcagugcgggggcugggggugcggcugcuucaacgugaaccccagcugccucuucguccacaccuaccugcaguccgugcgcaaggaggcccugcggguguucaacugcaucgacuggguccacaagcucacccuggagaucaccgacuucgacggcagcguguccacgaucgaccugggggccagcuccagccgcuucaccaacuggggcuccgugagccucagccuggacgccgaggggaucuccggcagcaacuccuucagcuucaucgagucccccgggaagggcuacgcgaucgucgacgagccguucagcgagaucccccggcagggcuuccugggggagauccgcugcaacuccgagagcuccgugcucagcgcccacgaguccugccugcgggcccccaaccugaucagcuacaagcccaugaucgaccagcucgagugcaccaccaaccugaucgacccguucguggucuucgagcgcggcucccugccccagacgcggaacgacaagaccuucgccgccagcaaggggaaccgcggcgugcaggcguucuccaaggggagcgugcaggccgaccucacccugauguucgacaacuucgaggucgacuucgugggcgccgccguguccugcgacgcggccuuccugaaccucaccggcugcuacagcugcaacgccggggcccgcgucugccuguccaucacgagcaccggcaccgggacccugagcgcccacaacaaggacggcucccuccacaucgugcugcccagcgagaacggcacgaaggaccagugccagauccugcacuucaccguccccgagguggaggaggaguucauguacuccugcgacggggacgagcggccgcuccuggugaagggcacccugaucgcgaucgaccccuucgacgaccgccgggaggccgggggcgagagcaccgucgugaaccccaaguccgggagcuggaacuucuucgacugguucuccggccucaugagcugguucggcgggccccugaagacgauccugcucaucugccuguacguggcccuguccaucggccucuucuuccugcugaucuaccucgggcgcaccggccugagcaagauguggcuggccgccaccaagaaggcguccuga

SEQ ID NO: 12790 - RNA, 3594 nt, Artificial Sequence
  derived and/or modified CDS sequence (opt1) from RVFV(Kenya 9800523)__DQ380196.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacaccaagcagaucggccgcgagaccauggccgggaucgcgaugaccgugcugcccgcccuggccgucuucgcccucgcgcccgugguguucgccgaggacccccaccuccggaaccgccccggcaaggggcacaacuacaucgacggcaugacccaggaggacgccacgugcaagccggucaccuacgccggggccugcagcuccuucgacgugcugcucgagaagggcaaguucccccuguuccagagcuacgcgcaccaccggacccugcucgaggccgugcacgacaccaucaucgccaaggccgacccgcccuccugcgaccugcagagcgcccacggcaaccccugcaugaaggagaagcuggucaugaagacgcacugccccaacgacuaccaguccgcgcacuaccucaacaacgacgggaagauggccagcgugaagugcccgcccaaguacgagcugaccgaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccacggcccacgaggugguccccuucgcgguguucaagaacagcaagaagguguaccuggacaagcucgaccugaagaccgaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcacgggcgacgccgccuucugcagcgccuacgagugcaccgcccaguacgcgaacgccuucugcucccacgccaacgggagcggcaucgugcagauccaggucuccgggguguggaagaagccgcugugcgugggcuacgagcgcgucguggugaagcgggagcucagcgccaagcccauccagcgcgucgagcccugcacgaccugcaucaccaagugcgagccccacggccugguggugcgguccaccggguucaagaucagcuccgcggucgccugcgccagcggcgugugcgugaccgggucccagagcccgagcaccgagaucacgcugaaguaccccggcaucucccagagcuccgggggcgacaucggcguccacauggcccacgacgaccagagcguguccagcaagaucguggcccacugcccgccccaggaccccugccucguccacgggugcaucgugugcgcgcacggccugaucaacuaccagugccacaccgcccuguccgccuucguggucguguucguguucagcuccaucgccaucaucugccucgccauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcgcccaucccgcgguacagcaccuaccugaugcugcuccugaucguguccuacgccagcgccugcuccgagcugauccaggccagcucccgcaucacgaccugcagcaccgagggcgugaacaccaagugccggcucuccgggacggcgcugauccgcgccggcagcgucggggccgaggccugccugaugcucaagggcgugaaggaggaccagaccaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgccgaguucagcuucgugggggaguccacgaccaugcgcgagaacaagugcuucgagcagugcggcggguggggcugcggcugcuucaacgucaaccccagcugccucuucgugcacaccuaccugcaguccgugcggaaggaggcgcugcgcgucuucaacugcaucgacugggugcacaagcucacccuggagaucacggacuucgacgggagcguguccaccaucgaccugggcgccagcuccagccgguucaccaacuggggguccgucagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcucaacgcccacgagagcugccugcgcgcgcccaaccugaucuccuacaagcccaugaucgaccagcucgagugcaccacgaaccugaucgacccguucgucguguucgagcgggggagccugccccagacccgcaacgacaagaccuucgccgccuccaagggcaaccgcggggugcaggccuucagcaagggcuccguccaggccgaccucacccugauguucgacaacuucgagguggacuucgugggcgcggccgucagcugcgacgccgccuuccugaaccucacggggugcuacuccugcaacgcgggcgcccgggugugccugagcaucaccuccaccgggaccggcacgcugagcgcccacaacaaggagggcagccuccacaucguccugcccuccgagaacgggaccaaggaccagugccagauccugcacuucaccgugcccgagguggaggaggaguucauguacagcugcgacggcgacgagcgcccgcuccuggucaaggggacccugaucgccaucgaccccuucgacgaccggcgcgaggccggcggggaguccacgguggugaaccccaagagcggcuccuggaacuucuucgacugguucagcggccucauguccugguucgggggcccccugaagaccauccugcucaucugccuguacgucgcgcugagcaucgggcuguucuuccugcugaucuaccucggccggaccgggcuguccaagauguggcuggccgccaccaagaaggccagcuga

SEQ ID NO: 12791 - RNA, 3594 nt, Artificial Sequence
  derived and/or modified CDS sequence (opt1) from RVFV(ANK-6087)__DQ380216.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaagcuggacagcgggcagaccaagcgggagcugaaguccuucgacaucagccagugccccaagaucggcggccacggguccaagaagugcaccggcgacgccgccuucugcagcgccuacgagugcaccgcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugacggggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgggugcaucgucugcgcccacggccugaucaacuaccagugccacaccgcccucuccgccuucgugguggucuucguguucagcuccaucgccaucaucugccuggcgauccuguaccgcgugcucaagugccugaagaucgcgccccggaagguccugaacccccucauguggaucacggccuucauccgcuggguguaccgcaagaugguggcccgggucgccgacaacaucaaccaggugaaccgcgagaucggguggauggagggcggccagcuggugcuggggaacccggcccccaucccccggcacguccccaucccgcgcuacagcaccuaccugaugcuccugcugaucguguccuacgccagcgccugcuccgagcucauccaggccagcucccggaucacgaccugcagcaccgagggcgugaacaccaagugccgccuguccgggaccgcgcugauccgggccggcagcgucggggccgaggccugccucaugcugaagggcgugaaggaggaccagaccaaguuccugaagaucaagacggugagcuccgagcucagcugccgcgagggccaguccuacuggaccgggagcuucucccccaagugccugagcucccggcgcugccaccuggucggcgagugccacgugaaccggugccucagcuggcgcgacaacgagaccuccgccgaguucagcuucgugggggaguccaccaccaugcgggagaacaagugcuucgagcagugcggcggguggggcugcggcugcuucaacgucaaccccagcugccuguucgugcacacguaccugcaguccgugcgcaaggaggcgcuccgggucuucaacugcaucgacugggugcacaagcugacccuggagaucaccgacuucgacgggagcguguccaccaucgaccucggcgccagcuccagccgcuucacgaacuggggguccgucagccugagccuggacgccgagggcaucuccgggagcaacuccuucagcuucaucgagucccccggcaagggcuacgccaucguggacgagccguucagcgagaucccccggcagggguuccucggcgagauccgcugcaacuccgagagcuccgugcugagcgcccacgaguccugccugcgggcgcccaaccucaucagcuacaagcccaugaucgaccagcuggagugcuccaccaaccugaucgacccguucgucguguucaagcgcgggagccucccccagacccgcaacgacaagaccuucgccgccuccaagggcaaccgcggggugcaggccuucagcaagggcuccguccaggccgaccugacgcugauguucgacaacuucgagguggacuucgugggcgcggccgucagcugcgacgccgccuuccucaaccugaccgggugcuacuccugcaacgcgggcgcccgggugugccugagcaucaccagcaccgggacgggcacccucuccgcccacaacaaggacggcagccugcacaucguccugcccuccgagaacgggaccaaggaccagugccagauccuccacuucaccgugcccgagguggaggaggaguucauguacagcugcgacggcgacgagcggccgcugcugguccgcgggacgcucaucgccaucgaccccuucgacgaccggcgcgaggccggcggggaguccaccguggugaaccccaagagcggcuccuggaacuucuucgacugguucagcggccugauguccugguucgggggcccccugaagaccauccuccugaucugccuguacgucgcgcucagcaucgggcuguucuuccugcucaucuaccugggccggaccgggcuguccaagauguggcucgccgccacgaagaaggccagcuga

SEQ ID NO: 12792 - RNA, 3594 nt, Artificial Sequence
  derived and/or modified CDS sequence (opt1) from RVFV(SAUDI 200010901)__KU978778.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcggccggcgccgggacaccaagcagaucgggcgcgagaccauggccggcaucgcgaugaccgugcugcccgcccuggccgucuucgcccucgcgcccgugguguucgccgaggacccccaccuccggaaccgccccgggaagggccacaacuacaucgacgggaugacccaggaggacgccacgugcaagccggucaccuacgccggcgccugcagcuccuucgacgugcugcuggagaagggcaaguucccccuguuccagagcuacgcgcaccaccggacccugcucgaggccgugcacgacaccaucaucgccaaggccgacccgcccuccugcgaccugcagagcgcccacgggaaccccugcaugaaggagaagcuggucaugaagacgcacugccccaacgacuaccaguccgcgcacuaccucaacaacgacggcaagauggccagcgugaagugcccgcccaaguacgagcugaccgaggacugcaacuucugccgccagaugaccggggccucccugaagaagggcagcuacccccuccaggaccuguucugccagagcuccgaggacgacggcagcaagcugaagaccaagaugaagggggugugcgaggucggcgugcaggcccucaagaagugcgacgggcagcuguccacggcccacgaggugguccccuucgcgguguucaagaacagcaagaagguguaccuggacaagcucgaccugaagaccgaggagaaccugcuccccgacuccuucgucugcuucgagcacaagggccaguacaaggggaccauggacagcggccagaccaagcgggagcugaaguccuucgacaucagccagugccccaagaucggcgggcacggcuccaagaagugcacgggggacgccgccuucugcagcgccuacgagugcaccgcccaguacgcgaacgccuucugcucccacgccaacggcagcgggaucgugcagauccaggucuccggcguguggaagaagccgcugugcgugggcuacgagcgcgucguggugaagcgggagcucagcgccaagcccauccagcgcgucgagcccugcacgaccugcaucaccaagugcgagccccacgggcugguggugcgguccaccggcuucaagaucagcuccgcggucgccugcgccagcggggugugcgugaccggcucccagagcccgagcaccgagaucacgcugaaguaccccgggaucucccagagcuccggcggcgacaucgggguccacauggcccacgacgaccagagcguguccagcaagaucguggcccacugcccgccccaggaccccugccucguccacggcugcaucgugugcgcgcacgggcugaucaacuaccagugccacaccgcccuguccgccuucguggucguguucguguucagcuccaucgccaucaucugccucgccauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggcuggauggagggcgggcagcucguccugggcaacccggcccccaucccccgccacgcgcccaucccgcgguacagcaccuaccugaugcugcuccugaucaucuccuacgccagcgccugcuccgagcugauccaggccagcucccgcaucacgaccugcagcaccgagggggugaacaccaagugccggcucuccggcacggcgcugauccgcgccgggagcgugggcgccgaggccugccugaugcucaagggcgucaaggaggaccagaccaaguuccugaagaucaagaccgugagcuccgagcugagcugccgggaggggcaguccuacuggaccggcagcuucucccccaagugccucagcucccgccggugccaccuggugggggagugccacgucaaccgcugccugagcuggcgggacaacgagaccuccgccgaguucagcuucgugggcgaguccacgaccaugcgcgagaacaagugcuucgagcagugcgggggcuggggcugcgggugcuucaacgugaaccccagcugccucuucguccacaccuaccugcaguccgugcggaaggaggcgcugcgcguguucaacugcaucgacuggguccacaagcucacccuggagaucacggacuucgacggcagcguguccaccaucgaccugggggccagcuccagccgguucaccaacuggggcuccgugagccucagccuggacgccgaggggaucuccggcagcaacuccuucagcuucaucgagucccccggcaagggguacgccaucgucgacgagccguucagcgagaucccccgccagggcuuccugggggagauccggugcaacuccgagagcuccgugcucagcgcccacgaguccugccugcgcgcgcccaaccugaucagcuacaagcccaugaucgaccagcucgagugcaccacgaaccugaucgacccguucguggucuucgagcggggcucccugccccagacccgcaacgagaagaccuucgccgccagcaaggggaaccgcggcgugcaggccuucuccaagggcagcgugcaggccgaccucacccugauguucgacaacuucgaggucgacuucgugggggcggccguguccugcgacgccgccuuccugaaccucacgggcugcuacagcugcaacgcgggggcccgggucugccuguccaucaccagcaccggcaccggcacgcugagcgcccacaacaaggacgggucccuccacaucgugcugcccagcgagaacggcaccaaggaccagugccagauccugcacuucaccguccccgagguggaggaggaguucauguacuccugcgacggggacgagcgcccgcuccuggugaagggcacccugaucgccaucgaccccuucgacgaccggcgcgaggccgggggcgagagcacggucgugaaccccaaguccggcagcuggaacuucuucgacugguucuccgggcucaugagcugguucggcgggccccugaagaccauccugcucaucugccuguacguggcgcuguccaucggccucuucuuccugcugaucuaccucgggcggaccggccugagcaagauguggcuggccgccaccaagaaggccuccuga

SEQ ID NO: 12793 - RNA, 3594 nt, Artificial Sequence
  derived and/or modified CDS sequence (opt1) from RVFV(35/74)__JF784387.1__GP
auguacgugcugcucaccauccugaucaccguccuggugugcgaggccgugauccgcgucagccucuccagcacgcgggaggagaccugcuucggcgacuacaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucgugaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgccacgugcaagccggucaccuacgccggggcgugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacgcacugccccaacgacuaccaguccgcccacuaccucaacaacgacgggaagauggccagcgugaagugcccgcccaaguacgagcugaccgaggacugcaacuucugccgccagaugaccggcgccucccugaagaaggggagcuacccccuccaggaccuguucugccaguccagcgaggacgacggcagcaagcugaagaccaagaugaagggcgugugcgaggucggggugcaggcccucaagaagugcgacggccagcuguccacggcgcacgaggugguccccuucgccguguucaagaacagcaagaagguguaccuggacaagcucgaccugaagaccgaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcacgggcgacgccgccuucugcagcgccuacgagugcaccgcgcaguacgccaacgccuacugcucccacgccaacgggagcggcgugguccagauccagguguccgggguguggaagaagccgcugugcgucggcuacgagcgcgugguggucaagcgggagcucagcgcgaagcccauccagcgcguggagcccugcacgaccugcaucaccaagugcgagccccacggccuggugguccgguccaccggguucaagaucagcuccgccguggccugcgccagcggcgugugcgucaccgggucccagagcccguccaccgagaucacgcugaaguaccccggcaucagccagagcuccgggggcgacaucggcgugcacauggcccacgacgaccagagcguguccagcaagaucgucgcgcacugcccgccccaggaccccugccucgugcacgggugcaucgugugcgcccacggccugaucaacuaccagugccacaccgcccuguccgccuucgucgugguguucgucuucagcuccguggccaucaucugccucgcgauccuguacaaggugcugaagugccucaagaucgcgccccgcaagguccuggacccccugauguggaucaccguguucauccgguggguguacaagaagauggucgcccgcguggccgacaacaucaaccaggugaaccgcgagaucggguggauggagggcggccagcucgcccuggggaacccggcccccaucccccggcacgcccccaucccgcgcuacagcaccuaccugaugcugcuccugaucgucuccuacgccagcgccugcuccgagcugauccaggcgagcucccggaucacgaccugcagcaccgagggcgugaacaccaagugccgccucuccgggacggcccugauccgggccggcagcgugggggccgaggccugccugaugcucaagggcgucaaggaggaccagaccaaguuccugaagaucaagaccguguccagcgagcugagcugccgcgagggccaguccuacuggaccgggagcuucucccccaagugccucagcucccggcgcugccaccuggugggcgagugccacgucaaccggugccugagcuggcgcgacaacgagaccuccgcggaguucagcuucgugggggaguccacgaccaugcgggagaacaagugcuucgagcagugcggcggguggggcugcggcugcuucaacgugaaccccagcugccucuucguccacaccuaccugcaguccgugcgcaaggaggcccugcggguguucaacugcaucgacuggguccacaagcucacccuggagaucacggacuucgacgggagcguguccaccaucgaccugggcgccagcuccagccgcuucaccaacuggggguccgugagccucucccuggacgccgagggcaucagcgggagcaacuccuucagcuucaucgagucccccggcaagggcuacgccaucgucgacgagccguucagcgagaucccccggcagggguuccugggcgagauccgcugcaacuccgagagcuccgugcucagcgcgcacgaguccugccugcgggcccccaaccugaucagcuacaagcccaugaucgaccagcucgagugcaccacgaaccugaucgacccguucguggucuucgagcgcgggucccugccccagacccggaacgacaagaccuucgccgccagcaagggcaaccgcggggugcaggccuucuccaagggcagcgugcaggcggaccucacccugauguucgacaacuucgaggucgacuucgugggcgccgccgucuccugcgacgccgcguuccugaaccucacggggugcuacagcugcaacgccggcgcccgcgugugccuguccaucaccagcaccgggaccggcacgcuguccgcccacaacaaggacggcagccuccacaucgugcugcccagcgagaacgggaccaaggaccagugccagauccugcacuucaccguccccgagguggaggaggaguucauguacuccugcgacggcgacgagcggccgcuccuggugaaggggacccugaucgccaucgaccccuucgacgaccgccgggaggcgggcggggagagcacggucgugaaccccaaguccggcagcuggaacuucuucgacugguucuccggccucaugagcugguucgggggcccccugaagaccauccugcucaucugccuguacguggcccuguccaucgggcuguucuuccugcugaucuaccucggccgcaccgggcugagcaagauguggcuggccgccaccaagaaggccuccuga

SEQ ID NO: 12794 - RNA, 3594 nt, Artificial Sequence
  derived and/or modified CDS sequence (opt1) from RVFV(KEN/Kil-006/07)__HM586966.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcguggugcgcugcgagcggcgccgggacgccaagcagaucggccgcgagaccauggcggggaucgccaugaccguccugcccgcccuggccguguucgcgcucgcccccguggucuucgccgaggacccccaccuccggaaccgccccggcaaggggcacaacuacaucgacggcaugacccaggaggacgcgaccugcaagccggugacguacgccggggccugcagcuccuucgacgugcugcuggagaagggcaaguucccccuguuccagagcuacgcccaccaccggacccugcucgaggccguccacgacaccaucaucgccaaggccgacccgcccuccugcgaccugcagagcgcggacggcaacaagugcaugaaggagaagcuggugaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgucugcgaggugggggugcaggcccucaagaagugcgacggccagcuguccaccgcgcacgaggucgugcccuucgccguguucaagaacagcaagaaggucuaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccgggguguggaagaagccccugugcgucggcuacgagcgcgugguggucaagcgggagcucagcgcgaagccgauccagcgcguggagcccugcacgaccugcaucaccaagugcgagccccacggccuggugguccgguccaccggguucaagaucagcuccgccguggccugcgccagcggcgugugcgucaccgggucccagagccccagcaccgagaucacccugaaguacccgggcaucucccagagcuccgggggcgacaucggcgugcacauggcccacgacgaccagagcguguccagcaagaucgucgcgcacugcccgccccaggaccccugccucgugcacgggugcaucgugugcgcccacggccugaucaacuaccagugccacacggcccuguccgccuucgucgugaucuucguguucagcuccaccgccaucaucugccucgcgguccuguaccgcgugcugaagugccucaagaucgcgccccggaaggugcugaacccccugauguggaucaccgccuucauccgcugggucuacaagaagaugguggcccgcguggccgacaacaucaaccaggucaaccgggagaucggguggauggagggcggccagcucgcccuggggaaccccgccccgaucccccgccacgcccccaucccccgguacagcaccuaccugaugcugcuccugaucguguccuacgccagcgcgugcuccgagcugauccaggccagcucccgcaucacgaccugcagcaccgagggcgugaacaccaagugccggcucuccgggacggcccugauccgcgccggcagcgucggggccgaggcgugccugaugcucaagggcgugaaggaggaccagaccaaguuccugaagaucaagaccgugagcuccgagcugagcugccgggagggccaguccuacuggaccgggagcuucuccccgaagugccucagcucccgccggugccaccuggucggcgagugccacgugaaccgcugccugagcuggcgggacaacgagaccuccgccgaguucagcuucgugggggaguccacgaccaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucacggacuucgacgggagcguguccaccaucgaccugggcgccagcuccagccgguucaccaacuggggguccgucagccucagccuggacgccgagggcaucuccgggagcaacuccuucagcuucaucgagucccccggcaagggcuacgcgaucguggacgagcccuucagcgagaucccgcgccagggguuccugggcgagauccggugcaacuccgagagcuccgugcucagcgcccacgaguccugccugcgcgcccccaaccuggucagcuacaagcccaugaucgaccagcucgagugcaccacgaaccugaucgaccccuucgugguguucgagcgggggucccugccgcagacccgcaacgacaagaccuucgccgccagcaagggcaaccgcgggguccaggcguucuccaagggcagcgugcaggccgaccucacccugauguucgacaacuucgagguggacuucgucggcgccgccguguccugcgacgcggccuuccugaaccucacggggugcuacagcugcaacgccggcgcccgggucugccuguccaucaccagcaccgggaccggcacgcugagcgcccacaacaaggacggcucccuccacaucgugcugcccagcgagaacgggaccaaggaccagugccagauccugcacuucaccgugcccgaggucgaggaggaguucauguacuccugcgacggcgacgagcgcccccuccuggugaaggggacccugaucgcgaucgacccguucgacgaccggcgcgaggccggcggggagagcacgguggucaaccccaaguccggcagcuggaacuucuucgacugguucuccggccucaugagcugguucgggggcccccugaagaccauccugcucaucugccuguacguggcccuguccaucggccucuucuuccugcugaucuaccucgggcggaccgggcugagcaagauguggcuggccgccaccaagaaggcguccuga

SEQ ID NO: 12795 - RNA, 3594 nt, Artificial Sequence
  derived and/or modified CDS sequence (opt1) from RVFV(MgH824)__DQ380210.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaagggguacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcggaaggggcaguacaagggcaccauggacagcgggcagaccaagcgcgagcugaaguccuucgacaucagccagugccccaagaucggcggccacggguccaagaagugcaccggcgacgccgccuucugcagcgccuacgagugcacgacccaguacgcgaacgccuacugcucccacgccaacgggagcggcgucgugcagauccaggucuccgggguguggaagaagccgcugugcgugggcuacgagcgggucguggugaagcgcgagcucagcgccaagcccauccagcgggucgagcccugcacgaccugcaucaccaagugcgagccccacggccugguggugcgcuccaccggguucaagaucagcuccgcggucgccugcgccagcggcgugugcgugaccgggucccagagcccgagcaccgagaucacgcugaaguaccccggcaucucccagagcuccgggggcgacaucggcguccacauggcccacgacgaccagagcguguccagcaagaucguggcccacugcccgccccaggaccccugccucguccacgggugcaucgugugcgcgcacggccugaucaacuaccagugccacaccgcccuguccgccuucguggucguguucguguucagcuccaucgccaucaucugccucgccauccuguaccggguccugaagugccucaagaucgcgccccgcaaggugcugaacccccugauguggaucaccgccuucauccgcuggaucuacaagaagaugguggcccgggucgccgacaacaucaaccaggugaaccgcgagaucggguggauggagggcggccagcucgugcuggggaacccggcccccaucccccggcacgcgcccaucccgcgcuacagcaccuaccugaugcugcuccugaucgucuccuacgccagcgccugcuccgagcugauccaggccagcucccggaucacgaccugcagcaccgagggcguggacaccaagugccgccucuccgggacggcgcugauccgggccggcagcgugggggccgaggccugccugaugcucaagggcgucaaggaggaccagaccaaguuccugaagaucaagaccgugagcuccgagcugagcugccgcgagggccaguccuacuggaccgggagcuucucccccaagugccucagcucccggcgcugccaccuggugggcgagugccacgucaaccggugccugagcuggcgcgacaacgagaccuccgccgaguucagcuucgugggggaguccacgaccaugcgggagaacaagugcuucgagcagugcggcggguggggcugcggcugcuucaacgugaaccccagcugccucuucguccacaccuaccugcaguccgugcgcaaggaggcgcugcggguguucaacugcaucgacuggguccacaagcucacccuggagaucacggacuucgacgggagcguguccaccaucgaccugggcgccagcuccagccgcuucaccaacuggggguccgugagccucagccuggacgccgagggcaucuccgggagcaacuccuucagcuucaucgagucccccggcaagggcuacgccaucgucgacgagccguuccccgagaucccccggcagggguuccugggcgagauccgcugcaacagcgaguccagcgugcucuccgcccacgagagcugccugcgggcgcccaaccugaucuccuacaagccgaugaucgaccagcucgagugcaccacgaaccugaucgaccccuucguggucuucgagcgcgggagccugccccagacccgcaacgacaagaccuucgccgccuccaagggcaaccgcggggugcaggccuucagcaagggcuccgugcaggccgaccucacccugauguucgacaacuucgaggucgacuucgugggcgcggccgugagcugcgacgccgccuuccugaaccucacggggugcuacuccugcaacgcgggcgcccgggucugccugagcaucaccuccaccgggaccggcagccugagcgcccacaacaaggacggcucccuccacaucgugcugcccagcgagaacgggacgaaggaccagugccagauccugcacuucaccgucccggagguggaggaggaguucauguacuccugcgacggcgacgagcggccccuccuggugaaggggacccugaucgccaucgaccccuucgacgaccgccgggaggccggcggggagagcaccgucgugaaccccaaguccggcagcuggaacuucuucgacugguucuccggccucaugagcugguucgggggcccgcugaagacgauccugcucaucugccuguacguggcgcuguccaucgggcuguucuuccugcugaucuaccucggccgcaccgggcugagcaagauguggcuggccgccaccaagaaggccuccuga

SEQ ID NO: 12796 - RNA, 3594 nt, Artificial Sequence
  derived and/or modified CDS sequence (opt1) from RVFV(Kenya 57 (Rintoul))__DQ380192.1__GP
auguacgcccugcucaccauccugaucagcgugcuggucugcgaggccgugauccgcgugucccucagcuccacccgggaggagacgugcuucggcgacagcaccaaccccgagaugaucgagggggcgugggacucccugcgcgaggaggagaugccggaggagcugagcugcuccaucagcggcauccgggaggucaagaccuccagccaggagcuccaccgcgcccugaaggccaucaucgccgccgacgggcugaacaacaucacgugccacggcaaggaccccgaggacaagaucucccucaucaaggggccgccccacaagaagcgggugggcgugguccgcugcgagcggcgccgggacgcgaagcagaucggccgcgagaccauggccgggaucgccaugaccgugcugcccgcccuggcgguguucgcccucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggcggacccgcccuccugcgaccugcagagcgcccacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcgcucaagaagugcgacggccagcuguccaccgcccacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaucaagcgggagcugaaguccuucgacaucagccagugccccaagaucggcggccacggguccaagaagugcaccggcgacgccgccuucugcagcgcguacgagugcaccgcccaguacgccaacgccuacugcucccacgcgaacgggagcggcaucguccagauccagguguccggggucuggaagaagccgcugugcgugggcuacgagcgcguggucgugaagcgggagcucagcgccaagcccauccagcgcguggagcccugcacgaccugcaucaccaagugcgagccccacggccuggucgugcgguccaccggguucaagaucagcuccgccguggccugcgccagcggcgucugcgugacggggucccagagcccgagcaccgagaucacccugaaguaccccggcaucucccagagcuccgggggcgacaucggcgugcacauggcgcacgacgaccagagcgucuccagcaagaucguggcccacugcccgccccaggaccccugccucgugcacgggugcaucgucugcgcccacggccugaucaacuaccagugccacaccgcccuguccgccuucgugguggucuucguguucagcuccguggcgaucaucugccucgccauccuguacaagguccugaagugccucaagaucgcgccccgcaaggugcugaacccccugauguggaucacggccuucauccgguggguguacaagaagauggucgcccgcguggccgacaacaucaaccaggugaaccgcgagaucggguggauggagggcggccagcucguccuggggaacccggcccccaucccccggcacgcccccaucccgcgcuacagcaccuaccugaugcugcuccugaucguguccuacgccagcgcgugcuccgagcugauccaggccagcucccggaucacgaccugcagcaccgagggcgugaacaccaagugccgccucuccgggaccgcccugauccgggccggcagcgucggggccgaggcgugccugaugcucaagggcgugaaggaggaccagaccaaguuccugaagaucaagacggugagcuccgagcugagcugccgcgagggccaguccuacuggaccgggagcuucucccccaagugccucagcucccggcgcugccaccuggucggcgagugccacgugaaccggugccugagcuggcgcgacaacgagaccuccgccgaguucagcuucgugggggaguccaccaccaugcgggagaacaagugcuucgagcagugcggcggguggggcugcggcugcuucaacgucaaccccagcugccucuucgugcacacguaccugcaguccgugcgcaaggaggcccugcgggucuucaacugcaucgacugggugcacaagcucacccuggagaucaccgacuucgacgggagcguguccaccgucgaccugggcgccagcuccagccgcuucacgaacuggggguccgugagccucagccuggacgccgagggcaucuccgggagcaacuccuucagcuucaucgagucccccggcaagggcuacgcgaucguggacgagccguucagcgagaucucccggcagggguuccugggcgagauccgcugcaacagcgaguccagcguccucuccgcccacgagagcugccugcgggcccccaaccugaucuccuacaagcccaugaucgaccagcucgagugcaccaccaaccugaucgaccccuucgugguguucgagcgcgggagccugccgcagacccggaacgacaagacguucgccgccuccaagggcaaccgcgggguccaggcguucagcaagggcuccgugcaggccgaccucacccugauguucgacaacuucgagguggacuucgucggcgccgccgugagcugcgacgcggccuuccugaaccucaccgggugcuacuccugcaacgccggcgcccgcgucugccugagcaucaccagcacggggaccggcacccuguccgcccacaacaaggacggcagccuccacaucgugcugcccuccgagaacgggaccaaggaccagugccagauccugcacuucacggugcccgaggucgaggaggaguucauguacagcugcgacggcgacgagcggccccuccuggugaaggggacccugaucgcgaucgacccguucgacgaccgccgggaggccggcggggaguccaccguggucaaccccaagagcggcuccuggaacuucuucgacugguucagcggccucauguccugguucgggggcccccugaagaccauccugcucaucugccuguacguggcccugagcaucgggcuguucuuccugcugaucuaccucggccgcacggggcuguccaagauguggcuggccgccaccaagaaggcgagcuga

SEQ ID NO: 12797 - RNA, 3594 nt, Artificial Sequence
  derived and/or modified CDS sequence (opt1) from RVFV(SA-75)__DQ380189.1__GP
auguacgugcugcucaccauccugaucaccguccuggugugcgaggccgugauccgcgucagccucuccagcacgcgggaggagaccugcuucggcgacuacaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucgugaaggggccgccccacaagaagcgggucggcaucgugcgcugcgagcggcgccgggacgccaagcagaucggccgcgagaccauggcgcggaucgccaugaccgugcugcccgcccuggccgucuucgcgcucgcccccgugguguucgccgaggacccccaccuccgcaaccggcccgggaagggccacaacuacaucgacgggaugacccaggaggacgccacgugcaagccggucaccuacgccggcgcgugcagcuccuucgacgugcugcuggagaaggggaaguucccccuguuccagagcuacgcccaccaccgcacccugcucgaggccgugcacgacaccaucaucgccaaggccgacccgcccuccugcgaccugcagagcgcgcacggcaaccccugcaugaaggagaagcuggucaugaagacgcacugccccaacgacuaccaguccgcccacuaccucaacaacgacggcaagauggccagcgugaagugcccgcccaaguacgagcugaccgaggacugcaacuucugccggcagaugaccggggccucccugaagaagggcagcuacccccuccaggaccuguucugccaguccagcgaggacgacgggagcaagcugaagaccaagaugaagggcgugugcgaggucggcgugcaggcccucaagaagugcgacgggcagcuguccacggcgcacgaggugguccccuucgccguguucaagaacagcaagaagguguaccuggacaagcucgaccugaagaccgaggagaaccugcuccccgacuccuucgucugcuucgagcacaagggccaguacaaggggaccauggacagcggccagaccaagcgcgagcugaaguccuucgacaucagccagugccccaagaucgggggccacggcuccaagaagugcacgggggacgccgccuucugcagcgccuacgagugcaccgcgcaguacgccaacgccuacugcucccacgccaacggcagcggggugguccagauccagguguccggcguguggaagaagccgcugugcgucggguacgagcgggugguggucaagcgcgagcucagcgcgaagcccauccagcggguggagcccugcacgaccugcaucaccaagugcgagccccacggccuggugguccgcuccaccggcuucaagaucagcuccgccguggccugcgccagcggggugugcgucaccggcucccagagcccguccaccgagaucacgcugaaguaccccgggaucagccagagcuccggcggggacaucggcgugcacauggcccacgacgaccagagcguguccagcaagaucgucgcgcacugcccgccccaggaccccugccucgugcacggcugcaucgugugcgcccacgggcugaucaacuaccagugccacaccgcccuguccgccuucgucgugguguucgucuucagcuccguggccaucaucugccucgcgauccuguacaaggugcugaagugccucaagaucgcgccccggaagguccugaacccccugauguggaucaccguguucauccgcuggguguacaagaagauggucgcccgcguggccgacaacaucaaccaggugaaccgggagaucggcuggauggagggcgggcagcucgcccugggcaacccggcgcccaucccccgccacgcccccaucccgcgguacagcaccuaccugaugcugcuccugaucgucuccuacgccagcgccugcuccgagcugauccaggcgagcucccgcaucacgaccugcagcaccgagggggugaacaccaagugccggcucuccggcacggcccugauccgcgccgggagcgugggcgccgaggccugccugaugcucaagggggucaaggaggaccagaccaaguuccugaagaucaagaccguguccagcgagcugagcugccgggagggccaguccuacuggaccggcagcuucucccccaagugccucagcucccgccggugccaccuggugggggagugccacgucaaccgcugccugagcuggcgggacaacgagaccuccgcggaguucagcuucgugggcgaguccacgaccaugcgcgagaacaagugcuucgagcagugcgggggcugggggugcggcugcuucaacgugaaccccagcugccucuucguccacaccuaccugcaguccgugcggaaggaggcccugcgcguguucaacugcaucgacuggguccacaagcucacccuggagaucacggacuucgacggcagcguguccaccaucgaccugggggccagcuccagccgguucaccaacuggggcuccgugagccucucccuggacgccgaggggaucagcggcagcaacuccuucagcuucaucgagucccccgggaagggcuacgccaucgucgacgagccguucagcgagaucccccgccagggcuuccugggggagauccggugcaacuccgagagcuccgugcucagcgcgcacgaguccugccugcgcgcccccaaccugaucagcuacaagcccaugaucgaccagcucgagugcaccacgaaccugaucgacccguucguggucuucgagcggggcucccugccccagacccgcaacgacaagaccuucgccgccagcaaggggaaccgcggcgugcaggccuucuccaaggggagcgugcaggcggaccucacccugauguucgacaacuucgaggucgacuucgugggcgccgccgucuccugcgacgccgcguuccugaaccucacgggcugcuacagcugcaacgccggggcccgggugugccuguccaucaccagcaccggcaccgggacgcuguccgcccacaacaaggacggcagccuccacaucgugcugcccagcgagaacggcaccaaggaccagugccagauccugcacuucaccguccccgagguggaggaggaguucauguacuccugcgacggggacgagcgcccgcuccuggugaagggcacccugaucgccaucgaccccuucgacgaccggcgcgaggccgggggcgagagcacggucgugaaccccaaguccgggagcuggaacuucuucgacugguucuccggccucaugagcugguucggcgggccccugaagaccauccugcucaucugccuguacguggcccuguccaucggccucuucuuccugcugaucuaccucgggcggaccggccugagcaagauguggcuggccgccaccaagaaggccuccuga

SEQ ID NO: 12798 - RNA, 3594 nt, Artificial Sequence
  derived and/or modified CDS sequence (opt1) from RVFV(SA01-1322)__KX096942.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcggccggcgccgggacaccaagcagaucgggcgcgagaccauggccggcaucgcgaugaccgugcugcccgcccuggccgucuucgcccucgcgcccgugguguucgccgaggacccccaccuccggaaccgccccgggaagggccacaacuacaucgacgggaugacccaggaggacgccacgugcaagccggucaccuacgccggcgccugcagcuccuucgacgugcugcuggagaagggcaaguucccccuguuccagagcuacgcgcaccaccggacccugcucgaggccgugcacgacaccaucaucgccaaggccgacccgcccuccugcgaccugcagagcgcccacgggaaccccugcaugaaggagaagcuggucaugaagacgcacugccccaacgacuaccaguccgcgcacuaccucaacaacgacggcaagauggccagcgugaagugcccgcccaaguacgagcugaccgaggacugcaacuucugccgccagaugaccggggccucccugaagaagggcagcuacccccuccaggaccuguucugccagagcuccgaggacgacggcagcaagcugaagaccaagaugaagggggugugcgaggucggcgugcaggcccucaagaagugcgacgggcagcuguccacggcccacgaggugguccccuucgcgguguucaagaacagcaagaagguguaccuggacaagcucgaccugaagaccgaggagaaccugcuccccgacuccuucgucugcuucgagcacaagggccaguacaaggggaccauggacagcggccagaccaagcgggagcugaaguccuucgacaucagccagugccccaagaucggcgggcacggcuccaagaagugcacgggggacgccgccuucugcagcgccuacgagugcaccgcccaguacgcgaacgccuucugcucccacgccaacggcagcgggaucgugcagauccaggucuccggcguguggaagaagccgcugugcgugggcuacgagcgcgucguggugaagcgggagcucagcgccaagcccauccagcgcgucgagcccugcacgaccugcaucaccaagugcgagccccacgggcugguggugcgguccaccggcuucaagaucagcuccgcggucgccugcgccagcggggugugcgugaccggcucccagagcccgagcaccgagaucacgcugaaguaccccgggaucucccagagcuccggcggcgacaucgggguccacauggcccacgacgaccagagcguguccagcaagaucguggcccacugcccgccccaggaccccugccucguccacggcugcaucgugugcgcgcacgggcugaucaacuaccagugccacaccgcccuguccgccuucguggucguguucguguucagcuccaucgccaucaucugccucgccauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggcuggauggagggcgggcagcucguccugggcgacccggcccccaucccccgccacgcgcccaucccgcgguacagcaccuaccugaugcugcuccugaucaucuccuacgccagcgccugcuccgagcugauccaggccagcucccgcaucacgaccugcagcaccgagggggugaacaccaagugccggcucuccggcacggcgcugauccgcgccgggagcgugggcgccgaggccugccugaugcucaagggcgucaaggaggaccagaccaaguuccugaagaucaagaccgugagcuccgagcugagcugccgggaggggcaguccuacuggaccggcagcuucucccccaagugccucagcucccgccggugccaccuggugggggagugccacgucaaccgcugccugagcuggcgggacaacgagaccuccgccgaguucagcuucgugggcgaguccacgaccaugcgcgagaacaagugcuucgagcagugcgggggcuggggcugcgggugcuucaacgugaaccccagcugccucuucguccacaccuaccugcaguccgugcggaaggaggcgcugcgcguguucaacugcaucgacuggguccacaagcucacccuggagaucacggacuucgacggcagcguguccaccaucgaccugggggccagcuccagccgguucaccaacuggggcuccgugagccucagccuggacgccgaggggaucuccggcagcaacuccuucagcuucaucgagucccccggcaagggguacgccaucgucgacgagccguucagcgagaucccccgccagggcuuccugggggagauccggugcaacuccgagagcuccgugcucagcgcccacgaguccugccugcgcgcgcccaaccugaucagcuacaagcccaugaucgaccagcucgagugcaccacgaaccugaucgacccguucguggucuucgagcggggcucccugccccagacccgcaacgagaagaccuucgccgccagcaaggggaaccgcggcgugcaggccuucuccaagggcagcgugcaggccgaccucacccugauguucgacaacuucgaggucgacuucgugggggcggccguguccugcgacgccgccuuccugaaccucacgggcugcuacagcugcaacgcgggggcccgggucugccuguccaucaccagcaccggcaccggcacgcugagcgcccacaacaaggacgggucccuccacaucgugcugcccagcgagaacggcaccaaggaccagugccagauccugcacuucaccguccccgagguggaggaggaguucauguacuccugcgacggggacgagcgcccgcuccuggugaagggcacccugaucgccaucgaccccuucgacgaccggcgcgaggccgggggcgagagcacggucgugaaccccaaguccggcagcuggaacuucuucgacugguucuccgggcucaugagcugguucggcgggccccugaagaccauccugcucaucugccuguacguggcgcuguccaucggccucuucuuccugcugaucuaccucgggcggaccggccugagcaagauguggcuggccgccaccaagaaggccuccuga

SEQ ID NO: 12799 - RNA, 3594 nt, Artificial Sequence
  derived and/or modified CDS sequence (opt1) from RVFV(KEN/Mal-032/07)__HM586967.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggccggcugcaggaggacgcgaccugcaagccggucaccuacgccggggccugcagcuccuucgacgugcugcuggagaagggcaaguucccccuguuccagagcuacgcccaccaccgcacgcuccuggaggccgugcacgacaccaucaucgccaaggccgacccgcccuccugcgaccugcagagcgcggacggcaacaagugcaugaaggagaagcucgucaugaagacccacugccccaacgacuaccaguccgcccacuaccugaacaacgacgggaagauggccagcgugaagugcccgcccaaguacgagcugaccgaggacugcaacuucugccggcagaugacgggcgccucccucaagaaggggagcuacccccugcaggaccuguucugccagagcuccgaggacgacggcagcaagcucaagaccaagaugaagggcgugugcgaggucggggugcaggcccugaagaagugcgacggccagcuguccaccgcgcacgaggugguccccuucgccguguucaagaacagcaagaagguguaccucgacaagcuggaccugaagaccgaggagaaccuccugcccgacuccuucgucugcuucgagcacaaggggcaguacaagggcacgauggacagcgggcagaccaagcgcgagcugaaguccuucgacaucagccagugccccaagaucggcggccacggguccaagaagugcaccggcgacgccgccuucugcagcgccuacgagugcaccgcgcaguacgccaacgccuacugcucccacgccaacgggagcggcaucgugcagauccaggucuccgggguguggaagaagccccucugcgugggcuacgagcgggucguggugaagcgcgagcugagcgcgaagccgauccagcgggucgagcccugcacgaccugcaucaccaagugcgagccccacggccugguggugcgcuccaccggguucaagaucagcuccgccgucgccugcgccagcggcgugugcgugacggggucccagagccccagcaccgagaucacccucaaguacccgggcaucucccagagcuccgggggcgacaucggcguccacauggcccacgacgaccagagcguguccagcaagaucguggcgcacugcccgccccaggaccccugccugguccacgggugcaucgugugcgcccacggccugaucaacuaccagugccacaccgcccucuccgccuucguggucaucuucguguucagcuccacggccaucaucugccuggcggugcuguaccggguccucaagugccugaagaucgcgccccgcaaggugcugaacccccucauguggaucaccgccuucauccgcuggguguacaagaagauggucgcccggguggccgacaacaucaaccaggugaaccgcgagaucggguggauggagggcggccagcuggcccuggggaaccccgccccgaucccccggcacgcccccaucccccgcuacagcaccuaccugaugcuccugcugaucgucuccuacgccagcgcgugcuccgagcucauccaggccagcucccggaucaccacgugcagcaccgagggcgugaacaccaagugccgccuguccgggaccgcccugauccgggccggcagcgugggggccgaggcgugccucaugcugaagggcgucaaggaggaccagacgaaguuccugaagaucaagaccgugagcuccgagcucagcugccgcgagggccaguccuacuggaccgggagcuucuccccgaagugccugagcucccggcgcugccaccuggugggcgagugccacgucaaccggugccucagcuggcgcgacaacgagaccuccgccgaguucagcuucgugggggaguccaccacgaugcgggagaacaagugcuucgagcagugcggcggguggggcugcggcugcuucaacgugaaccccagcugccuguucguccacaccuaccugcaguccgugcgcaaggaggcccuccggguguucaacugcaucgacuggguccacaagcugacccuggagaucaccgacuucgacgggagcguguccacgaucgaccucggcgccagcuccagccgcuucaccaacuggggguccgugagccugagccuggacgccgagggcaucuccgggagcaacuccuucagcuucaucgagucccccggcaagggcuacgcgaucgucgacgagcccuucagcgagaucccgcggcagggguuccucggcgagauccgcugcaacuccgagagcuccgugcugagcgcccacgaguccugccugcgggcccccaaccucgugagcuacaagcccaugaucgaccagcuggagugcaccaccaaccugaucgaccccuucgucguguucgagcgcgggucccucccgcagacgcgcaacgacaagaccuucgccgccagcaagggcaaccgcggggugcaggcguucuccaagggcagcguccaggccgaccugacccugauguucgacaacuucgagguggacuucgugggcgccgccgucuccugcgacgcggccuuccucaaccugaccgggugcuacagcugcaacgccggcgcccgggugugccuguccaucacgagcaccgggaccggcacccucagcgcccacaacaaggacggcucccugcacaucguccugcccagcgagaacgggacgaaggaccagugccagauccuccacuucaccgugcccgagguggaggaggaguucauguacuccugcgacggcgacgagcggccccugcuggucaaggggacccucaucgcgaucgacccguucgacgaccgccgggaggccggcggggagagcaccguggugaaccccaaguccggcagcuggaacuucuucgacugguucuccggccugaugagcugguucgggggcccccugaagacgauccuccugaucugccuguacgucgcccucuccaucgggcuguucuuccugcucaucuaccugggccgcaccgggcugagcaagauguggcucgccgccaccaagaaggcguccuga

SEQ ID NO: 12800 - RNA, 3594 nt, Artificial Sequence
  derived and/or modified CDS sequence (opt1) from RVFV(KEN/Gar-008/06)__HM586965.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucucccgcguguggaagaagccgcugugcgugggguacgagcgggucguggugaagcgcgagcucagcgcgaagcccauccagcgggucgagcccugcacgaccugcaucaccaagugcgagccccacggccugguggugcgcuccaccggcuucaagaucagcuccgccgucgccugcgccagcggggugugcgugaccggcucccagagcccgagcaccgagaucacccugaaguaccccgggaucucccagagcuccggcggggacaucggcguccacauggcccacgacgaccagagcguguccagcaagaucguggcgcacugcccgccccaggaccccugccucguccacggcugcaucgugugcgcccacgggcugaucaacuaccagugccacacggcccuguccgccuucguggucaucuucguguucagcuccaccgccaucaucugccucgcggugcuguaccggguccugaagugccucaagaucgcgccccgcaaggugcugaacccccugauguggaucaccgccuucauccgcuggguguacaagaagauggucgcccggguggccgacaacaucaaccaggugaaccgcgagaucggcuggauggagggcgggcagcucgcccugggcaacccggcccccaucccccggcacgcccccaucccgcgcuacagcaccuaccugaugcugcuccugaucgucuccuacgccagcgcgugcuccgagcugauccaggccagcucccggaucacgaccugcagcaccgagggggugaacaccaagugccgccucuccggcacggcccugauccgggccgggagcgugggcgccgaggcgugccugaugcucaagggggucaaggaggaccagaccaaguuccugaagaucaagaccgugagcuccgagcugagcugccgcgagggccaguccuacuggaccggcagcuucucccccaagugccucagcucccggcgcugccaccuggugggggagugccacgucaaccggugccugagcuggcgcgacaacgagaccuccgccgaguucagcuucgugggcgaguccacgaccaugcgggagaacaagugcuucgagcagugcgggggcugggggugcggcugcuucaacgugaaccccagcugccucuucguccacaccuaccugcaguccgugcgcaaggaggcccugcggguguucaacugcaucgacuggguccacaagcucacccuggagaucacggacuucgacggcagcguguccaccaucgaccugggggccagcuccagccgcuucaccaacuggggcuccgugagccucagccuggacgccgaggggaucuccggcagcaacuccuucagcuucaucgagucccccgggaagggcuacgcgaucgucgacgagccguucagcgagaucccccggcagggcuuccugggggagauccgcugcaacuccgagagcuccgugcucagcgcccacgaguccugccugcgggcccccaaccuggugagcuacaagcccaugaucgaccagcucgagugcaccacgaaccugaucgacccguucgucguguucgagcgcggcucccugccccagacccgcaacgacaagaccuucgccgccagcaaggggaaccggggcgugcaggcguucuccaaggggagcguccaggccgaccucacccugauguucgacaaccugaagguggacuucgugggcgccgccgucuccugcgacgcggccuuccucaaccugacgggcugcuacagcugcaacgccggggcccgcgugugccuguccaucaccagcaccggcaccgggacgcucagcgcccacaacaaggacggcucccugcacaucguccugcccagcgagaacggcaccaaggaccagugccagauccuccacuucaccgugcccgaggugaaggaggaguucauguacuccugcgacggggacgagcgggcgcugcugaugaagggcacccucaucgccaucgacccguucgacgaccgccgggaggccgggggcgagagcacggucgugaaccccaaguccgggagcuggaacuucuucgacugguucuccggccugaugagcugguucggcgggccccugaagaccauccuccugaucugccuguacguggcccucuccaucggccuguucuuccugcucaucuaccuggggcgcaccggccugagcaagauguggcucgccgcgaccaagaaggccuccuga

SEQ ID NO: 12801 - RNA, 3594 nt, Artificial Sequence
  derived and/or modified CDS sequence (opt1) from RVFV(Kenya 56 (IB8))__DQ380190.1__GP
auguacgugcugcucaccauccugaucaccguccuggugugcgaggccgugauccgcgucagccucuccagcacgcgggaggagaccugcuucggcgacuccaccagccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcaggucggcaucgugcggugcgagcgccggcgcgacgccaagcagaucggccgggagaccauggcggggaucgccaugaccgugcugcccgcccuggccguguucgcgcucgcccccgucguguucgccgaggacccccaccuccgcaaccggcccggcaaggggcacaacuacaucgacggcaugacccagggggacgccacgugcaagccggugaccuacgccggcgcgugcagcuccuucgacguccugcuggagaagggcaaguucccccuguuccagagcuacgcccaccaccgcacccugcucgaggccgugcacgacaccaucaucgccaaggccgacccgcccuccugcgaccugcagagcgcgcacgggaaccccugcaugaaggagaagcuggugaugaagacgcacugccccaaggacuaccaguccgcccacuaccucaacaacgacggcaagauggccagcgucaagugcccgcccaaguacgagcugaccgaggacugcaacuucugccggcagaugaccggggccucccugaagaagggcagcuacccccuccaggaccuguucugccagagcuccgaggacgacggcagcaagcugaagaccaagaugaagggggugugcgaggugggcguccaggcccucaagaagugcgacgggcagcuguccacggcgcacgagguggugcccuucgccgucuucaagaacagcaagaagguguaccuggacaagcucgaccugaagaccgaggagaaccugcuccccgacuccuucgugugcuucgagcacaagggccaguacaaggggaccauggacagcggccagaccaagcgcgagcugaaguccuucgacaucagccagugccccaagaucggcgggcacggcuccaagaagugcacgggggacgccgccuucugcagcgccuacgagugcaccgcgcaguacgccaacgccuacugcucccacgccaacggcagcgggaucguccagauccagguguccggcgucuggaagcggccgcugugcgugggcuacgagcgcguggucgugaagcgggagcucagcgcgaagcccauccagcgcguggagcccugcacgaccugcaucaccaagugcgagccccacgggcuggucgugcgguccaccggcuucaagaucagcuccgccguggccugcgccagcggggucugcgugaccggcucccagagcccgagcaccgagaucacgcugaaguaccccgggaugucccagagcuccggcggcgacaucggggugcacauggcccacgacgaccagagcgucuccagcaagaucguggcgcacugcccgccccaggaccccugccucgugcacggcugcaucgucugcgcccacgggcugaucaacuaccagugccacaccgcccuguccgccuucgugguggucuucguguucagcuccguggccaucaucugccucgcgauccuguacaagguccugaagugccucaagaucgcgccccgcaaggugcugaacccccugauguggaucaccgccuucauccgguggguguacaagaagauggucgcccgcguggccgacaacaucaaccaggugaaccgcgagaucggcuggauggagggcgggcagccggcccucggcaaccccgcccccaucccccggcacgccccgaucccccgcuacagcaccuaccugaugcugcugcucaucgucuccuacgccagcgcgugcuccgagcugauccaggccagcucccggaucacgaccugcagcaccgagggggugaacaccaagugccgccuguccggcacggcccucauccgggccgggagcgugggcgccgaggcgugccugaugcugaagggcgucaaggaggaccagaccaaguuccucaagaucaagaccgugagcuccgagcugagcugccgcgaggggcaguccuacuggaccggcagcuucucccccaagugccugagcucccggcgcugccaccucgugggggagugccacgucaaccggugccugagcuggcgcgacaacgagaccuccgccgaguucagcuucgugggcgaguccacgaccaugcgggagaacaagugcuucgagcagugcgggggcuggggcugcgggugcuucaacgugaaccccagcugccuguucguccacaccuaccuccaguccgugcgcaaggaggcccugcggguguucaacugcaucgacuggguccacaagcugacccucgagaucacggacuucgacggcagcguguccaccaucgaccugggggccagcuccagccgcuucaccaacuggggcuccgugagccugagccucgacgccgaggggaucuccggcagcaacuccuucagcuucaucgaguccccgggcaagggguacgcgaucgucgacgagcccuucagcgagaucccccggcagggcuuccugggggagauccgcugcaacuccgagagcuccgugcugagcgcccacgaguccugccuccgggcccccaaccugaucagcuacaagccgaugaucgaccagcuggagugcaccacgaaccucaucgaccccuucguggccuucgagcgcggcucccugccccagacccggaacgacaagaccuucgccgcgagcaaggggaaccgcggcguccaggccuucuccaagggcagcgugcaggccgaccugacccucauguucgacaacuucgagguggacuucgucggggccgcgguguccugcgacgccgccuuccugaaccugacgggcugcuacagcugcaacgccggggcccgcgugugccucuccaucaccagcaccggcaccggcacgcugagcgcgcacaacaaggacgggucccugcacaucguccuccccagcgagaacggcaccaaggaccagugccagauccugcacuucaccgugccggaggucgaggaggaguucauguacuccugcgacggggacgagcggccccugcucgugaagggcacccugaucgccaucgaccccuucgacgaccgccgggaggccgggggcgagagcacgguggucaaccccaaguccggcagcuggaacuucuucgacugguucuccgggcugaugagcugguucggcgggccgcucaagaccauccugcugaucugccucuacguggcccuguccaucggccuguucuuccuccugaucuaccuggggcgcaccggccucagcaagauguggcuggccgcgaccaagaaggccuccuga

SEQ ID NO: 12802 - RNA, 3594 nt, Artificial Sequence
  derived and/or modified CDS sequence (opt1) from RVFV(KEN/Bar-035/07)__HM586969.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggccggcugcaggaggacgcgaccugcaagccggucaccuacgccggggccugcagcuccuucgacgugcugcuggagaagggcaaguucccccuguuccagagcuacgcccaccaccgcacgcuccuggaggccgugcacgacaccaucaucgccaaggccgacccgcccuccugcgaccugcagagcgcggacggcaacaagugcaugaaggagaagcucgucaugaagacccacugccccaacgacuaccaguccgcccacuaccugaacaacgacgggaagauggccagcgugaagugcccgcccaaguacgagcugaccgaggacugcaacuucugccggcagaugacgggcgccucccucaagaaggggagcuacccccugcaggaccuguucugccagagcuccgaggacgacggcagcaagcucaagaccaagaugaagggcgugugcgaggucggggugcaggcccugaagaagugcgacggccagcuguccaccgcgcacgaggugguccccuucgccguguucaagaacagcaagaagguguaccucgacaagcuggaccugaagaccgaggagaaccuccugcccgacuccuucgucugcuucgagcacaaggggcaguacaagggcacgauggacagcgggcagaccaagcgcgagcugaaguccuucgacaucagccagugccccaagaucggcggccacggguccaagaagugcaccggcgacgccgccuucugcagcgccuacgagugcaccgcgcaguacgccaacgccuacugcucccacgccaacgggagcggcaucgugcagauccaggucuccgggguguggaagaagccccucugcgugggcuacgagcgggucguggugaagcgcgagcugagcgcgaagccgauccagcgggucgagcccugcacgaccugcaucaccaagugcgagccccacggccugguggugcgcuccaccggguucaagaucagcuccgccgucgccugcgccagcggcgugugcgugacggggucccagagccccagcaccgagaucacccucaaguacccgggcaucucccagagcuccgggggcgacaucggcguccacauggcccacgacgaccagagcguguccagcaagaucguggcgcacugcccgccccaggaccccugccugguccacgggugcaucgugugcgcccacggccugaucaacuaccagugccacaccgcccucuccgccuucguggucaucuucguguucagcuccacggccaucaucugccuggcggugcuguaccggguccucaagugccugaagaucgcgccccgcaaggugcugaacccccucauguggaucaccgccuucauccgcuggguguacaagaagauggucgcccggguggccgacaacaucaaccaggugaaccgcgagaucggguggauggagggcggccagcuggcccuggggaaccccgccccgaucccccggcacgcccccaucccccgcuacagcaccuaccugaugcuccugcugaucgucuccuacgccagcgcgugcuccgagcucauccaggccagcucccggaucaccacgugcagcaccgagggcgugaacaccaagugccgccuguccgggaccgcccugauccgggcccgcagcgugggcgccgaggcgugccucaugcugaagggggucaaggaggaccagacgaaguuccugaagaucaagaccgugagcuccgagcucagcugccgggagggccaguccuacuggaccggcagcuucuccccgaagugccugagcucccgccggugccaccuggugggggagugccacgucaaccgcugccucagcuggcgggacaacgagaccuccgccgaguucagcuucgugggcgaguccaccacgaugcgcgagaacaagugcuucgagcagugcgggggcugggggugcggcugcuucaacgugaaccccagcugccuguucguccacaccuaccugcaguccgugcggaaggaggcccuccgcguguucaacugcaucgacuggguccacaagcugacccuggagaucaccgacuucgacggcagcguguccacgaucgaccucggggccagcuccagccgguucaccaacuggggcuccgugagccugagccuggacgccgaggggaucuccggcagcaacuccuucagcuucaucgagucccccgggaagggcuacgcgaucgucgacgagcccuucagcgagaucccgcgccagggcuuccucggggagauccggugcaacuccgagagcuccgugcugagcgcccacgaguccugccugcgcgcccccaaccucgugagcuacaagcccaugaucgaccagcuggagugcaccaccaaccugaucgaccccuucgucguguucgagcgcggcucccucccgcagacgcggaacgacaagaccuucgccgccagcaaggggaaccgcggcgugcaggcguucuccaaggggagcguccaggccgaccugacccugauguucgacaacuucgagguggacuucgugggcgccgccgucuccugcgacgcggccuuccucaaccugaccggcugcuacagcugcaacgccggggcccgggugugccuguccaucacgagcaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgcgaucgacccguucgacgaccggcgcgaggccgggggcgagagcaccguggugaaccccaaguccgggagcuggaacuucuucgacugguucuccggccugaugagcugguucggcgggccccugaagacgauccuccugaucugccuguacgucgcccucuccaucggccuguucuuccugcucaucuaccuggggcggaccggccugagcaagauguggcucgccgccaccaagaaggcguccuga

SEQ ID NO: 12803 - RNA, 3594 nt, Artificial Sequence
  derived and/or modified CDS sequence (opt1) from RVFV(TAN/Dod-002/07)__HM586971.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacgggcgcaagaagugcaccggcgacgccgccuucugcuccgccuacgagugcacggcgcaguacgccaacgccuacugcagccacgccaacggguccggcaucgugcagauccaggucagcgggguguggaagaagccgcugugcgugggcuacgagcgggucguggugaagcgcgagcucuccgcgaagcccauccagcgggucgagcccugcacgaccugcaucaccaagugcgagccccacggccugguggugcgcagcaccggguucaagaucuccagcgccgucgccugcgccuccggcgugugcgugaccgggagccaguccccgagcaccgagaucacccugaaguaccccggcaucagccaguccagcgggggcgacaucggcguccacauggcccacgacgaccaguccgugagcuccaagaucguggcgcacugcccgccccaggaccccugccucguccacgggugcaucgugugcgcccaggccuggaucaucagccaguggcacacggcccuguccgccuucguggucaucuucguguucagcuccaccgcgaucaucugccuggccgugcucuaccggguccugaagugccugaagaucgcgccccgcaaggugcucaacccccugauguggaucaccgccuucauccgcuggguguacaagaagauggucgcccggguggccgacaacaucaaccaggugaaccgcgagaucggcuggauggagggcgggcagcuggcccucggcaacccggcccccaucccccggcacgcccccaucccgcgcuacagcaccuaccugaugcugcugcucaucgucuccuacgcgagcgccugcuccgagcugauccaggccagcucccggaucacgaccugcagcaccgagggggugaacaccaagugccgccuguccggcacggcccucauccgggccgggagcgugggcgcggaggccugccugaugcugaagggggucaaggaggaccagaccaaguuccucaagaucaagaccgugagcuccgagcugagcugccgcgagggccaguccuacuggaccggcagcuucucccccaagugccugagcucccggcgcugccaccucgugggggagugccacgucaaccggugccugagcuggcgcgacaacgagaccuccgccgaguucagcuucgugggcgaguccacgaccaugcgggagaacaagugcuucgagcagugcgggggcugggggugcggcugcuucaacgugaaccccagcugccuguucguccacaccuaccuccaguccgugcgcaaggaggcccugcggguguucaacugcaucgacuggguccacaagcugacccucgagaucacggacuucgacggcagcguguccaccaucgaccugggggccagcuccagccgcuucaccaacuggggcuccgugagccugagccucgacgcggaggggaucuccggcagcaacuccuucagcuucaucgagucccccgggaagggcuacgccaucgucgacgagccguucagcgagaucccccggcagggcuuccugggggagauccgcugcaacuccgagagcuccgugcugagcgcccacgaguccugccuccgggcccccaaccuggugagcuacaagcccaugaucgaccagcuggagugcaccacgaaccucaucgacccguucgucguguucgagcgcggcucccugccccagacccgcaacgacaagaccuucgccgcgagcaaggggaaccggggcgugcaggccuucuccaaggggagcguccaggccgaccugacccucauguucgacaacuucgagguggacuucgugggcgccgcggucuccugcgacgccgccuuccugaaccugacgggcugcuacagcugcaacgccggggcccgcgugugccucuccaucaccagcaccggcaccgggacgcugagcgcgcacaacaaggacggcucccugcacaucguccuccccagcgagaacggcaccaaggaccagugccagauccugcacuucaccgugcccgagguggaggaggaguucauguacuccugcgacggggacgagcggccgcugcucgucaagggcacccugaucgccaucgaccccuucgacgaccgccgggaggccgggggcgagagcacgguggugaaccccaaguccgggagcuggaacuucuucgacugguucuccggccugaugagcugguucggcgggccccucaagaccauccugcugaucugccucuacgucgcccuguccaucggccuguucuuccuccugaucuaccuggggcgcaccggccucagcaagauguggcuggccgcgaccaagaaggccuccuga

SEQ ID NO: 12804 - RNA, 3594 nt, Artificial Sequence
  derived and/or modified CDS sequence (opt1) from RVFV(Beijing-01)__KX611606.1__GP
auguacgugcugcucaccauccugaucagcguccugguguucgagguggucauccgcgugucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcccugaaggcgaucaucgccgccgacgggcugaacaacaucacgugccacggcaaggaccccgaggacaagaucucccucaucaaggggccgccccacaagaagcgggucggcaucgugcgcugcgagcggcgccgggacgccaagcagaucggccgcgagaccauggccgggaucgcgaugaccgugcugcccgcccuggccgucuucgcccucgcgcccgugguguucgccgaggacccccaccuccggaaccgccccggcaaggggcacaacuacaucgacggcgucacccaggaggacgcgaccugcaagccggugacguacgccggggccugcagcuccuucgacgugcugcuggagaagggcaaguucccccuguuccagagcuacgcccaccaccggacccugcucgaggccguccacgacaccaucaucgccaaggccgacccgcccuccugcgaccugcagagcgcccacggcaaccccugcaugaaggagaagcuggugaugaagacccacugccccaacgacuaccaguccgcgcacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgucugcgaggugggggugcaggcccucaagaagugcgacggccggcuguccaccgcccacgaggucgugcccuucgcgguguucaagaacagcaagaaggucuaccuggacaagcucgaccugaagacggaggagaaccugcuccccgacuccuucgugugcuucgagcacaaggggcaguacaagggcaccauggacagcgggcagaccaagcgcgagcugaaguccuucgacaucagccagugccccaagaucggcggccacggguccaagaagugcaccggcgacgccgccuucugcagcgccuacgagugcacggcccaguacgcgaacgccuacugcucccacgccaacgggagcggcaucguccagauccagguguccgggguguggaagaagccgcugugcgucggcuacgagcgggugguggucaagcgcgagcucagcgccaagcccauccagcggguggagcccugcacgaccugcaucaccaagugcgagccccacggccuggugguccgcuccaccggguucaagaucagcuccgcgguggccugcgccagcggcgugugcgucaccgggucccagagcccgagcaccgagaucacccugaaguaccccggcaucucccagagcuccgggggcgacaucggcgugcacauggcccacgacgaccagagcguguccagcaagaucgucuucgacugcccgccccaggaccccugccucgugcacgggugcaucgugugcgcccacggccugaucaacuaccagugccacacggcgcuguccgccuucgucgugguguucgucuucagcuccguggccaucaucugccucgccauccuguacaaggugcugcggugccucaagaucgcccccaagaagguccugaacccccugauguggaucaccgcguucauccgcuggguguacaagaagaugguggcccgcgucgccgacaacaucaaccaggugaaccgggagaucggguggauggagggcggccagcucgcccuggggaacccggcccccaucccccgccacgcgcccaucccgcgguacagcaccuaccugaugcugcuccugaucaucuccuacgccagcgccugcuccgagcugauccaggccagcucccgcaucaccacgugcagcaccgagggcgugaacaccaagugccggcucuccgggaccgcgcugauccgcgccggcagcgucggggccgaggccugccugauguucgagggcgugaaggaggaccagacgaaguuccucaagaucaagaccgugagcuccgagcugagcugccgggagggccaguccuacuggaccgggagcuucucccccaagugccugagcucccgccggugccaccucgucggcgagugccacgugaaccgcugccugagcuggcgggacaacgagaccuccgccgaguucagcuucgugggggaguccaccacgaugcgcgagaacaagugcuucgagcagugcggcggguggggcugcggcugcuucaacgucaaccccagcugccuguucgugcacaccuaccuccaguccgugcggaaggaggcgcugcgcgucuucaacugcaucgacugggugcacaagcugacccucgagaucaccgacuucgacgggagcguguccacgaucgaccugggcgccagcuccagccgguucaccaacuggggguccgucagccugagccucgacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcugagcgcccacgaguccugccuccgcgcgcccaaccugaucagcuacaagcccaugaucgaccagcuggagugcaccaccaaccucaucgacccguucgucguguucgagcgggggucccugccccagacgcgcaacgacaagaccuucgccgccagcaagggcaaccgcggggugcaggccuucuccaagggcagcguccaggccgaccugacccucauguucgacaacuucgagguggacuucgugggcgcggccgucuccugcgacgccgccuuccugaaccugaccgggugcuacagcugcaacgcgggcgcccgggugugccucuccaucacgagcaccgggaccggcacccugagcgcccacaacaaggacggcucccugcacaucguccuccccagcgagaacgggacgaaggaccagugccagauccugcacuucaccgugcccgagguggaggaggaguucauguacuccugcgacggcgacgagcgcccgcugcucgucaaggggacccugaucgccaucgaccccuucgacgaccggcgcgaggccggcggggagagcaccguggugaaccccaaguccggcagcuggaacuucuucgacugguucuccggccugaugagcugguucgggggcccccucaagacgauccugcugaucugccucuacgucgcgcuguccaucgggcuguucuuccuccugaucuaccugggccggaccgggcucagcaagauguggcuggccgccaccaagaaggccuccuga

SEQ ID NO: 12805 - RNA, 3594 nt, Artificial Sequence
  derived and/or modified CDS sequence (opt1) from RVFV(Smithburn)__DQ380193.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaccaucgccgccgacgggcugaacaacaucacgugccacggcaaggaccccgaggacaagaucucccucaucaaggggccgccccacaagaagcgggugggcgucgugcgcugcgagcggcagcgcgacgccaagcagaucggccgggggaccauggcgggcaucgccaugaccguguuccccgcccuggucguguucgcccuggcgcccguggucuucgccgaggacccccaccuccgcaaccggcccgggaagggccacaacuacaucgacgggaugacccaggaggacgccacgugcaagccggugaccuacgccggcgccugcagcuccuucgacgugcugcuggagaagggcaaguucccccucuuccagagcuacgcgcaccaccgcacccugcuggaggccguccacgacaucaucaucgccaaggccgacccgcccuccugcaaccuccagagcgcccacgggaaccccugcaugaaggagaagcuggugaugaagaccuacugccccaacgacuaccaguccgcgcacuaccugaacaacgacggcaagauggccagcgugaagugcccgcccaagcacgagcucacggaggacugcaacuucugccggcagaugaccggggccucccugaaggagggcagcuacccccugcaggaccucuucugccagagcuccgaggacgacggcagcaagcugaagaccaagaugaagggggucugcgaggugggcgugcagguccugaagaagugcgacgggcagcucuccaccgcccacgagguggugcccuucgccgucuucaagaacagcaagaagguguaccuggacaagcuggaccucaagacggaggagaaccugcugcccgacuccuucgucugcuucgagcacaagggccaguacaaggggaccauggacagcggccagaucaagcgcgagcucaaguccuucgacaucagccagugccccaagaucggcgggcacggcuccaagaagugcaccggggacgcggccuucugcagcgccuacgagugcaccgcccaguacgccaacgcguacugcucccacgccaacggcagcgggaucgugcagauccagguguccggcgucuggaagaagccgcugugcgugggcuacgagcggguggucgugaagcgcgagcugagcgccaagcccauccagcggguggagcccugcacgaccugcaucaccaagugcgagccccacgggcucgucgugcgcuccaccggcuucaagaucagcuccgccguggcgugcgccagcggggucugcgugacgggcucccagagcccgagcaccgagaucacccugaaguaccccgggaucucccagagcuccggcggcgacaucggggugcacauggcccacgacgaccagagcgucuccagcaagaucguggcccacugcccgccccaggaccccugccuggugcacggcugcaucgucugcgcccacgggcucaucaacuaccagugccacaccgcguucuccgccuucgugguggucuucguguucagcuccguggucaucaucugccuggccauccuguacaaggugcucaagugccugaagaucgcgccccggaaggugcugaacccccucauguggaucacggccuucauccgcugggucuacaagaagaugguggcccggguggccgacaacaucaaccaggucaaccgcgagaucggcuggauggagggcgggcagcuggugcugggcaacccggcccccaucccccgccacgcccccaucccgcgguacagcaccuaccucaugcugcugcugaucguguccuacgccagcgcgugcuccgagcucauccaggccagcucccgcaucacgaccugcagcaccgagggggucaacaccaagugccggcuguccggcaccgcccugauccgcgccgggagcgugggcgcggaggccugccucaugcugaagggcgugaaggaggaccagaccaaguuccugaagaucaagacggucagcuccgagcucagcugccgggaggggcaguccuacuggaccggcagcuucucccccaagugccugagcucccgccggugccaccuggugggggagugccacgugaaccgcugccucagcuggcgggacaacgagaccuccgccgaguucagcuucgucggcgaguccaccaccaugcgcgagaacaagugcuucgagcagugcgggggcuggggcugcgggugcuucaacgugaaccccagcugccuguucgugcacacguaccugcaguccguccggaaggaggcccuccgcguguucaacugcaucgacugggugcacaagcugacccuggagaucaccgacuucgacggcagcgucuccaccguggaccucggggccagcuccagccgguucacgaacuggggcuccgugagccugagccuggacgcggaggggaucuccggcagcaacuccuucagcuucaucgagucccccggcaagggguacgccaucgucgacgagccguucagcgagaucccccgccagggcuuccucggggagauccggugcaacuccgagagcuccgugcugagcgcccacgaguccugccugcgcgcccccaaccucaucagcuacaagcccaugaucgaccagcuggagugcaccaccaaccugaucgacccguucguggucuucgagcggggcucccucccccagacccgcaacgacaagacguucgccgcgagcaaggggaaccggggcgugcaggccuucuccaagggcagcguccaggccgaccugacccugauguucgacaacuucgagguggacuucgugggggccgccgucuccugcgacgcggccuuccucaaccugaccggcugcuacagcugcaacgccggggcccgcgugugccuguccaucaccagcacgggcaccggcacccucagcgcgcacaacaaggacgggucccugcacaucgugcugcccagcgagaacggcaccaaggaccagugccagauccuccacuucacgguccccgagguggaggaggaguucauguacuccugcgacggggacgagcgcccgcugcuggugaagggcacccucaucgccaucgaccccuucgacgaccggcgcgaggccgggggcgagagcaccgucgugaaccccaaguccggcagcuggaacuucuucgacugguucuccgggcugaugagcugguucggcgggccccugaagaccauccuccugaucugccuguacguggcccucuccaucggccuguucuucuuccugaucuaccucgggcggacgggccugagcaagauguggcuggccgcgaccaagaaggccuccuga

SEQ ID NO: 12806 - RNA, 3594 nt, Artificial Sequence
  derived and/or modified CDS sequence (opt1) from RVFV(KEN/Bar-032/07)__HM586968.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggccggcugcaggaggacgcgaccugcaagccggucaccuacgccggggccugcagcuccuucgacgugcugcuggagaagggcaaguucccccuguuccagagcuacgcccaccaccgcacgcuccuggaggccgugcacgacaccaucaucgccaaggccgacccgcccuccugcgaccugcagagcgcggacggcaacaagugcaugaaggagaagcucgucaugaagacccacugccccaacgacuaccaguccgcccacuaccugaacaacgacgggaagauggccagcgugaagugcccgcccaaguacgagcugaccgaggacugcaacuucugccggcagaugacgggcgccucccucaagaaggggagcuacccccugcaggaccuguucugccagagcuccgaggacgacggcagcaagcucaagaccaagaugaagggcgugugcgaggucggggugcaggcccugaagaagugcgacggccagcuguccaccgcgcacgaggugguccccuucgccguguucaagaacagcaagaagguguaccucgacaagcuggaccugaagaccgaggagaaccuccugcccgacuccuucgucugcuucgagcacaaggggcaguacaagggcacgauggacagcgggcagaccaagcgcgagcugaaguccuucgacaucagccagugccccaagaucggcggccacggguccaagaagugcaccggcgacgccgccuucugcagcgccuacgagugcaccgcgcaguacgccaacgccuacugcucccacgccaacgggagcggcaucgugcagauccaggucuccgggguguggaagaagccccucugcgugggcuacgagcgggucguggugaagcgcgagcugagcgcgaagccgauccagcgggucgagcccugcacgaccugcaucaccaagugcgagccccacggccugguggugcgcuccaccggguucaagaucagcuccgccgucgccugcgccagcggcgugugcgugacggggucccagagccccagcaccgagaucacccucaaguacccgggcaucucccagagcuccgucggggacaucggcgugcacauggcccacgacgaccagagcguguccagcaagaucgucgcgcacugcccgccccaggaccccugccuggugcacggcugcaucgugugcgcccacgggcugaucaacuaccagugccacaccgcccucuccgccuucgucgugaucuucguguucagcuccacggccaucaucugccuggcgguccuguaccgggugcucaagugccugaagaucgcgccccgcaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgccccgaucccccggcacgcccccaucccccgcuacagcaccuaccugaugcuccugcugaucguguccuacgccagcgcgugcuccgagcucauccaggccagcucccggaucaccacgugcagcaccgagggggugaacaccaagugccgccugucccacaccgcccugauccgggccggcagcgucggggccgaggcgugccucaugcugaagggcgugaaggaggaccagacgaaguuccugaagaucaagaccgugagcuccgagcucagcugccgcgaggggcaguccuacuggaccggcagcuucuccccgaagugccugagcucccggcgcugccaccuggucggcgagugccacgugaaccggugccucagcuggcgcgacaacgagaccuccgccgaguucagcuucgugggggaguccaccacgaugcgggagaacaagugcuucgagcagugcggcggguggggcugcgggugcuucaacgucaaccccagcugccuguucgugcacaccuaccugcaguccgugcgcaaggaggcccuccgggucuucaacugcaucgacugggugcacaagcugacccuggagaucaccgacuucgacggcagcguguccacgaucgaccucggcgccagcuccagccgcuucaccaacuggggguccgucagccugagccuggacgccgagggcaucuccgggagcaacuccuucagcuucaucgagucccccggcaagggguacgcgaucguggacgagcccuucagcgagaucccgcggcagggcuuccucggcgagauccgcugcaacuccgagagcuccgugcugagcgcccacgaguccugccugcgggcccccaaccucgucagcuacaagcccaugaucgaccagcuggagugcaccaccaaccugaucgaccccuucgugguguucgagcgcgggucccucccgcagacgcgcaacgacaagaccuucgccgccagcaagggcaaccgcgggguccaggcguucuccaagggcagcgugcaggccgaccugacccugcgguucgacaacuucgagguggacuucgucggggccgccguguccugcgacgcggccuuccucaaccugaccggcugcuacagcugcaacgccggcgcccgggucugccuguccaucacgagcaccgggaccggcacccucagcgcccacaacaaggacgggucccugcacaucgugcugcccagcgagaacggcacgaaggaccagugccagauccuccacuucaccgugcccgaggucgaggaggaguucauguacuccugcgacggcgacgagcgcccccugcuggugaaggggacccucaucgcgaucgacccguucgacgaccggcgcgaggccggcggggagagcaccguggucaaccccaaguccggcagcuggaacuucuucgacugguucuccgggcugaugagcugguucggcggcccccugaagacgauccuccugaucugccuguacguggcccucuccaucgggcuguucuuccugcucaucuaccugggccggaccgggcugagcaagauguggcucgccgccaccaagaaggcguccuga

SEQ ID NO: 12807 - RNA, 3594 nt, Artificial Sequence
  derived and/or modified CDS sequence (opt1) from RVFV(KEN/Gar-004/06)__HM586964.1__GP
auguacgugcugcucaccauccugaucagcgucugggugugcgaggccgugauccgcgucucccugagcuccacccgggaggagacgugcuucggcgacagcaccaaccccgagaugaucgagggggccugggacucccuccgcgaggaggagaugccggaggagcugagcugcuccgugagcggcauccgggaggugaagaccuccagccaggagcuguaccgcgcgcucaaggccaucaucgccgccgacgggcugaacaacaucacgugccacggcaagaaccccgaggacaagaucucccugaucaaggggccgccccacaagaagcgggucggcaucgugcgcugcgagcggcgccgggacgccaagcagaucggccgcgagaccauggcggggaucgccaugaccgugcuccccgcccuggccgucuucgcgcuggcccccgugguguucgccgaggacccccaccuccggaaccgccccggcaaggggcacaacuacaucgacggcaugacccaggaggacgcgaccugcaagccggucacguacgccggggccugcagcuccuucgacgugcugcuggagaagggcaaguucccccucuuccagagcuacgcccaccaccggacccugcuggaggccgugcacgacaccaucaucgccaaggccgacccgcccuccugcgaccuccagagcgcgcacggcaaccccugcaugaaggagaagcuggucaugaagacccacugccccaacgacuaccaguccgcccacuaccugaacaacgacgggaagauggccagcgugaagugcccgcccaaguacgagcucacggaggacugcaacuucugccgccagaugaccggcgccucccugaagaaggggagcuacccccugcaggaccucuucugccagagcuccgaggacgacggcagcaagcugaagaccaagaugaagggcgugugcgaggucggggugcaggcccugaagaagugcgacggccagcucuccaccgcgcacgaggugguccccuucgccguguucaagaacagccagaagguguaccuggacaagcuggaccucaagacggaggagaaccugcugcccgacuccuucgucugcuucgagcacaaggggcaguacaagggcaccauggacagcgggcagaccaagcgggagcucaaguccuucgacaucagccagugccccaagaucggcggccacgggcgcaagaagcggaccggcgacgccgccuucugcuccgccuacgagugcacggcgcaguacgccaacgccuacugcagccgcgccaacggguccggcaucgugcagauccaggucagccggguguggaagaagccgcugugcgugggguacgagcgcgucguggugaagcgggagcuguccgcgaagcccauccagcgcgucgagcccugcacgaccugcaucaccaagugcgagccccacggccucguggugcgcagcaccggcuucaagaucuccagcgccgucgccugcgccuccggggugugcgugaccggcagccaguccccgagcaccgagaucacccugaaguaccccgggaucagccaguccagcggcggggacaucggcguccacauggcccacgacgaccaguccgugagcuccaagaucguggcgcacugcccgccccaggaccccugccugguccacggcugcaucgugugcgcccacgggcucaucaacaaccagagccacuccgcccugagcgccuucguggucaucuucguguucuccagcacggccaucaucugccuggcggugcucuaccggguccugaagugccugaagaucgcgccccgcaaggugcucaacccccugauguggaucaccgccuucauccgguggguguacaagaagauggucgcccgcguggccgacaacaucaaccaggugaaccgggagaucggcuggauggagggcgggcagcuggcccucggcaacccggcccccaucccccgccacgcccccaucccgcgguacuccaccuaccugaugcugcugcucaucgucagcuacgccuccgcgugcagcgagcugauccaggccuccagccgcaucaccacgugcuccaccgagggggugaacaccaagugccggcugagcggcaccgcccucauccgcgccgggagcgugggcgccgaggcgugccugaugcugaagggggucaaggaggaccagacgaaguuccucaagaucaagaccguguccagcgagcuguccugccgggagggccagagcuacuggaccggcuccuucagccccaagugccuguccagccgccggugccaccucgugggggagugccacgucaaccgcugccuguccuggcgggacaacgagaccagcgccgaguucuccuucgugggcgagagcaccacgaugcgcgagaacaagugcuucgagcagugcgggggcugggggugcggcugcuucaacgugaaccccuccugccuguucguccacaccuaccuccagagcgugcggaaggaggcccugcgcguguucaacugcaucgacuggguccacaagcugacccucgagaucaccgacuucgacggcuccgugagcacgaucgaccugggggccuccagcucccgguucaccaacuggggcagcgugagccugucccucgacgccgaggggaucagcggcuccaacagcuucuccuucaucgagagccccgggaagggcuacgcgaucgucgacgagccguucuccgagaucccccgccagggcuuccugggggagauccgcugcaacagcgaguccagcgugcuguccgcccacgagagcugccuccgggcccccaaccugguguccuacaagcccaugaucgaccagcuggagugcaccaccaaccucaucgacccguucgucguguucgagcgcggcagccugccccagacgcggaacgacaagaccuucgccgccuccaaggggaaccgcggcgugcaggcguucagcaagggguccguccaggccgaccugacccuccgguucgacaacuucgagguggacuucgugggcgccgccgucagcugcgacgcggccuuccugaaccugaccggcugcuacuccugcaacgccggggcccgcgugugccucagcaucacgagcaccggcaccgggacccuguccgcccacaacaaggacggcagccugcacaucguccuccccuccgagaacggcacgaaggaccagugccagauccugcacuucaccgugcccgagguggaggaggaguucauguacagcugcgacggggacgagcggccgcugcucgucaagggcacccugaucgcgaucgaccccuucgacgaccgccgggaggccgggggcgaguccaccguggugaaccccaagagcggguccuggaacuucuucgacugguucagcggccugauguccugguucggcgggccccucaagacgauccugcugaucugccucuacgucgcccugagcaucggccuguucuuccuccugaucuaccuggggcgcaccggccucuccaagauguggcuggccgccaccaagaaggcgagcuga

SEQ ID NO: 12808 - RNA, 3621 nt, Artificial Sequence
  derived and/or modified CDS sequence (opt1) from RVFV(RVFV)__M11157.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcuggagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacggccugacggaggacugcaacuucugccgccagaugaccggggccucccugaagaagggcagcuacccccuccaggaccuguucugccagagcuccgaggacgacggcagcaagcugaagaccaagaugaagggggugugcgaggugggcguccaggcccacaagaagugcgacgggcagcucuccaccgcgcacgagguggugcccuucgccgucuucaagaacagcaagaagguguaccuggacaagcuggaccucaagacggaggagaaccugcugcccgacuccuucgugugcuucgagcacaagggccaguacaaggggaccauggacagcggccagaccaagcgggagcucaaguccuucgacaucagccagugccccaagaucggcgggcacggcuccaagaagugcaccggggacgccgccuucugcagcgccuacgagugcacggcgcaguacgccaacgccuacugcucccacgccaacggcagcgggaucguccagauccagguguccggcgucuggaagaagccgcugugcgugggcuacgagcgcguggucgugaagcgggagcugagcgcgaagcccauccagcgcguggagcccugcacgaccugcaucaccaagugcgagccccacgggcucgucgugcgguccaccggcuucaagaucagcuccgccguggccugcgccagcggggucugcgugaccggcucccagagcccgagcaccgagaucacccugaaguaccccgggaucucccagagcuccggcggcgacaucggggugcacauggcccacgacgaccagagcgucuccagcaagaucguggcgcacugcccgccccaggaccccugccuggugcacggcugcaucgucugcgcccacgggcucaucaacuaccagugccacacggcccuguccgccuucgugguggucuucguguucagcuccaucgccaucaucugccuggcggugcucuaccgcguccugaagugccugaagaucgcgccccggaaggugcucaacccccugauguggaucaccgccuucauccgcuggaucuacaagaagaugguggcccgcgucgcccacaacaucaaccaggugaaccgggagaucggcuggauggagggcgggcagcuggugcucggcaacccggcccccaucccccgccacgcccccaucccgcgguacagcaccuaccugaugcugcugcucaucgucuccuacgccagcgccugcuccgagcugauccaggcgagcucccgcaucaccacgugcagcaccgagggggugaacaccaagugccggcuguccggcaccgcccucauccgcgccgggagcgugggcgccgaggccugccugaugcugaagggcgucaaggaggaccagacgaaguuccucaagaucaagaccgugagcuccgagcugagcugccgggaggggcaguccuacuggaccggcagcaucucccccaagugccugagcucccgccggugccaccucgugggggagugccacgucaaccgcugccugagcuggcgggacaacgagaccuccgcggaguucagcuucgugggcgaguccaccacgaugcgcgagaacaagugcuucgagcagugcgggggcuggggcugcgggugcuucaacgugaaccccagcugccuguucguccacaccuaccuccaguccgugcggaaggaggcccugcgcguguucaacugcaucgacuggguccacaagcugacccucgagaucaccgacuucgacggcagcguguccacgaucgaccugggggccagcuccagccgguucaccaacuggggcuccgugagccugagccucgacgccgaggggaucuccggcagcaacuccuucagcuucaucgagucccccagcaagggcuacgccaucgucgacgagccguucuccgagaucccccgccagggguuccugggcgagauccggugcaacagcgaguccagcgugcuguccgcgcacgagagcugccuccgcgcccccaaccugaucuccuacaagcccaugaucgaccagcuggagugcaccaccaaccucaucgacccguucguggucuucgagcgggggagccugccccagacgcgcaacgacaagaccuucgccgccuccaagggcaaccgcggggugcaggccuucagcaagggcuccgugcaggcggaccugacccucauguucgacaacuucgaggucgacuucgugggcgccgccgugagcugcgacgccgcguuccugaaccugaccgggugcuacuccugcaacgccggcgcccgggucugccucagcaucacgagcaccgggaccggcucccugagcgcccacaacaaggacggcucccugcacaucgugcuccccagcgagaacgggaccaaggaccagugccagauccugcacuucacgguccccgagguggaggaggaguucauguacuccugcgacggcgacgagcgcccgcugcucgugaaggggacccugaucgccaucgaccccuucgacgaccggcgcgaggcgggcggggagagcaccgucgugaaccccaaguccggcagcuggaacuucuucgacugguucuccggccugaugagcugguucgggggcccccucaagcuguacuccagcuucgccugcaugcugcacuaccagcucggguccuucagcucccuguacauccuggaggagcaggccagccucaagugcggccugcugccgcuccggcgcccccaccgguccgugcgcgucaaggugaucugcuga

SEQ ID NO: 12809 - RNA, 3480 nt, Artificial Sequence
  derived and/or modified CDS sequence (opt1) from RVFV(ZH-548)__DQ380206.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcucuccgcccacggcaaccccugcaugaaggagaagcuggucaugaagacccacugccccaacgacuaccagagcgcgcacuaccugaacaacgacggcaagauggccuccgugaagugcccgcccaaguacgagcucacggaggacugcaacuucugccgccagaugaccggggccagccugaagaagggcuccuacccccugcaggaccucuucugccagagcuccgaggacgacgggagcaagcugaagaccaagaugaagggcgugugcgaggucggcgugcaggcccugaagaagugcgacgggcagcucuccaccgcccacgaggugguccccuucgcgguguucaagaacagcaagaagguguaccuggacaagcuggaccucaagacggaggagaaccugcugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccucguggugcggagcaccggcuucaagaucuccagcgcggucgccugcgccuccggggugugcgugaccggcagccagucccccagcaccgagaucacccugaaguacccggggaucucccagagcuccggcggggacaucggcguccacauggcccacgacgaccagagcgugagcuccaagaucguggcccacugcccgccccaggaccccugccugguccacgacugcaucgugugcgcgcacggccucaucaacuaccagugccacacggcccugagcgccuucguggucguguucguguucuccagcaucgccaucaucugccuggccauccucuaccgcguccugaagugccugaagaucgcgccccggaaggugcucaacccccugauguggaucaccgccuucauccgcuggaucuacaagaagaugguggcccgggucgccgacaacaucaaccaggugaaccgcgagaucggguggauggagggcgggcagcuggugcucggcaaccccgccccgaucccccgccacgcgcccaucccccgguacuccaccuaccugaugcugcuccugaucgucagcuacgccuccgccugcagcgagcugauccaggccuccagccgcaucaccacgugcuccaccgagggcgugaacaccaagugccggcugagcgggaccgcgcucauccgcgccggcuccgugggggccgaggccugccugaugcugaagggcgucaaggaggaccagacgaaguuccucaagaucaagaccgugagcuccgagcugagcugccgggaggggcaguccuacuggaccggcagcuucagcccgaagugccuguccagccgccggugccaccucgugggcgagugccacgucaaccgcugccuguccuggcgggacaacgagaccagcgccgaguucuccuucgugggggagagcacgaccaugcgcgagaacaagugcuucgagcagugcggcggguggggcugcgggugcuucaacgugaaccccuccugccuguucguccacaccuaccuccagagcgugcggaaggaggcgcugcgcguguucaacugcaucgacuggguccacaagcugacccucgagaucaccgacuucgacggcuccgugagcacgaucgaccugggcgccuccagcucccgguucaccaacugggggagcgugucccugagccucgacgccgagggcaucuccgggagcaacuccuucagcuucaucgagagccccggcaagggguacgccaucgucgacgagcccuucuccgagaucccgcgccagggcuuccugggcgagauccggugcaacagcgaguccagcgugcuguccgcccacgagagcugccuccgcgcgcccaaccugaucuccuacaagcccaugaucgaccagcuggagugcaccaccaaccucaucgaccccuucguggucuucgagcgggggagccugccgcagacgcgcaacgacaagaccuucgccgccuccaagggcaaccgcggggugcaggccuucagcaagggcuccgugcaggccgaccugacccucauguucgacaacuucgaggucgacuucgugggggcggccgugagcugcgacgccgccuuccugaaccugaccggcugcuacuccugcaacgcgggcgcccgggucugccucagcaucacguccaccgggaccggcagccuguccgcccacaacaaggacgggagccugcacaucgugcuccccuccgagaacggcaccaaggaccagugccagauccugcacuucacggugcccgaggucgaggaggaguucauguacagcugcgacggcgacgagcgcccccugcucgugaaggggacccugaucgccaucgacccguucgacgaccggcgcgaggccggcggggagagcaccguggucaaccccaaguccggcagcuggaacuucuucgacugguucuccgggcugaugagcugguucggcggcccccucaagaccauccugcugaucugccucuacguggcgcuguccaucgggcuguucuuccuccugaucuaccugggccggacggggcucagcaagauguggcuggccgccaccaagaaggccuccuga

SEQ ID NO: 12810 - RNA, 3480 nt, Artificial Sequence
  derived and/or modified CDS sequence (opt1) from RVFV(ZS-6365)__DQ380205.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccauccuguaccgcguccucaagugccugaagaucgcgccccggaaggugcugaacccccucauguggaucaccgccuucauccgcuggaucuacaagaagaugguggcccgggucgccgacaacaucaaccaggugaaccgcgagaucggcuggauggagggcgggcagcuggugcugggcaaccccgccccgaucccccgccacgcgcccaucccccgguacuccaccuaccucaugcugcugcucaucgucagcuacgccuccgccugcagcgagcugauccaggccuccagccgcaucaccacgugcuccaccgagggggugaacaccaagugccggcugagcggcaccgcgcugauccgcgccggguccgugggcgccgaggccugccucaugcugaagggggucaaggaggaccagacgaaguuccugaagaucaagaccgugagcuccgagcucagcugccgggagggccaguccuacuggaccggcagcuucagcccgaagugccuguccagccgccggugccaccuggugggggagugccacgucaaccgcugccucuccuggcgggacaacgagaccagcgccgaguucuccuucgugggcgagagcacgaccaugcgcgagaacaagugcuucgagcagugcgggggcugggggugcggcugcuucaacgugaaccccuccugccuguucguccacaccuaccugcagagcgugcggaaggaggcgcuccgcguguucaacugcaucgacuggguccacaagcugacccuggagaucaccgacuucgacggcuccgugagcacgaucgaccucggggccuccagcucccgguucaccaacuggggcagcgugucccugagccuggacgccgaggggaucuccggcagcaacuccuucagcuucaucgagagccccgggaagggcuacgccaucgucgacgagcccuucuccgagaucccgcgccagggcuuccucggggagauccggugcaacagcgaguccagcgugcuguccgcccacgagagcugccugcgcgcgcccaaccucaucuccuacaagcccaugaucgaccagcuggagugcaccaccaaccugaucgaccccuucguggucuucgagcggggcagccucccgcagacgcgcaacgacaagaccuucgccgccuccaaggggaaccggggcgugcaggccuucagcaagggguccgugcaggccgaccugacccugauguucgacaacuucgaggucgacuucgugggcgcggccgugagcugcgacgccgccuuccucaaccugaccggcugcuacuccugcaacgcgggggcccgcgucugccugagcaucacguccaccggcaccgggagccucuccgcccacaacaaggacggcagccugcacaucgugcugcccuccgagaacggcaccaaggaccagugccagauccuccacuucacggugcccgaggucgaggaggaguucauguacagcugcgacggggacgagcgcccccugcuggugaagggcacccucaucgccaucgacccguucgacgaccggcgcgaggccgggggcgagagcaccguggucaaccccaaguccgggagcuggaacuucuucgacugguucuccggccugaugagcugguucggcgggccccugaagaccauccuccugaucugccuguacguggcgcucuccaucggccuguucuuccugcucaucuaccuggggcggacgggccugagcaagauguggcucgccgccaccaagaaggccuccuga

SEQ ID NO: 12811 - RNA, 3480 nt, Artificial Sequence
  derived and/or modified CDS sequence (opt1) from RVFV(MP-12)__DQ380208.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcuccuggagaaggggaaguucccgcuguuccaguccuacgcccaccaccggacccuccuggaggccgugcacgacaccaucaucgccaaggccgacccgcccagcugcgaccugcucuccgcccacggcaaccccugcaugaaggagaagcuggucaugaagacccacugccccaacgacuaccagagcgcgcaccaccugaacaacgacggcaagauggccuccgugaagugcccgcccaaguacgagcucacggaggacugcaacuucugccgccagaugaccggggccagccugaagaagggcuccuacccccugcaggaccucuucugccagagcuccgaggacgacgggagcaagcugaagaccaagaugaagggcgugugcgaggucggcgugcaggcccugaagaagugcgacgggcagcucuccaccgcccacgaggugguccccuucgcgguguucaagaacagcaagaagguguaccuggacaagcuggaccucaagacggaggagaaccugcugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccucguggugcggagcaccggcuucaagaucuccagcgcggucgccugcgccuccggggugugcgugaccggcagccagucccccagcaccgagaucacccugaaguacccggggaucucccagagcuccggcggggacaucggcguccacauggcccacgacgaccagagcgugagcuccaagaucguggcccacugcccgccccaggaccccugccugguccacgacugcaucgugugcgcgcacggccucaucaacuaccagugccacacggcccugagcgccuucguggucguguucguguucuccagcaucgccaucaucugccuggccauccucuaccgcguccugaagugccugaagaucgcgccccggaaggugcucaacccccugauguggaucaccgccuucauccgcuggaucuacaagaagaugguggcccgggucgccgacaacaucaaccaggugaaccgcgagaucggguggauggagggcgggcagcuggugcucggcaaccccgccccgaucccccgccacgcgcccaucccccgguacuccaccuaccugaugcugcuccugaucgucagcuacgccuccgccugcagcgagcugauccaggccuccagccgcaucaccacgugcuccaccgagggcgugaacaccaagugccggcugagcgggaccgcgcucauccgcgccggcuccgugggggccgaggccugccugaugcugaagggcgucaaggaggaccagacgaaguuccucaagcugaagaccgugagcuccgagcugagcugccgggaggggcaguccuacuggaccggcagcuucagcccgaagugccucuccagccgccggugccaccuggugggcgagugccacgucaaccgcugccuguccuggcgggacaacgagaccagcgccgaguucuccuucgugggggagagcacgaccaugcgcgagaacaagugcuucgagcagugcggcggguggggcugcgggugcuucaacgugaaccccuccugccucuucguccacaccuaccugcagagcgugcggaaggaggcgcugcgcguguucaacugcaucgacuggguccacaagcucacccuggagaucaccgacuucgacggcuccgugagcacgaucgaccugggcgccuccagcucccgguucaccaacugggggagcgugucccucagccuggacgccgagggcaucuccgggagcaacuccuucagcuucaucgagagccccggcaagggguacgccaucgucgacgagcccuucuccgagaucccgcgccagggcuuccugggcgagauccggugcaacagcgaguccagcgugcucuccgcccacgagagcugccugcgcgcgcccaaccugaucuccuacaagcccaugaucgaccagcucgagugcaccaccaaccugaucgaccccuucguggucuucgagcgggggagccugccgcagacgcgcaacgacaagaccuucgccgccuccaagggcaaccgcggggugcaggccuucagcaagggcuccgugcaggccgaccucacccugauguucgacaacuucgaggucgacuucgugggggcggccgugagcugcgacgccgccuuccugaaccucaccggcugcuacuccugcaacgcgggcgcccgggucugccugagcaucacguccaccgggaccggcagccuguccgcccacaacaaggacgggagccuccacaucgugcugcccuccgagaacggcaccaaggaccagugccagauccugcacuucacggugcccgaggucgaggaggaguucauguacagcugcgacggcgacgagcgcccccuccuggugaaggggacccugaucgccaucgacccguucgacgaccggcgcgaggccggcggggagagcaccguggucaaccccaaguccggcagcuggaacuucuucgacugguucuccgggcucaugagcugguucggcggcccccugaagaccauccugcucaucugccuguacguggcgcuguccaucgggcuguucuuccugcugaucuaccucggcgggacgggccugagcaagauguggcuggccgccaccaagaaggccuccuga

SEQ ID NO: 12812 - RNA, 3480 nt, Artificial Sequence
  derived and/or modified CDS sequence (opt1) from RVFV(T1)__DQ380201.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccguccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggugaacaccaagugccggcugagcggcaccgcgcugauccgcgccggguccgucggcgccgaggccugccucaugcugaagggggugaaggaggaccagacgaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagaccagcgccgaguucuccuucgugggcgagagcacgaccaugcgcgagaacaagugcuucgagcagugcgggggcugggggugcggcugcuucaacgucaaccccuccugccuguucgugcacaccuaccugcagagcgugcggaaggaggcgcuccgcgucuucaacugcaucgacugggugcacaagcugacccuggagaucaccgacuucgacggcuccgugagcacgaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcccacgagagcugccugcgcgcgcccaaccucaucuccuacaagcccaugaucgaccagcuggagugcaccaccaaccugaucgaccccuucgucguguucgagcggggcagccucccgcagacgcgcaacgacaagaccuucgccgccuccaaggggaaccggggcgugcaggccuucagcaagggguccguccaggccgaccugacccugauguucgacaacuucgagguggacuucgugggcgcggccgucagcugcgacgccgccuuccucaaccugaccggcugcuacuccugcaacgcgggggcccgcgugugccugagcaucacguccaccggcaccgggagccucuccgcccacaacaaggacggcagccugcacaucgugcugcccuccgagaacggcaccaaggaccagugccagauccuccacuucacgguccccgagguggaggaggaguucauguacagcugcgacggggacgagcgcccccugcuggugaagggcacccucaucgccaucgacccguucgacgaccggcgcgaggccgggggcgagagcaccgucgugaaccccaaguccgggagcuggaacuucuucgacugguucuccggccugaugagcugguucggcgggccccugaagaccauccuccugaucugccuguacgucgcgcucuccaucggccuguucuuccugcucaucuaccuggggcggacgggccugagcaagauguggcucgccgccaccaagaaggccuccuga

SEQ ID NO: 12813 - RNA, 3480 nt, Artificial Sequence
  derived and/or modified CDS sequence (opt1) from RVFV(1853/78)__DQ380220.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggguggugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggucaacaccaagugccggcugagcggcaccgcgcugauccgcgccggguccgugggcgccgaggccugccucaugcugaagggggugaaggaggaccagacgaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgccgaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcgcuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcccacgagagcugccugcgcgcgcccaaccucaucuccuacaagcccaugaucgaccagcuggagugcaccaccaaccugaucgaccccuucgugguguucgagcggggcagccucccgcagacgcgcaacgacaagaccuucgccgccuccaaggggaaccggggcguccaggccuucagcaagggguccgugcaggccgaccugacccugauguucgacaacuucgagguggacuucgucggcgcggccgugagcugcgacgccgccuuccucaaccugaccggcugcuacuccugcaacgcgggggcccgcgugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcgcucagcaucggccuguucuuccugcucaucuaccuggggcggaccggccuguccaagauguggcucgccgccaccaagaaggccagcuga

SEQ ID NO: 12814 - RNA, 3480 nt, Artificial Sequence
  derived and/or modified CDS sequence (opt1) from RVFV(CAR-R1622)__DQ380219.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccauccuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggcuggauggagggcgggcagcugguccugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggugaacaccaagugccggcugagcggcaccgcgcugauccgcgccggguccgucggcgccgaggccugccucaugcugaagggggugaaggaggaccagacgaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagaccagcgccgaguucuccuucgugggcgagagcacgaccaugcgcgagaacaagugcuucgagcagugcgggggcugggggugcggcugcuucaacgucaaccccuccugccuguucgugcacaccuaccugcagagcgugcggaaggaggcgcuccgcgucuucaacugcaucgacugggugcacaagcugacccuggagaucaccgacuucgacggcuccgugagcacgaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcccacgagagcugccugcgcgcgcccaaccucaucuccuacaagcccaugaucgaccagcuggagugcaccaccaaccugaucgaccccuucgucguguucgagcggggcagccucccgcagacgcgcaacgacaagaccuucgccgccuccaaggggaaccggggcgugcaggccuucagcaagggguccguccaggccgaccugacccugauguucgacaacuucgagguggacuucgugggcgcggccgucagcugcgacgccgccuuccucaaccugaccggcugcuacuccugcaacgcgggggcccgcgugugccugagcaucacguccaccggcaccgggacccucagcgcccacaacaaggacggcucccugcacaucgugcugcccagcgagaacggcacgaaggaccagugccagauccuccacuucaccguccccgagguggaggaggaguucauguacuccugcgacggggacgagcgcccccugcuggugaagggcacccucaucgccaucgacccguucgacgaccggcgcgaggccgggggcgagagcaccgucgugaaccccaagagcggguccuggaacuucuucgacugguucagcggccugauguccugguucggcgggccccugaagacgauccuccugaucugccuguacgucgcgcucagcaucggccuguucuuccugcucaucuaccuggggcggaccggccuguccaagauguggcucgccgccaccaagaaggccagcuga

SEQ ID NO: 12815 - RNA, 3480 nt, Artificial Sequence
  derived and/or modified CDS sequence (opt1) from RVFV(2250/74)__DQ380209.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccauccuguaccgcguccucaagugccugaagaucgcgccccggaaggugcugaacccccucauguggaucaccgccuucauccgcuggaucuacaagaagaugguggcccgggucgccgacaacaucaaccaggugaaccgcgagaucggcuggauggagggcgggcagcuggugcugggcaaccccgccccgaucccccgccacgcgcccaucccccgguacuccaccuaccucaugcugcugcucaucgucagcuacgccuccgccugcagcgagcugauccaggccuccagccgcaucaccacgugcuccaccgagggggugaacaccaagugccggcugagcggcaccgcgcugauccgcgccggguccgugggcgccgaggccugccucaugcugaagggggucaaggaggaccagacgaaguuccugaagaucaagaccgugagcuccgagcucagcugccgggagggccaguccuacuggaccggcagcuucagcccgaagugccuguccagccgccggugccaccuggugggggagugccacgucaaccgcugccucuccuggcgggacaacgagaccagcgccgaguucuccuucgugggcgagagcacgaccaugcgcgagaacaagugcuucgagcagugcgggggcugggggugcggcugcuucaacgugaaccccuccugccuguucguccacaccuaccugcagagcgugcggaaggaggcgcuccgcguguucaacugcaucgacuggguccacaagcugacccuggagaucaccgacuucgacggcuccgugagcacgaucgaccucggggccuccagcucccgguucaccaacuggggcagcgugucccugagccuggacgccgaggggaucuccggcagcaacuccuucagcuucaucgagagccccgggaagggcuacgccaucgucgacgagcccuucuccgagaucccgcgccagggcuuccucggggagauccggugcaacagcgaguccagcgugcuguccgcccacgagagcugccugcgcgcgcccaaccucaucuccuacaagcccaugaucgaccagcuggagugcaccaccaaccugaucgaccccuucguggucuucgagcggggcagccucccgcagacgcgcaacgacaagaccuucgccgccuccaaggggaaccggggcgugcaggccuucagcaagggguccgugcaggccgaccugacccugauguucgacaacuucgaggucgacuucgugggcgcggccgugagcugcgacgccgccuuccucaaccugaccggcugcuacuccugcaacgcgggggccaaggucugccugagcaucacguccaccggcaccgggagccucuccgcccacaacaaggacggcagccugcacaucgugcugcccuccgagaacggcaccaaggaccagugccagauccuccacuucacggugcccgaggucgaggaggaguucauguacagcugcgacggggacgagcgcccccugcuggugaagggcacccucaucgccaucgacccguucgacgaccgccgggaggccgggggcgagagcaccguggucaaccccaaguccgggagcuggaacuucuucgacugguucuccggccugaugagcugguucggcgggccccugaagaccauccuccugaucugccuguacguggcgcucuccaucggccuguucuuccugcucaucuaccuggggcgcacgggccugagcaagauguggcucgccgccaccaagaaggccuccuga

SEQ ID NO: 12816 - RNA, 3480 nt, Artificial Sequence
  derived and/or modified CDS sequence (opt1) from RVFV(2007000094)__EU574055.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggucaacaccaagugccggcugagcggcaccgcgcugauccgcgccggguccgugggcgccgaggccugccucaugcugaagggggugaaggaggaccagacgaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgccgaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcgcuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcccacgagagcugccugcgcgcgcccaaccucaucuccuacaagcccaugaucgaccagcuggagugcaccaccaaccugaucgaccccuucgugguguucgagcggggcagccucccgcagacgcgcaacgacaagaccuucgccgccuccaaggggaaccggggcguccaggccuucagcaagggguccgugcaggccgaccugacccugauguucgacaacuucgagguggacuucgucggcgcggccgugagcugcgacgccgccuuccucaaccugaccggcugcuacuccugcaacgcgggggcccgcgugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcgcucagcaucggccuguucuuccugcucaucuaccuggggcggaccggccuguccaagauguggcucgccgccaccaagaaggccagcuga

SEQ ID NO: 12817 - RNA, 3480 nt, Artificial Sequence
  derived and/or modified CDS sequence (opt1) from RVFV(ZM-657)__DQ380204.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaaggccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccauccuguaccgcguccucaagugccugaagaucgcgccccggaaggugcugaacccccucauguggaucaccgccuucauccgcuggaucuacaagaagaugguggcccgggucgccgacaacaucaaccaggugaaccgcgagaucggcuggauggagggcgggcagcuggugcugggcaaccccgccccgaucccccgccacgcgcccaucccccgguacuccaccuaccucaugcugcugcucaucgucagcuacgccuccgccugcagcgagcugauccaggccuccagccgcaucaccacgugcuccaccgagggggugaacaccaagugccggcugagcggcaccgcgcugauccgcgccggguccgugggcgccgaggccugccucaugcugaagggggucaaggaggaccagacgaaguuccugaagaucaagaccgugagcuccgagcucagcugccgggagggccaguccuacuggaccggcagcuucagcccgaagugccuguccagccgccggugccaccuggugggggagugccacgucaaccgcugccucuccuggcgggacaacgagaccagcgccgaguucuccuucgugggcgagagcacgaccaugcgcgagaacaagugcuucgagcagugcgggggcugggggugcggcugcuucaacgugaaccccuccugccuguucguccacaccuaccugcagagcgugcggaaggaggcgcuccgcguguucaacugcaucgacuggguccacaagcugacccuggagaucaccgacuucgacggcuccgugagcacgaucgaccucggggccuccagcucccgguucaccaacuggggcagcgugucccugagccuggacgccgaggggaucuccggcagcaacuccuucagcuucaucgagagccccgggaagggcuacgccaucgucgacgagcccuucuccgagaucccgcgccagggcuuccucggggagauccggugcaacagcgaguccagcgugcuguccgcccacgagagcugccugcgcgcgcccaaccucaucuccuacaagcccaugaucgaccagcuggagugcaccaccaaccugaucgaccccuucguggucuucgagcggggcagccucccgcagacgcgcaacgacaagaccuucgccgccuccaaggggaaccggggcgugcaggccuucagcaagggguccgugcaggccgaccugacccugauguucgacaacuucgaggucgacuucgugggcgcggccgugagcugcgacgccgccuuccucaaccugaccggcugcuacuccugcaacgcgggggcccgcgucugccugagcaucacguccaccggcaccgggagccucuccgcccacaacaaggacggcagccugcacaucgugcugcccuccgagaacggcaccaaggaccagugccagauccuccacuucacggugcccgaggucgaggaggaguucauguacagcugcgacggggacgagcgcccccugcuggugaagggcacccucaucgccaucgacccguucgacgaccggcgcgaggccgggggcgagagcaccguggucaaccccaaguccgggagcuggaacuucuucgacugguucuccggccugaugagcugguucggcgggccccugaagaccauccuccugaucugccuguacguggcgcucuccaucggccuguucuuccugcucaucuaccuggggcggacgggccugagcaagauguggcucgccgccaccaagaaggccuccuga

SEQ ID NO: 12818 - RNA, 3480 nt, Artificial Sequence
  derived and/or modified CDS sequence (opt1) from RVFV(ZH-548M12)__M25276.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcaagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcuccuggagaaggggaaguucccgcuguuccaguccuacgcccaccaccggacccuccuggaggccgugcacgacaccaucaucgccaaggccgacccgcccagcugcgaccugcucuccgcccacggcaaccccugcaugaaggagaagcuggucaugaagacccacugccccaacgacuaccagagcgcgcaccaccugaacaacgacggcaagauggccuccgugaagugcccgcccaaguacgagcucacggaggacugcaacuucugccgccagaugaccggggccagccugaagaagggcuccuacccccugcaggaccucuucugccagagcuccgaggacgacgggagcaagcugaagaccaagaugaagggcgugugcgaggucggcgugcaggcccugaagaagugcgacgggcagcucuccaccgcccacgaggugguccccuucgcgguguucaagaacagcaagaagguguaccuggacaagcuggaccucaagacggaggagaaccugcugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccucguggugcggagcaccggcuucaagaucuccagcgcggucgccugcgccuccggggugugcgugaccggcagccagucccccagcaccgagaucacccugaaguacccggggaucucccagagcuccggcggggacaucggcguccacauggcccacgacgaccagagcgugagcuccaagaucguggcccacugcccgccccaggaccccugccugguccacgacugcaucgugugcgcgcacggccucaucaacuaccagugccacacggcccugagcgccuucguggucguguucguguucuccagcaucgccaucaucugccuggccauccucuaccgcguccugaagugccugaagaucgcgccccggaaggugcucaacccccugauguggaucaccgccuucauccgcuggaucuacaagaagaugguggcccgggucgccgacaacaucaaccaggugaaccgcgagaucggguggauggagggcgggcagcuggugcucggcaaccccgccccgaucccccgccacgcgcccaucccccgguacuccaccuaccugaugcugcuccugaucgucagcuacgccuccgccugcagcgagcugauccaggccuccagccgcaucaccacgugcuccaccgagggcgugaacaccaagugccggcugagcgggaccgcgcucauccgcgccggcuccgugggggccgaggccugccugaugcugaagggcgucaaggaggaccagacgaaguuccucaagcugaagaccgugagcuccgagcugagcugccgggaggggcaguccuacuggaccggcagcuucagcccgaagugccucuccagccgccggugccaccuggugggcgagugccacgucaaccgcugccuguccuggcgggacaacgagaccagcgccgaguucuccuucgugggggagagcacgaccaugcgcgagaacaagugcuucgagcagugcggcggguggggcugcgggugcuucaacgugaaccccuccugccucuucguccacaccuaccugcagagcgugcggaaggaggcgcugcgcguguucaacugcaucgacuggguccacaagcucacccuggagaucaccgacuucgacggcuccgugagcacgaucgaccugggcgccuccagcucccgguucaccaacugggggagcgugucccucagccuggacgccgagggcaucuccgggagcaacuccuucagcuucaucgagagccccggcaagggguacgccaucgucgacgagcccuucuccgagaucccgcgccagggcuuccugggcgagauccggugcaacagcgaguccagcgugcucuccgcccacgagagcugccugcgcgcgcccaaccugaucuccuacaagcccaugaucgaccagcucgagugcaccaccaaccugaucgaccccuucguggucuucgagcgggggagccugccgcagacgcgcaacgacaagaccuucgccgccuccaagggcaaccgcggggugcaggccuucagcaagggcuccgugcaggccgaccucacccugauguucgacaacuucgaggucgacuucgugggggcggccgugagcugcgacgccgccuuccugaaccucaccggcugcuacuccugcaacgcgggcgcccgggucugccugagcaucacguccaccgggaccggcagccuguccgcccacaacaaggacgggagccuccacaucgugcugcccuccgagaacggcaccaaggaccagugccagauccugcacuucacggugcccgaggucgaggaggaguucauguacagcugcgacggcgacgagcgcccccuccuggugaaggggacccugaucgccaucgacccguucgacgaccggcgcgaggccggcggggagagcaccguggucaaccccaaguccggcagcuggaacuucuucgacugguucuccgggcucaugagcugguucggcggcccccugaagaccauccugcucaucugccuguacguggcgcuguccaucgggcuguucuuccugcugaucuaccucggcgggacgggccugagcaagauguggcuggccgccaccaagaaggccuccuga

SEQ ID NO: 12819 - RNA, 3480 nt, Artificial Sequence
  derived and/or modified CDS sequence (opt1) from RVFV(ZH-501-777)__DQ380202.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggaccccggccagaccaagcgggagcugaaguccuucgacaucagccagugccccaagaucgggggccacggcuccaagaagugcaccggggacgccgccuucugcagcgccuacgagugcacggcccaguacgcgaacgccuacugcucccacgccaacggcagcgggaucgugcagauccagguguccggcgucuggaagaagccgcucugcgugggguacgagcgcguggucgugaagcgggagcugagcgccaagcccauccagcgcgucgagcccugcacgaccugcaucaccaagugcgagccccacggccugguggugcgguccaccggcuucaagaucagcuccgcggucgccugcgccagcggggugugcgugaccggcucccagagcccguccaccgagaucacccucaaguaccccgggaucagccaguccagcggcggggacaucggcguccacauggcccacgacgaccaguccgugagcagcaagaucguggcccacugcccgccccaggaccccugccugguccacggcugcaucgugugcgcgcacgggcugaucaacuaccagugccacacggcccucuccgccuucguggucguguucguguucagcuccaucgccaucaucugccuggccguccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccugggcaacccggcccccaucccccgccacgcgcccaucccgcgguacagcaccuaccucaugcugcugcucaucguguccuacgccagcgccugcuccgagcugauccaggccagcucccgcaucaccacgugcagcaccgagggggugaacaccaagugccggcuguccggcaccgcgcugauccgcgccgggagcgucggcgccgaggccugccucaugcugaagggggugaaggaggaccagacgaaguuccugaagaucaagaccguguccagcgagcucuccugccgggagggccagagcuacuggaccggcuccuucagccccaagugccugagcucccgccggugccaccuggucggggagugccacgugaaccgcugccucagcuggcgggacaacgagaccuccgccgaguucagcuucgugggcgaguccacgaccaugcgcgagaacaagugcuucgagcagugcgggggcugggggugcggcugcuucaacgucaaccccagcugccuguucgugcacaccuaccugcaguccgugcggaaggaggcgcuccgcgucuucaacugcaucgacugggugcacaagcugacccuggagaucaccgacuucgacggcagcguguccacgaucgaccucggggccagcuccagccgguucaccaacuggggcuccgucagccugucccuggacgccgaggggaucagcggcuccaacagcuucuccuucaucgagagccccgggaagggcuacgccaucguggacgagccguucagcgagaucccccgccagggcuuccucggggagauccggugcaacuccgagagcuccgugcugagcgcccacgaguccugccugcgcgcgcccaaccucaucagcuacaagcccaugaucgaccagcuggagugcaccaccaaccugaucgacccguucgucguguucgagcggggcucccucccccagacgcgcaacgacaagaccuucgccgccagcaaggggaaccggggcgugcaggccuucuccaaggggagcguccaggccgaccugacccugauguucgacaacuucgagguggacuucgugggcgcggccgucuccugcgacgccgccuuccucaaccugaccggcugcuacagcugcaacgcgggggcccgcgugugccuguccaucacgagcaccggcaccgggucccucagcgcccacaacaaggacggcucccugcacaucgugcugcccagcgagaacggcaccaaggaccagugccagauccuccacuucacgguccccgagguggaggaggaguucauguacuccugcgacggggacgagcgcccgcugcuggugaagggcacccucaucgccaucgaccccuucgacgaccggcgcgaggccgggggcgagagcaccgucgugaaccccaagagcggguccuggaacuucuucgacugguucagcggccugauguccugguucggcgggccccugaagaccauccuccugaucugccuguacgucgcgcucagcaucggccuguucuuccugcucaucuaccuggggcggacgggccuguccaagauguggcucgccgccaccaagaaggccagcuga

SEQ ID NO: 12820 - RNA, 3480 nt, Artificial Sequence
  derived and/or modified CDS sequence (opt1) from RVFV(T-46 (228113))__DQ380199.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccaaggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccguccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggugaacaccaagugccggcugagcggcaccgcgcugauccgcgccggguccgucggcgccgaggccugccucaugcugaagggggugaaggaggaccagacgaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagaccagcgccgaguucuccuucgugggcgagagcacgaccaugcgcgagaacaagugcuucgagcagugcgggggcugggggugcggcugcuucaacgucaaccccuccugccuguucgugcacaccuaccugcagagcgugcggaaggaggcgcuccgcgucuucaacugcaucgacugggugcacaagcugacccuggagaucaccgacuucgacggcuccgugagcacgaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcccacgagagcugccugcgcgcgcccaaccucaucuccuacaagcccaugaucgaccagcuggagugcaccaccaaccugaucgaccccuucgucguguucgagcggggcagccucccgcagacgcgcaacgacaagaccuucgccgccuccaaggggaaccggggcgugcaggccuucagcaagggguccguccaggccgaccugacccugauguucgacaacuucgagguggacuucgugggcgcggccgucagcugcgacgccgccuuccucaaccugaccggcugcuacuccugcaacgcgggggcccgcgugugccugagcaucacguccaccggcaccgggagccucuccgcccacaacaaggacggcagccugcacaucgugcugcccuccgagaacggcaccaaggaccagugccagauccuccacuucacgguccccgagguggaggaggaguucauguacagcugcgacggggacgagcgcccccugcuggugaagggcacccucaucgccaucgacccguucgacgaccggcgcgaggccgggggcgagagcaccgucgugaaccccaaguccgggagcuggaacuucuucgacugguucuccggccugaugagcugguucggcgggccccugaagaccauccuccugaucugccuguacgucgcgcucuccaucggccuguucuuccugcucaucuaccuggggcggacgggccugagcaagauguggcucgccgccaccaagaaggccuccuga

SEQ ID NO: 12821 - RNA, 3480 nt, Artificial Sequence
  derived and/or modified CDS sequence (opt1) from RVFV(OS-3)__DQ380184.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggguggugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcguggccaucaucugccuggccauccuguacaaggugcucaagugccugaagaucgcgccccgcaagguccugaacccccucauguggaucaccgccuucauccgguggguguacaagaagaugguggcccgcgucgccgacaacaucaaccaggugaaccgggagaucggcuggauggagggcgggcagcuggcccugggcaaccccgcgccgaucccccgccacgcccccaucccccgcuacuccaccuaccucaugcugcugcucaucgugagcuacgccuccgccugcagcgagcugauccaggcguccagccggaucaccacgugcuccaccgagggggucaacaccaagugccgccugagcggcaccgcccugauccgggccggguccgugggcgccgaggccugccucaugcugaagggggugaaggaggaccagacgaaguuccugaagaucaagaccgucagcuccgagcucagcugccgcgagggccaguccuacuggaccggcagcuucagcccgaagugccuguccagccggcgcugccaccuggugggggagugccacgugaaccggugccucuccuggcgcgacaacgagaccagcgcggaguucuccuucgucggcgagagcacgaccaugcgggagaacaagugcuucgagcagugcgggggcugggggugcggcugcuucaacgugaaccccuccugccuguucgugcacaccuaccugcagagcguccgcaaggaggcccuccggguguucaacugcaucgacugggugcacaagcugacccuggagaucaccgacuucgacggcuccgucagcacgaucgaccucggggccuccagcucccgcuucaccaacuggggcagcgugucccugagccuggacgccgaggggaucuccggcagcaacuccuucagcuucaucgagagccccgggaagggcuacgccaucguggacgagcccuucuccgagaucccgcggcagggcuuccucggggagauccgcugcaacagcgaguccagcguccuguccgcgcacgagagcugccugcgggcccccaaccucaucuccuacaagcccaugaucgaccagcuggagugcaccaccaaccugaucgaccccuucgugguguucgagcgcggcagccucccgcagacgcggaacgacaagaccuucgccgccuccaaggggaaccgcggcguccaggccuucagcaagggguccgugcaggcggaccugacccugauguucgacaacuucgagguggacuucgucggcgccgccgugagcugcgacgccgcguuccucaaccugaccggcugcuacuccugcaacgccggggcccgggugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccgccgggaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcgcaccggccuguccaagauguggcucgccgccaccaagaaggccagcuga

SEQ ID NO: 12822 - RNA, 3480 nt, Artificial Sequence
  derived and/or modified CDS sequence (opt1) from RVFV(Sudan 86-2010)__JQ820489.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggucaacaccaagugccggcugagcggcaccgcgcugauccgcgccggguccgugggcgccgaggccugccucaugcugaagggggugaaggaggaccagacgaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgccgaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcgcuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcccacgagagcugccugcgcgcgcccaaccucaucuccuacaagcccaugaucgaccagcuggagugcaccaccaaccugaucgaccccuucgugaucuucgagcggggcagccucccgcagacgcgcaacgacaagaccuucgccgccuccaaggggaaccggggcgugcaggccuucagcaagggguccguccaggccgaccugacccugauguucgacaacuucgagguggacuucgugggcgcggccgucagcugcgacgccgccuuccucaaccugaccggcugcuacuccugcaacgcgggggcccgcgugugccugagcaucacguccaccggcaccgggacccucagcgcccacaacaaggacggcucccugcacaucgugcugcccagcgagaacggcacgaaggaccagugccagauccuccacuucaccguccccgagguggaggaggaguucauguacuccugcgacggggacgagcgcccccugcuggugaagggcacccucaucgccaucgacccguucgacgaccggcgcgaggccgggggcgagagcaccgucgugaaccccaagagcggguccuggaacuucuucgacugguucagcggccugauguccugguucggcgggccccugaagacgauccuccugaucugccuguacgucgcgcucagcaucggccuguucuuccugcucaucuaccuggggcggaccggccuguccaagauguggcucgccgccaccaagaaggccagcuga

SEQ ID NO: 12823 - RNA, 3480 nt, Artificial Sequence
  derived and/or modified CDS sequence (opt1) from RVFV(Sudan 28-2010)__JQ820491.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggucaacaccaagugccggcugagcggcaccgcgcugauccgcgccggguccgugggcgccgaggccugccucaugcugaagggggugaaggaggaccagacgaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgccgaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcgcuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcccacgagagcugccugcgcgcgcccaaccucaucuccuacaagcccaugaucgaccagcuggagugcaccaccaaccugaucgaccccuucgugguguucgagcggggcagccucccgcagacgcgcaacgacaagaccuucgccgccuccaaggggaaccggggcguccaggccuucagcaagggguccgugcaggccgaccugacccugauguucgacaacuucgagguggacuucgucggcgcggccgugagcugcgacgccgccuuccucaaccugaccggcugcuacuccugcaacgcgggggcccgcgugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggugcucagcaucggccuguucuuccugcucaucuaccuggggcggaccggccuguccaagauguggcucgcggccaccaagaaggccagcuga

SEQ ID NO: 12824 - RNA, 3480 nt, Artificial Sequence
  derived and/or modified CDS sequence (opt1) from RVFV(2007004194)__EU574031.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccuguccaacgacggcaagauggccagcgugaagugcccgcccaaguacgagcugacggaggacugcaacuucugccgccagaugaccggggccucccucaagaagggcagcuacccccugcaggaccuguucugccaguccagcgaggacgacggguccaagcucaagaccaagaugaagggcgucugcgaggugggcgugcaggcccugaagaagugcgacgggcagcugagcaccgcccacgaggucgugcccuucgcgguguucaagaacagcaagaaggucuaccucgacaagcuggaccugaagacggaggagaaccuccugcccgacuccuucgugugcuucgagcacaagggccaguacaaggggaccauggacagcggccagaccaagcgggagcugaaguccuucgacaucagccagugccccaagaucgggggccacggcuccaagaagugcaccggggacgccgccuucugcagcgccuacgagugcacggcccaguacgcgaacgccuacugcucccacgccaacggcagcgggaucgugcagauccaggucuccggcguguggaagaagccccucugcgugggguacgagcgcgucguggucaagcgggagcugagcgccaagccgauccagcgcguggagcccugcacgaccugcaucaccaagugcgagccccacggccuggugguccgguccaccggcuucaagaucagcuccgcgguggccugcgccagcggggugugcgucaccggcucccagagccccuccaccgagaucacccucaaguacccggggaucagccaguccagcggcggggacaucggcgugcacauggcccacgacgaccagagcguguccagcaagaucgucgcccacugcccgccccaggaccccugccuggugcacggcugcaucgugugcgcgcacgggcugaucaacuaccagugccacacggcccucuccgccuucgucgugguguucgucuucagcuccaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacagcaccuaccucaugcugcugcucaucguguccuacgccagcgccugcuccgagcugauccaggccagcucccgcaucaccacgugcagcaccgagggggucaacaccaagugccggcuguccggcaccgcgcugauccgcgccgggagcgugggcgccgaggccugccucaugcugaagggggugaaggaggaccagacgaaguuccugaagaucaagaccgucuccagcgagcucuccugccgggagggccagagcuacuggaccggcagcuucuccccgaagugccugagcucccgccggugccaccuggugggggagugccacgugaaccgcugccucagcuggcgggacaacgagaccuccgccgaguucagcuucgucggcgaguccacgaccaugcgcgagaacaagugcuucgagcagugcgggggcugggggugcggcugcuucaacgugaaccccagcugccuguucgugcacaccuaccugcaguccguccggaaggaggcgcuccgcguguucaacugcaucgacugggugcacaagcugacccuggagaucaccgacuucgacggcagcgucuccacgaucgaccucggggccagcuccagccgguucaccaacuggggcuccgugagccugucccuggacgccgaggggaucagcggcuccaacagcuucagcuucaucgagucccccgggaagggcuacgccaucguggacgagcccuucagcgagaucccgcgccagggcuuccucggggagauccggugcaacuccgagagcuccguccugagcgcccacgaguccugccugcgcgcgcccaaccucaucagcuacaagcccaugaucgaccagcuggagugcaccaccaaccugaucgaccccuucgugguguucgagcggggcucccucccgcagacgcgcaacgacaagaccuucgccgccagcaaggggaaccggggcguccaggccuucuccaaggggagcgugcaggccgaccugacccugauguucgacaacuucgagguggacuucgucggcgcggccguguccugcgacgccgccuuccucaaccugaccggcugcuacagcugcaacgcgggggcccgcgugugccuguccaucacgagcaccggcaccgggacccucuccgcccacaacaaggacggcagccugcacaucguccugcccuccgagaacggcacgaaggaccagugccagauccuccacuucaccgugcccgagguggaggaggaguucauguacagcugcgacggggacgagcgcccccugcuggucaagggcacccucaucgccaucgacccguucgacgaccggcgcgaggccgggggcgagagcaccguggucaaccccaaguccgggagcuggaacuucuucgacugguucuccggccugaugagcugguucggcgggccccugaagacgauccuccugaucugccuguacguggcgcucuccaucggccuguucuuccugcucaucuaccuggggcggaccggccugagcaagauguggcucgccgccaccaagaaggccuccuga

SEQ ID NO: 12825 - RNA, 3480 nt, Artificial Sequence
  derived and/or modified CDS sequence (opt1) from RVFV(73HB1230)__DQ380221.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcaggucggccgcgagacgauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcuccuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagaaggagcugaaguccuucgacaucucccagugccccaagaucgggggccacggcagcaagaagugcaccggggacgccgccuucugcuccgccuacgagugcaccgcccaguacgccaacgccuacugcagccacgccaacggcagcgggaucgugcagauccaggugagcggcguguggaagaagccccugugcgugggguacgagcgggucguggucaagcgcgagcuguccgccaagccgauccagcggguggagcccugcacgaccugcaucaccaagugcgagccccacggccuggugguccgcagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgggugcucaagugccugaagaucgcgccccgcaaggugcugaacccccucauguggaucaccgccuucauccggugggucuacaagaagaugguggcccgcguggccgacaacaucaaccaggucaaccgggagaucggcuggauggagggcgggcagcuggugcugggcaaccccgccccgaucccccgccacgcgcccaucccccgcuacuccaccuaccucaugcugcugcucaucgugagcuacgccuccgccugcagcgagcugauccaggccuccagccggaucaccacgugcuccaccgagggggucaacaccaagugccgccugagcggcaccgcgcugauccgggccggguccgugggcgccgaggccugccucaugcugaagggggugaaggaggaccagacgaaguuccugaagaucaagaccgucagcuccgagcucagcugccgcgagggccaguccuacuggaccggcagcuucagcccgaagugccuguccagccggcgcugccaccuggugggggagugccacgugaaccggugccucuccuggcgcgacaacgagaccagcgccgaguucuccuucgucggcgagagcacgaucaugcgggagaacaagugcuucgagcagugcgggggcugggggugcggcugcuucaacgugaaccccuccugccuguucgugcacaccuaccugcagagcguccgcaaggaggcgcuccggguguucaacugcaucgacugggugcacaagcugacccuggagaucaccgacuucgacggcuccgucagcaccaucgaccucggggccuccagcucccgcuucacgaacuggggcagcgugucccugagccuggacgccgaggggaucuccggcagcaacuccuucagcuucaucgagagccccgggaagggcuacgccaucguggacgagcccuucuccgagaucccgcggcagggcuuccucggggagauccgcugcaacagcgaguccagcguccuguccgcccacgagagcugccugcgggcgcccaaccucaucuccuacaagcccaugaucgaccagcuggagugcaccaccaaccugaucgaccccuucgugguguucgagcgcggcagccucccgcagacccggaacgacaagacguucgccgccuccaaggggaaccgcggcguccaggccuucagcaagggguccgugcaggccgaccugacccugauguucgacaacuucgagguggacuucgucggcgcggccgugagcugcgacgccgccuuccucaaccugaccggcugcuacuccugcaacgcgggggcccgggugugccugagcaucaccuccacgggcaccgggacccucagcgcccacaacaaggacggcucccugcacaucguccugcccagcgagaacggcaccaaggaccagugccagauccuccacuucacggugcccgagguggaggaggaguucauguacuccugcgacggggacgagcgcccccugcuggucaagggcacccucaucgccaucgacccguucgacgaccgccgggaggccgggggcgagagcaccguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcgcacgggccuguccaagauguggcucgccgccaccaagaaggccagcuga

SEQ ID NO: 12826 - RNA, 3480 nt, Artificial Sequence
  derived and/or modified CDS sequence (opt1) from RVFV(1260/78)__DQ380214.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccauccugcaccgcguccucaagugccugaagaucgcgccccggaaggugcugaacccccucauguggaucaccgccuucauccgcuggguguacaagaagauggucgcccggguggccgacaacaucaaccaggugaaccgcgagaucggcuggauggagggcgggcagcugguccugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggugaacaccaagugccggcugagcggcaccgcgcugauccgcgccggguccgucggcgccgaggccugccucaugcugaagggggugaaggacgaccagacgaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagaccagcgccgaguucuccuucgugggcgagagcacgaccaugcgcgagaacaagugcuucgagcagugcgggggcugggggugcggcugcuucaacgucaaccccuccugccuguucgugcacaccuaccugcagagcgugcggaaggaggcgcuccgcgucuucaacugcaucgacugggugcacaagcugacccuggagaucaccgacuucgacggcuccgugagcacgaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcccacgagagcugccugcgcgcgcccaaccucaucuccuacaagcccaugaucgaccagcuggagugcaccaccaaccugaucgaccccuucgucguguucgagcggggcagccucccgcagacgcgcaacgacaagaccuucgccgccuccaaggggaaccggggcgugcaggccuucagcaagggguccguccaggccgaccugacccugauguucgacaacuucgagguggacuucgugggcgcggccgucagcugcgacgccgccuuccucaaccugaccggcugcuacuccugcaacgcgggggcccgcgugugccugagcaucacguccaccggcaccgggacccucagcgcccacaacaaggacggcucccugcacaucgugcugcccagcgagaacggcacgaaggaccagugccagauccuccacuucaccguccccgagguggaggaggaguucauguacuccugcgacggggacgagcgcccccugcuggugaagggcacccucaucgccaucgacccguucgacgaccggcgcgaggccgggggcgagagcaccgucgugaaccccaagagcggguccuggaacuucuucgacugguucagcggccugauguccugguucggcgggccccugaagacgauccuccugaucugccuguacgucgcgcucagcaucggccuguucuuccugcucaucuaccuggggcggaccggccuguccaagauguggcucgccgccaccaagaaggccagcuga

SEQ ID NO: 12827 - RNA, 3480 nt, Artificial Sequence
  derived and/or modified CDS sequence (opt1) from RVFV(ZC-3349)__DQ380207.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccaggccgugagcagcaagaucguggcgcacugcccgccccaggaccccugccugguccacggcugcaucgugugcgcccacgggcugaucaacuaccagugccacacggcccucuccgccuucguggucguguucguguucagcuccaucgccaucaucugccuggcgauccuguaccgcguccucaagugccugaagaucgcgccccggaaggugcugaacccccucauguggaucaccgccuucauccgcuggaucuacaagaagaugguggcccgggucgccgacaacaucaaccacgugaaccgcgagaucggcuggauggagggcgggcagcuggugcugggcaaccccgccccgaucccccgccacgcccccaucccccgguacagcaccuaccucaugcugcugcucaucgucuccuacgccagcgccugcuccgagcugauccaggcgagcucccgcaucaccacgugcagcaccgagggggugaacaccaagugccggcuguccggcaccgcccugauccgcgccgggagcgugggcgccgaggccugccucaugcugaagggggucaaggaggaccagacgaaguuccugaagaucaagaccguguccagcgagcucuccugccgggagggccagagcuacuggaccggcuccuucagcccgaagugccugagcucccgccggugccaccuggugggggagugccacgucaaccgcugccucagcuggcgggacaacgagaccuccgcggaguucagcuucgugggcgaguccacgaccaugcgcgagaacaagugcuucgagcagugcgggggcugggggugcggcugcuucaacgugaaccccagcugccuguucguccacaccuaccugcaguccgugcggaaggaggcccuccgcguguucaacugcaucgacuggguccacaagcugacccuggagaucaccgacuucgacggcagcguguccacgaucgaccucggggccagcuccagccgguucaccaacuggggcuccgugagccugucccuggacgccgaggggaucagcggcuccaacagcuucuccuucaucgagagccccgggaagggcuacgccaucgucgacgagcccuucagcgagaucccgcgccagggcuuccucggggagauccggugcaacuccgagagcuccgugcugagcgcgcacgaguccugccugaaggcccccaaccucaucagcuacaagcccaugaucgaccagcuggagugcaccaccaaccugaucgaccccuucguggucuucgagcgcggcucccucccgcagacgcggaacgacaagaccuucgccgccagcaaggggaaccgcggcgugcaggccuucuccaaggggagcgugcaggcggaccugacccugauguucgacaacuucgaggucgacuucgugggcgccgccguguccugcgacgccgcguuccucaaccugaccggcugcuacagcugcaacgccggggcccgggucugccuguccaucacgagcaccggcaccgggucccucagcgcccacaacaaggacggcucccugcacaucgugcugcccagcgagaacggcaccaaggaccagugccagauccuccacuucacggugcccgaggucgaggaggaguucauguacuccugcgacggggacgagcgcccccugcuggugaagggcacccucaucgccaucgacccguucgacgaccgccgggaggccgggggcgagagcaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcgcacgggccuguccaagauguggcucgccgccaccaagaaggccagcuga

SEQ ID NO: 12828 - RNA, 3480 nt, Artificial Sequence
  derived and/or modified CDS sequence (opt1) from RVFV(Sudan 85-2010)__JQ820488.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggucaacaccaagugccggcugagcggcaccgcgcugauccgcgccggguccgugggcgccgaggccugccucaugcugaagggggugaaggaggaccagacgaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgccgaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcgcuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcccacgagagcugccugcgcgcgcccaaccucaucuccuacaagcccaugaucgaccagcuggagugcaccaccaaccugaucgaccccuucgugguguucgagcggggcagccucccgcagacgcgcaacgagaagaccuucgccgccuccaaggggaaccggggcguccaggccuucagcaagggguccgugcaggccgaccugacccugauguucgacaacuucgagguggacuucgucggcgcggccgugagcugcgacgccgccuuccucaaccugaccggcugcuacuccugcaacgcgggggcccgcgugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcgcucagcaucggccuguucuuccugcucaucuaccuggggcggaccggccuguccaagauguggcucgccgccaccaagaaggccagcuga

SEQ ID NO: 12829 - RNA, 3480 nt, Artificial Sequence
  derived and/or modified CDS sequence (opt1) from RVFV(2007000324)__JF326195.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacuccaccuaccucaugcugcugcucaucgugagcuacgccuccgccugcagcgagcugauccaggcguccagccgcaucacgaccugcuccaccgagggggugaacaccaagugccggcugagcggcacggcccugauccgcgccggguccgucggcgccgaggccugccucaugcugaagggggugaaggaggaccagaccaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagacgagcgcggaguucuccuucgugggcgagagcaccaccaugcgcgagaacaagugcuucgagcagugcgggggcugggggugcggcugcuucaacgucaaccccuccugccuguucgugcacaccuaccugcagagcgugcggaaggaggcccuccgcgucuucaacugcaucgacugggugcacaagcugacccuggagaucacggacuucgacggcuccgugagcaccaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcgcacgagagcugccugcgcgcccccaaccucgucuccuacaagcccaugaucgaccagcuggagugcaccacgaaccugaucgaccccuucgugguguucgagcggggcagccucccgcagacccgcaacgacaagaccuucgccgccuccaaggggaaccggggcguccaggccuucagcaagggguccgugcaggcggaccugacccugauguucgacaacuucgagguggacuucgucggcgccgccgugagcugcgacgccgcguuccucaaccugacgggcugcuacuccugcaacgccggggcccgcgugugccugagcaucaccuccaccggcaccgggacgcucagcgcccacaacaaggacggcucccugcacaucguccugcccagcgagaacggcaccaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcacgguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgccgccaccaagaaggccagcuga

SEQ ID NO: 12830 - RNA, 3480 nt, Artificial Sequence
  derived and/or modified CDS sequence (opt1) from RVFV(OS-8)__DQ380185.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggguggugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcguggccaucaucugccuggccauccuguacaaggugcucaagugccugaagaucgcgccccgcaagguccugaacccccucauguggaucaccgccuucauccgguggguguacaagaagaugguggcccgcgucgccgacaacaucaaccaggugaaccgggagaucggcuggauggagggcgggcagcuggcccugggcaaccccgcgccgaucccccgccacgcccccaucccccgcuacuccaccuaccucaugcugcugcucaucgugagcuacgccuccgccugcagcgagcugauccaggcguccagccggaucaccacgugcuccaccgagggggucaacaccaagugccgccugagcggcaccgcccugauccgggccggguccgugggcgccgaggccugccucaugcugaagggggugaaggaggaccagacgaaguuccugcgcaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgcggaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcccuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcgcacgagagcugccugcgcgcccccaaccucaucuccuacaagcccaugaucgaccagcuggagugcaccaccaaccugaucgaccccuucgugguguucgagcggggcagccucccgcagacgcgcaacgacaagaccuucgccgccuccaaggggaaccggggcguccaggccuucagcaagggguccgugcaggcggaccugacccugauguucgacaacuucgagguggacuucgucggcgccgccgugagcugcgacgccgcguuccucaaccuguccggcugcuacagcugcaacgccggggcccgcgugugccuguccaucaccagcacgggcaccgggacccucuccgcccacaacaaggacggcagccugcacaucguccugcccuccgagaacggcaccaaggaccagugccagauccuccacuucacggugcccgagguggaggaggaguucauguacagcugcgacggggacgagcgcccccugcuggucaagggcacccucaucgccaucgacccguucgacgaccggcgcgaggccgggggcgagagcaccguggucaaccccaaguccgggagcuggaacuucuucgacugguucuccggccugaugagcugguucggcgggccccugaagaccauccuccugaucugccuguacguggcccucuccaucggccuguucuuccugcucaucuaccuggggcggacgggccugagcaagauguggcucgccgccaccaagaaggccuccuga

SEQ ID NO: 12831 - RNA, 3480 nt, Artificial Sequence
  derived and/or modified CDS sequence (opt1) from RVFV(ZINGA J83 R1)__KU978776.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccucaugaccggggccagccugaagaagggcuccuacccccugcaggaccucuucugccagagcuccgaggacgacgggagcaagcugaagaccaagaugaagggcgugugcgaggucggcgugcaggcccugaagaagugcgacgggcagcucuccaccgcccacgaggugguccccuucgcgguguucaagaacagcaagaagguguaccuggacaagcuggaccucaagacggaggagaaccugcugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccucguggugcggagcaccggcuucaagaucuccagcgcggucgccugcgccuccggggugugcgugaccggcagccagucccccagcaccgagaucacccugaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcucaucaacuaccagugccacacggcccugagcgccuucguggucguguucguguucuccagcaucgccaucaucugccuggccauccucuaccgcguccugaagugccugaagaucgcgccccggaaggugcucaacccccugauguggaucaccgccuucauccgcuggguguaccggaagauggucgcccgcguggccgacaacaucaaccaggugaaccgcgagaucggcuggauggagggcgggcagcugguccucggcaaccccgccccgaucccccggcacgugcccaucccccgcuacuccaccuaccugaugcugcuccugaucgugagcuacgcguccgccugcagcgagcugauccaggccuccagccggaucaccacgugcuccaccgagggggucaacaccaagugccgccugagcggcaccgcccucauccgggcgggguccgugggcgccgaggccugccugaugcugaagggggugaaggaggaccagacgaaguuccucaagaucaagaccgucagcuccgagcugagcugccgcgagggccaguccuacuggaccggcagcuucagcccgaagugccuguccagccggcgcugccaccucgugggggagugccacgugaaccggugccuguccuggcgcgacaacgagaccagcgccgaguucuccuucgucggcgagagcacgaccaugcgggagaacaagugcuucgagcagugcgggggcugggggugcggcugcuucaacgugaaccccuccugccuguucgugcacaccuaccuccagagcguccgcaaggaggcccugcggguguucaacugcaucgacugggugcacaagcugacccucgagaucaccgacuucgacggcuccgucagcacgaucgaccugggggcguccagcucccgcuucaccaacuggggcagcgugucccugagccucgacgccgaggggaucuccggcagcaacuccuucagcuucaucgagagccccgggaagggcuacgccaucguggacgagcccuucuccgagaucccgcggcagggcuuccugggggagauccgcugcaacagcgaguccagcguccuguccgcccacgagagcugccuccgggcccccaaccugaucuccuacaagcccaugaucgaccagcuggagugcaccaccaaccucaucgaccccuucgugguguucgagcgcggcagccugccgcagacgcggaacgacaagaccuucgcggccuccaaggggaaccgcggcguccaggccuucagcaagggguccgugcaggccgaccugacccucauguucgacaacuucgagguggacuucgucggcgccgcggugagcugcgacgccgccuuccugaaccugaccggcugcuacuccugcaacgccggggcgcgcgugugccucagcaucacguccaccggcaccgggacccugagcgcccacaacaaggacggcucccugcacaucguccuccccagcgagaacggcacgaaggaccagugccagauccugcacuucaccgugcccgagguggaggaggaguucauguacuccugcgacggggacgagcggccccugcucguccgcggcacccugaucgccaucgacccguucgacgaccggcgcgaggccgggggcgagagcaccguggucaaccccaagagcggguccuggaacuucuucgacugguucagcggccugauguccugguucggcgggccccucaagacgauccugcugaucugccucuacguggcccugagcaucggccuguucuuccuccugaucuaccuggggcggaccggccucuccaagauguggcuggcggccaccaagaaggccagcuga

SEQ ID NO: 12832 - RNA, 3480 nt, Artificial Sequence
  derived and/or modified CDS sequence (opt1) from RVFV(2007000253)__JF326192.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacuccaccuaccucaugcugcugcucaucgugagcuacgccuccgccugcagcgagcugauccaggcguccagccgcaucacgaccugcuccaccgagggggugaacaccaagugccggcugagcggcacggcccugauccgcgccggguccgccggcgccgaggcgugccucaugcugaagggggucaaggaggaccagaccaaguuccugaagaucaagaccgugagcuccgagcucagcugccgggagggccaguccuacuggaccggcagcuucagcccgaagugccuguccagccgccggugccaccuggugggggagugccacgucaaccgcugccucuccuggcgggacaacgagacgagcgccgaguucuccuucgugggcgagagcaccaccaugcgcgagaacaagugcuucgagcagugcgggggcugggggugcggcugcuucaacgugaaccccuccugccuguucguccacaccuaccugcagagcgugcggaaggaggcccuccgcguguucaacugcaucgacuggguccacaagcugacccuggagaucacggacuucgacggcuccgugagcaccaucgaccucggggccuccagcucccgguucaccaacuggggcagcgugucccugagccuggacgccgaggggaucuccggcagcaacuccuucagcuucaucgagagccccgggaagggcuacgcgaucgucgacgagcccuucuccgagaucccgcgccagggcuuccucggggagauccggugcaacagcgaguccagcgugcuguccgcccacgagagcugccugcgcgcccccaaccucguguccuacaagcccaugaucgaccagcuggagugcaccacgaaccugaucgaccccuucgucguguucgagcggggcagccucccgcagacccgcaacgacaagaccuucgccgccuccaaggggaaccggggcgugcaggcguucagcaagggguccguccaggccgaccugacccugauguucgacaacuucgagguggacuucgugggcgccgccgucagcugcgacgcggccuuccucaaccugacgggcugcuacuccugcaacgccggggcccgcgugugccugagcaucaccuccaccggcaccgggacgcucagcgcccacaacaaggacggcucccugcacaucgugcugcccagcgagaacggcaccaaggaccagugccagauccuccacuucaccguccccgagguggaggaggaguucauguacuccugcgacggggacgagcgcccccugcuggugaagggcacccucaucgcgaucgacccguucgacgaccggcgcgaggccgggggcgagagcacggucgugaaccccaagagcggguccuggaacuucuucgacugguucagcggccugauguccugguucggcgggccccugaagaccauccuccugaucugccuguacgucgcccucagcaucggccuguucuuccugcucaucuaccuggggcggaccggccuguccaagauguggcucgccgccaccaagaaggcgagcuga

SEQ ID NO: 12833 - RNA, 3480 nt, Artificial Sequence
  derived and/or modified CDS sequence (opt1) from RVFV(MP12)__Z30318.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcaagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcuccuggagaaggggaaguucccgcuguuccaguccuacgcccaccaccggacccuccuggaggccgugcacgacaccaucaucgccaaggccgacccgcccagcugcgaccugcucuccgcccacggcaaccccugcaugaaggagaagcuggucaugaagacccacugccccaacgacuaccagagcgcgcaccaccugaacaacgacggcaagauggccuccgugaagugcccgcccaaguacgagcucacggaggacugcaacuucugccgccagaugaccggggccagccugaagaagggcuccuacccccugcaggaccucuucugccagagcuccgaggacgacgggagcaagcugaagaccaagaugaagggcgugugcgaggucggcgugcaggcccugaagaagugcgacgggcagcucuccaccgcccacgaggugguccccuucgcgguguucaagaacagcaagaagguguaccuggacaagcuggaccucaagacggaggagaaccugcugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccucguggugcggagcaccggcuucaagaucuccagcgcggucgccugcgccuccggggugugcgugaccggcagccagucccccagcaccgagaucacccugaaguacccggggaucucccagagcuccggcggggacaucggcguccacauggcccacgacgaccagagcgugagcuccaagaucguggcccacugcccgccccaggaccccugccugguccacgacugcaucgugugcgcgcacggccucaucaacuaccagugccacacggcccugagcgccuucguggucguguucguguucuccagcaucgccaucaucugccuggccauccucuaccgcguccugaagugccugaagaucgcgccccggaaggugcucaacccccugauguggaucaccgccuucauccgcuggaucuacaagaagaugguggcccgggucgcccacaacaucaaccaggugaaccgcgagaucggguggauggagggcgggcagcuggugcucggcaaccccgccccgaucccccgccacgcgcccaucccccgguacuccaccuaccugaugcugcuccugaucgucagcuacgccuccgccugcagcgagcugauccaggccuccagccgcaucaccacgugcuccaccgagggcgugaacaccaagugccggcugagcgggaccgcgcucauccgcgccggcuccgugggggccgaggccugccugaugcugaagggcgucaaggaggaccagacgaaguuccucaagcugaagaccgugagcuccgagcugagcugccgggaggggcaguccuacuggaccggcagcuucagcccgaagugccucuccagccgccggugccaccuggugggcgagugccacgucaaccgcugccuguccuggcgggacaacgagaccagcgccgaguucuccuucgugggggagagcacgaccaugcgcgagaacaagugcuucgagcagugcggcggguggggcugcgggugcuucaacgugaaccccuccugccucuucguccacaccuaccugcagagcgugcggaaggaggcgcugcgcguguucaacugcaucgacuggguccacaagcucacccuggagaucaccgacuucgacggcuccgugagcacgaucgaccugggcgccuccagcucccgguucaccaacugggggagcgugucccucagccuggacgccgagggcaucuccgggagcaacuccuucagcuucaucgagagccccggcaagggguacgccaucgucgacgagcccuucuccgagaucccgcgccagggcuuccugggcgagauccggugcaacagcgaguccagcgugcucuccgcccacgagagcugccugcgcgcgcccaaccugaucuccuacaagcccaugaucgaccagcucgagugcaccaccaaccugaucgaccccuucguggucuucgagcgggggagccugccgcagacgcgcaacgacaagaccuucgccgccuccaagggcaaccgcggggugcaggccuucagcaagggcuccgugcaggccgaccucacccugauguucgacaacuucgaggucgacuucgugggggcggccgugagcugcgacgccgccuuccugaaccucaccggcugcuacuccugcaacgcgggcgcccgggucugccugagcaucacguccaccgggaccggcagccuguccgcccacaacaaggacgggagccuccacaucgugcugcccuccgagaacggcaccaaggaccagugccagauccugcacuucacggugcccgaggucgaggaggaguucauguacagcugcgacggcgacgagcgcccccuccuggugaaggggacccugaucgccaucgacccguucgacgaccggcgcgaggccggcggggagagcaccguggucaaccccaaguccggcagcuggaacuucuucgacugguucuccgggcucaugagcugguucggcggcccccugaagaccauccugcucaucugccuguacguggcgcuguccaucgggcuguucuuccugcugaucuaccucggcgggacgggccugagcaagauguggcuggccgccaccaagaaggccuccuga

SEQ ID NO: 12834 - RNA, 3480 nt, Artificial Sequence
  derived and/or modified CDS sequence (opt1) from RVFV(BIME-01)__KX609032.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcgucgccaucaucugccuggccauccuguacaaggugcuccgcugccugaagaucgcgcccaagaaggugcugaacccccucauguggaucaccgccuucauccggugggucuacaagaagaugguggcccgcguggccgacaacaucaaccaggucaaccgggagaucggcuggauggagggcgggcagcuggcccugggcaaccccgcgccgaucccccgccacgcccccaucccccgcuacuccaccuaccucaugcugcugcucaucaucagcuacgccuccgccugcagcgagcugauccaggcguccagccggaucaccacgugcuccaccgagggggugaacaccaagugccgccugagcggcaccgcccugauccgggccggguccgugggcgccgaggccugccucaugcugaagggggucaaggaggaccagacgaaguuccugaagaucaagaccgugagcuccgagcucagcugccgcgagggccaguccuacuggaccggcagcuucagcccgaagugccuguccagccggcgcugccaccuggugggggagugccacgucaaccggugccucuccuggcgcgacaacgagaccagcgcggaguucuccuucgugggcgagagcacgaccaugcgggagaacaagugcuucgagcagugcgggggcugggggugcggcugcuucaacgugaaccccuccugccuguucguccacaccuaccugcagagcgugcgcaaggaggcccuccggguguucaacugcaucgacuggguccacaagcugacccuggagaucaccgacuucgacggcuccgugagcacgaucgaccucggggccuccagcucccgcuucaccaacuggggcagcgugucccugagccuggacgccgaggggaucuccggcagcaacuccuucagcuucaucgagagccccgggaagggcuacgccaucgucgacgagcccuucuccgagaucccgcggcagggcuuccucggggagauccgcugcaacagcgaguccagcgugcuguccgcgcacgagagcugccugcgggcccccaaccucaucuccuacaagcccaugaucgaccagcuggagugcaccaccaaccugaucgaccccuucguggucuucgagcgcggcagccucccgcagacgcggaacgacaagaccuucgccgccuccaaggggaaccgcggcgugcaggccuucagcaagggguccgugcaggcggaccugacccugauguucgacaacuucgaggucgacuucgugggcgccgccgugagcugcgacgccgcguuccucaaccugaccggcugcuacuccugcaacgccggggcccgggucugccugagcaucacguccaccggcaccgggacccucagcgcccacaacaaggacggcucccugcacaucgugcugcccagcgagaacggcacgaaggaccagugccagauccuccacuucaccgugcccgaggucgaggaggaguucauguacuccugcgacggggacgagcgcccccugcuggugaagggcacccucaucgccaucgacccguucgacgaccgccgggaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcgcaccggccuguccaagauguggcucgccgccaccaagaaggccagcuga

SEQ ID NO: 12835 - RNA, 3480 nt, Artificial Sequence
  derived and/or modified CDS sequence (opt1) from RVFV(200803166)__JF311381.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcugaagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacuccaccuaccucaugcugcugcucaucgugagcuacgccaccgccugcuccgagcugauccaggccagcucccgcaucacgaccugcagcaccgagggggucaacaccaagugccggcuguccggcacggcgcugauccgcgccgggagcgugggcgccgaggccugccucaugcugaagggggugaaggaggaccagaccaaguuccugaagaucaagaccgucuccagcgagcucuccugccgggagggccagagcuacuggaccggcuccuucagcccgaagugccugagcucccgccggugccaccuggugggggagugccacgugaaccgcugccucagcuggcgggacaacgagacguccgccgaguucagcuucgucggcgaguccaccaccaugcgcgagaacaagugcuucgagcagugcgggggcugggggugcggcugcuucaacgugaaccccagcugccuguucgugcacaccuaccugcaguccguccggaaggaggcgcuccgcguguucaacugcaucgacugggugcacaagcugacccuggagaucacggacuucgacggcagcgucuccaccaucgaccucggggccagcuccagccgguucaccaacuggggcuccgugagccugucccuggacgccgaggggaucagcggcuccaacagcuucuccuucaucgagagccccgggaagggcuacgccaucguggacgagcccuucagcgagaucccgcgccagggcuuccucggggagauccggugcaacuccgagagcuccguccugagcgcccacgaguccugccugcgcgcgcccaaccucaucagcuacaagcccaugaucgaccagcuggagugcaccacgaaccugaucgaccccuucgugguguucgagcggggcucccucccgcagacccgcaacgacaagaccuucgccgccagcaaggggaaccggggcguccaggccuucuccaaggggagcgugcaggccgaccugacccugauguucgacaacuucgagguggacuucgucggcgcggccguguccugcgacgccgccuuccucaaccugacgggcugcuacagcugcaacgcgggggcccgcgugugccuguccaucaccagcaccggcaccgggacgcucuccgcccacaacaaggacggcagccugcacgucgugcugcccuccgagaacggcaccaaggaccagugccagauccuccacuucaccgugcccgaggucgaggaggaguucauguacagcugcgacggggacgagcgcccccugcuggugaagggcacccucaucgccaucgacccguucgacgaccggcgcgaggccgggggcgaguccacggucgugaaccccaagagcgggagcuggaacuucuucgacugguucuccggccugaugagcugguucggcgggccccugaagaccauccuccugaucugccuguacguggcgcucuccaucggccuguucuuccugcucaucuaccuggggcggaccggccugagcaagauguggcucgccgccaccaagaaggccuccuga

SEQ ID NO: 12836 - RNA, 3480 nt, Artificial Sequence
  derived and/or modified CDS sequence (opt1) from RVFV(Kenya 83 (21445))__DQ380198.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaagaacccggagaacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcaucgccaucaucugccuggccauccuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggcuggauggagggcgggcagcuggcccugggcaaccccgcgccgaucccccgccacgcccccaucccccgguacuccaccuaccucaugcugcugcucaucgucagcuacgccuccgccugcagcgagcugauccaggcguccagccgcaucaccacgugcuccaccgagggggugaacaccaagugccggcugagcggcaccgcccugauccgcgccggguccgugggcgccgaggccugccucaugcugaagggggucaaggaggaccagacgaaguuccugaagaucaagaccgugagcuccgagcucagcugccgggagggccaguccuacuggaccggcagcuucagcccgaagugccuguccagccgccggugccaccuggugggggagugccacgucaaccgcugccucuccuggcgggacaacgagaccagcgcggaguucuccuucgugggcgagagcacgaccaugcgcgagaacaagugcuucgagcagugcgggggcugggggugcggcugcuucaacgugaaccccuccugccuguucguccacaccuaccugcagagcgugcggaaggaggcccuccgcguguucaacugcaucgacuggguccacaagcugacccuggagaucaccgacuucgacggcuccgugagcacgaucgaccucggggccuccagcucccgguucaccaacuggggcagcgugucccugagccuggacgccgaggggaucuccggcagcaacuccuucagcuucaucgagagccccgggaagggcuacgccaucgucgacgagcccuucuccgagaucccgcgccagggcuuccucggggagauccggugcaacagcgaguccagcgugcuguccgcgcacgagagcugccugcgcgcccccaaccucaucuccuacaagcccaugaucgaccagcuggagugcaccaccaaccugaucgaccccuucguggucuucgagcggggcagccucccgcagacgcgcaacgacaagaccuucgccgccuccaaggggaaccggggcgugcaggccuucagcaagggguccgugcaggcggaccugacccugauguucgacaacuucgaggucgacuucgugggcgccgccgugagcugcgacgccgcguuccucaaccugaccggcugcuacuccugcaacgccggggcccgcgucugccugagcaucacguccaccggcaccgggacccucagcgcccacaacaaggacggcucccugcacaucgugcugcccagcgagaacggcacgaaggaccagugccagauccuccacuucaccgugcccgaggucgaggaggaguucauguacuccugcgacggggacgagcgcccccugcuggugaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcggaccggccuguccaagauguggcucgccgccaccaagaaggccagcuga

SEQ ID NO: 12837 - RNA, 3480 nt, Artificial Sequence
  derived and/or modified CDS sequence (opt1) from RVFV(Entebbe)__DQ380191.1__NSm-Gn-Gc
augaucgagggcgccugggacagccugcgcgaggaggagaugcccgaggagcucuccugcagcaucuccgggauccgggaggugaagaccagcucccaggagcugcaccgcgcccugaaggcgaucaucgccgccgacggccucaacaacaucacgugccacgggaaggacccggaggacaagaucagccugaucaagggcccgccccacaagaagcgggucgggguggugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaucaagcgggagcucaagagcuucgacaucucccagugccccaagaucgggggccacggcagcaagaagugcaccggggacgccgccuucugcuccgccuacgagugcaccgcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucacgggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacaccgcccucagcgccuucgucgugguguucgucuucuccagcguggccaucaucugccuggccauccuguacaaggugcucaagugccugaagaucgcgccccgcaagguccugaacccccucauguggaucacggccuucauccgguggguguacaagaagaugguggcccgcgucgccgacaacaucaaccaggugaaccgggagaucggcuggauggagggcgggcagcuggugcugggcaaccccgccccgaucccccgccacgcgcccaucccccgcuacuccaccuaccucaugcugcugcucaucgucagcuacgccuccgccugcagcgagcugauccaggccuccagccggaucacgaccugcuccaccgagggggugaacaccaagugccgccugagcggcaccgcgcugauccgggccggguccgugggcgccgaggccugccucaugcugaagggggucaaggaggaccagaccaaguuccugaagaucaagacggugagcuccgagcucagcugccgcgagggccaguccuacuggaccggcagcuucagcccgaagugccuguccagccggcgcugccaccuggugggggagugccacgucaaccggugccucuccuggcgcgacaacgagaccagcgccgaguucuccuucgugggcgagagcaccacgaugcgggagaacaagugcuucgagcagugcgggggcugggggugcggcugcuucaacgugaaccccuccugccuguucguccacaccuaccugcagagcgugcgcaaggaggcgcuccggguguucaacugcaucgacuggguccacaagcugacccuggagaucaccgacuucgacggcuccgugagcaccguggaccucggggccuccagcucccgcuucacgaacuggggcagcgucucccugagccuggacgccgaggggaucuccggcagcaacuccuucagcuucaucgagagccccgggaagggcuacgccaucguggacgagcccuucuccgagaucccgcggcagggcuuccucggggagauccgcugcaacagcgaguccagcgugcuguccgcccacgagagcugccugcgggcgcccaaccucaucuccuacaagcccaugaucgaccagcuggagugcaccaccaaccugaucgaccccuucgucguguucgagcgcggcagccucccgcagacccggaacgacaagacguucgccgccuccaaggggaaccgcggcgugcaggccuucagcaagggguccguccaggccgaccugacccugauguucgacaacuucgagguggacuucgugggcgcggccgucagcugcgacgccgccuuccucaaccugaccggcugcuacuccugcaacgcgggggcccgggugugccugagcaucaccuccacgggcaccgggacccucagcgcccacaacaaggacggcucccugcacaucgugcugcccagcgagaacggcaccaaggaccagugccagauccuccacuucacgguccccgagguggaggaggaguucauguacuccugcgacggggacgagcgcccccugcuggucaagggcacccucaucgccaucgacccguucgacgaccgccgggaggccgggggcgagagcaccguggugaaccccaagagcggguccuggaacuucuucgacugguucagcggccugauguccugguucggcgggccccugaagaccauccuccugaucugccuguacgucgcgcucagcaucggccuguucuuccugcucaucuaccuggggcgcacgggccuguccaagauguggcucgccgccaccaagaaggccagcuga

SEQ ID NO: 12838 - RNA, 3480 nt, Artificial Sequence
  derived and/or modified CDS sequence (opt1) from RVFV(763/70)__DQ380188.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccuggucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgggcugacggaggacugcaacuucugccgccagaugaccggcgccagccucaagaagggguccuacccccugcaggaccuguucugccagagcuccgaggacgacggcagcaagcucaagaccaagaugaagggcgucugcgaggugggggugcaggcccugaagaagugcgacggccagcuguccaccgcccacgaggucgugcccuucgcgguguucaagaacagcaagaaggucuaccucgacaagcuggaccugaagacggaggagaaccuccugcccgacagcuucgugugcuucgagcacaaggggcaguacaagggcaccauggacuccgggcagaccaagcgggagcucaagagcuucgacaucucccagugccccaagaucggcggccacgggagcaagaagugcaccggcgacgccgccuucugcuccgccuacgagugcacggcccaguacgcgaacgccuacugcagccacgccaacggguccggcaucgugcagauccaggucagcgggguguggaagaagccccugugcgugggcuacgagcgcgucguggucaagcgggagcuguccgccaagccgauccagcgcguggagcccugcacgaccugcaucaccaagugcgagccccacggccuggugguccggagcaccggguucaagaucuccagcgcgguggccugcgccuccggcgugugcgucaccgggagccagucccccagcaccgagaucacccucaaguacccgggcaucucccagagcuccgggggcgacaucggcgugcacauggcccacgacgaccagagcgugagcuccaagaucgucgcccacugcccgccccaggaccccugccuggugcacgggugcaucgugugcgcgcacggccugaucaacuaccagugccacacggcccucagcgccuucgucgugguguucgucuucuccagcguggccaucaucugccuggccauccuguacaaggugcucaagugccugaagaucgcgccccgcaagguccugaacccccucauguggaucaccgccuucauccgguggguguacaagaagaugguggcccgcgucgccgacaacaucaaccaggugaaccgggagaucggguggauggagggcggccagcuggcccuggggaaccccgcgccgaucccccgccacgcccccaucccccgcuacuccaccuaccucaugcugcugcucaucgugagcuacgccuccgccugcagcgagcugauccaggcguccagccggaucaccacgugcuccaccgagggcgucaacaccaagugccgccugagcgggaccgcccugauccgggccggcuccgugggggccgaggccugccucaugcugaagggcgugaaggaggaccagacgaaguuccugaagaucaagaccgucagcuccgagcucagcugccgcgagggccaguccuacuggaccgggagcuucagcccgaagugccuguccagccggcgcugccaccuggugggcgagugccacgugaaccggugccucuccuggcgcgacaacgagaccagcgcggaguucuccuucgucggggagagcacgaccaugcgggagaacaagugcuucgagcagugcggcggguggggcugcggcugcuucaacgugaaccccuccugccuguucgugcacaccuaccugcagagcguccgcaaggaggcccuccggguguucaacugcaucgacugggugcacaagcugacccuggagaucaccgacuucgacggguccgucagcacgaucgaccucggcgccuccagcucccgcuucaccaacugggggagcgugucccugagccuggacgccgagggcaucuccgggagcaacuccuucagcuucaucgagagccccggcaagggcuacgccaucguggacgagcccuucuccgagaucccgcggcagggguuccucggcgagauccgcugcaacagcgaguccagcguccuguccgcgcacgagagcugccugcgggcccccaaccucaucuccuacaagcccaugaucgaccagcuggagugcaccaccaaccugaucgaccccuucgugguguucgagcgcgggagccucccgcagacgcggaacgacaagaccuucgccgccuccaagggcaaccgcgggguccaggccuucagcaagggcuccgugcaggcggaccugacccugauguucgacaacuucgagguggacuucgucggcgccgccgugagcugcgacgccgcguuccucaaccugaccgggugcuacuccugcaacgccggcgcccgggugugccugagcaucacguccaccgggaccggcacccucagcgcccacaacaaggacggcucccugcacaucguccugcccagcgagaacgggacgaaggaccagugccagauccuccacuucaccgugcccgagguggaggaggaguucauguacuccugcgacggcgacgagcgcccccugcuggucaaggggacccucaucgccaucgacccguucgacgaccgccgggaggcgggcggggagagcaccguggucaaccccaagagcggcuccuggaacuucuucgacugguucagcggccugauguccugguucgggggcccccugaagacgauccuccugaucugccuguacguggcccucagcaucgggcuguucuuccugcucaucuaccugggccgcaccgggcuguccaagauguggcucgccgccaccaagaaggccagcuga

SEQ ID NO: 12839 - RNA, 3480 nt, Artificial Sequence
  derived and/or modified CDS sequence (opt1) from RVFV(OS-1)__DQ380186.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcagcgcgacgccaagcagaucggccgggagaccauggccggcaucgcgaugaccgugcugcccgcccucgccgucuucgcccuggcgcccgugguguucgccgaggacccccaccuccgcaaccggcccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccgcacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccggcagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggguggugcagauccaggucagcggcguguggaagaagccccugugcgugggguacgagcgggucguggucaagcgcgagcuguccgccaagccgauccagcggguggagcccugcacgaccugcaucaccaagugcgagccccacggccuggugguccgcagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcguggccaucaucugccuggccauccuguacaaggugcucaagugccugaagaucgcgccccggaagguccugaacccccucauguggaucaccgccuucauccgcuggguguacaagaagaugguggcccgggucgccgacaacaucaaccaggugaaccgcgagaucggcuggauggagggcgggcagcuggcccugggcaaccccgcgccgaucccccggcacgcccccaucccccgcuacuccaccuaccucaugcugcugcucaucgugagcuacgccuccgccugcagcgagcugauccaggcguccagccgcaucaccacgugcuccaccgagggggucaacaccaagugccggcugagcggcaccgcccugauccgcgccggguccgugggcgccgaggccugccucaugcugaagggggugaaggaggaccagacgaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgcggaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcccucaagguguucaacugcaucgacugggugcacaagcugacccuggagaucaccgacuucgacggcuccgucagcacgaucgaccucggggccuccagcucccgcuucaccaacuggggcagcgugucccugagccuggacgccgaggggaucuccggcagcaacuccuucagcuucaucgagagccccgggaagggcuacgccaucguggacgagcccuucuccgagaucccgcggcagggcuuccucggggagauccgcugcaacagcgaguccagcguccuguccgcgcacgagagcugccugcgggcccccaaccucaucuccuacaagcccaugaucgaccagcuggagugcaccaccaaccugaucgaccccuucgugguguucgagcgcggcagccucccgcagacgcggaacgacaagaccuucgccgccuccaaggggaaccgcggcguccaggccuucagcaagggguccgugcaggcggaccugacccugauguucgacaacuucgagguggacuucgucggcgccgccgugagcugcgacgccgcguuccucaaccugaccggcugcuacuccugcaacgccggggcccgggugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcgcaccggccuguccaagauguggcucgccgccaccaagaaggccagcuga

SEQ ID NO: 12840 - RNA, 3480 nt, Artificial Sequence
  derived and/or modified CDS sequence (opt1) from RVFV(2008/00101)__HE687306.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacuccaccuaccucaugcugcugcucaucgugagcuacgccuccgccugcagcgagcugauccaggcguccagccgcaucacgaccugcuccaccgagggggugaacaccaagugccggcugagcggcacggcccugauccgcgccggguccgucggcgccgaggccugccucaugcugaagggggugaaggaggaccagaccaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagacgagcgcggaguucuccuucgugggcgagagcaccaccaugcgcgagaacaagugcuucgagcagugcgggggcugggggugcggcugcuucaacgucaaccccuccugccuguucgugcacaccuaccugcagagcgugcggaaggaggcccuccgcgucuucaacugcaucgacugggugcacaagcugacccuggagaucacggacuucgacggcuccgugagcaccaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcgcacgagagcugccugcgcgcccccaaccucgucuccuacaagcccaugaucgaccagcuggagugcaccacgaaccugaucgaccccuucgugguguucgagcggggcagccucccgcagacccgcaacgacaagaccuucgccgccuccaaggggaaccggggcguccaggccuucagcaagggguccgugcaggcggaccugacccugauguucgacaacuucgagguggacuucgucggcgccgccgugagcugcgacgccgcguuccucaaccugacgggcugcuacuccugcaacgccggggcccgcgugugccugagcaucaccuccaccggcaccgggacgcucagcgcccacaacaaggacggcucccugcacaucguccugcccagcgagaacggcaccaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcacgguggucaaccccaagagcggguccuggaacuucuucgacugguucagcggccugauguccugguucggcgggccccugaagaccacccuccugaucugccuguacguggcccucagcaucggccuguucuuccugcucaucuaccuggggcggaccggccuguccaagauguggcucgccgccacgaagaaggccagcuga

SEQ ID NO: 12841 - RNA, 3480 nt, Artificial Sequence
  derived and/or modified CDS sequence (opt1) from RVFV(200803162)__JF311377.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucgcgaagugcgagccccacggccuggugguccggagcaccggcuucaagaucuccagcgccguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcgcacugcccgccccaggaccccugccuggugcacgacugcaucgugugcgcccacggccugaucaacuaccagugccacaccgcccucagcgccuucgucgugaucuucguguucuccagcacggccaucaucugccuggcgguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggguggauggagggcgggcagcuggcccugcgcaaccccgccccgaucccccggcacgcccccaucccccgcuacuccaccuaccucaugcugcugcucaucgugagcuacgccuccgcgugcagcgagcugauccaggccuccagccggaucaccacgugcuccaccgagggcgugaacaccaagugccgccugagcggcaccgcccugauccgggccggguccgucggcgccgaggcgugccucaugcugaagggggugaaggaggaccagacgaaguuccugaagaucaagaccgugagcuccgagcucagcugccgcgagggccaguccuacuggaccgggagcuucagcccgaagugccuguccagccggcgcugccaccuggucggcgagugccacgugaaccggugccucuccuggcgcgacaacgagaccagcgccgaguucuccuucgugggcgagagcacgaccaugcgggagaacaagugcuucgagcagugcgggggcugggggugcggcugcuucaacgucaaccccuccugccuguucgugcacaccuaccugcagagcgugcgcaaggaggcccuccgggucuucaacugcaucgacugggugcacaagcugacccuggagaucaccgacuucgacggguccgugagcacgaucgaccucggcgccuccagcucccgcuucaccaacuggggcagcgucucccugagccuggacgccgaggggaucuccggcagcaacuccuucagcuucaucgagagccccgggaagggcuacgcgaucguggacgagcccuucuccgagaucccgcggcagggguuccucggcgagauccgcugcaacagcgaguccagcgugcuguccgcccacgagagcugccugcgggcccccaaccucgucuccuacaagcccaugaucgaccagcuggagugcaccaccaaccugaucgaccccuucgugguguucgagcgcggcagccucccgcagacgcggaacgacaagaccuucgccgccuccaaggggaaccgcggcguccaggcguucagcaagggguccgugcaggccgaccugacccugauguucgacaacuucgagguggacuucgucggcgccgccgugagcugcgacgcggccuuccucaaccugaccgggugcuacuccugcaacgccggcgcccgcgugugccugagcaucacguccaccggcaccgggacccucagcgcccacaacaaggacggcucccugcacaucguccugcccagcgagaacgggacgaaggaccagugccagauccuccacuucaccgugcccgagguggaggaggaguucauguacuccugcgacggcgacgagcggccccugcuggucaagggcacccucaucgcgaucgacccguucgacgaccgccgggaggccgggggcgagagcaccguggucaaccccaagagcggguccuggaacuucuucgacugguucagcggccugauguccugguucgggggcccccugaagacgauccuccugaucugccuguacguggcccucagcaucggccuguucuuccugcucaucuaccuggggcgcaccggccuguccaagauguggcucgccgccaccaagaaggcgagcuga

SEQ ID NO: 12842 - RNA, 3480 nt, Artificial Sequence
  derived and/or modified CDS sequence (opt1) from RVFV(2007002060)__EU574039.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgcaaggacgccaagcagaucggccgggagaccauggccggcaucgcgaugaccguccugcccgcccucgccguguucgcccuggcgcccguggucuucgccgaggacccccaccuccgcaaccggcccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccgcacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccggcagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgcgagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgggucguggucaagcgcgagcuguccgccaagccgauccagcggguggagcccugcacgaccugcaucaccaagugcgagccccacggccuggugguccgcagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgggugcucaagugccugaagaucgcgccccgcaaggugcugaacccccucauguggaucaccgccuucauccggugggucuacaagaagaugguggcccgcguggccgacaacaucaaccaggucaaccgggagaucggcuggauggagggcgggcagcuggcccugggcaaccccgcgccgaucccccgccacgcccccaucccccgcuacuccaccuaccucaugcugcugcucaucgugagcuacgccuccgccugcagcgagcugauccaggcguccagccggaucacgaccugcuccaccgagggggugaacaccaagugccgccugagcggcacggcccugauccgggccggguccgucggcgccgaggccugccucaugcugaagggggugaaggaggaccagaccaaguuccugaagaucaagaccgugagcuccgagcucagcugccgcgagggccaguccuacuggaccggcagcuucagcccgaagugccuguccagccggcgcugccaccuggucggggagugccacgugaaccggugccucuccuggcgcgacaacgagacgagcgcggaguucuccuucgugggcgagagcaccaccaugcgggagaacaagugcuucgagcagugcgggggcugggggugcggcugcuucaacgucaaccccuccugccuguucgugcacaccuaccugcagagcgugcgcaaggaggcccuccgggucuucaacugcaucgacugggugcacaagcugacccuggagaucacggacuucgacggcuccgugagcaccaucgaccucggggccuccagcucccgcuucaccaacuggggcagcgucucccugagccuggacgccgaggggaucuccggcagcaacuccuucagcuucaucgagagccccgggaagggcuacgccaucguggacgagcccuucuccgagaucccgcggcagggcuuccucggggagauccgcugcaacagcgaguccagcgugcuguccgcgcacgagagcugccugcgggcccccaaccucgucuccuacaagcccaugaucgaccagcuggagugcaccacgaaccugaucgaccccuucgugguguucgagcgcggcagccucccgcagacccggaacgacaagaccuucgccgccuccaaggggaaccgcggcguccaggccuucagcaagggguccgugcaggcggaccugacccugauguucgacaacuucgagguggacuucgucggcgccgccgugagcugcgacgccgcguuccucaaccugacgggcugcuacuccugcaacgccggggcccgggugugccugagcaucaccuccaccggcaccgggacgcucagcgcccacaacaaggacggcucccugcacaucguccugcccagcgagaacggcaccaaggaccagugccagauccuccacuucaccgugcccgagguggaggaggaguucauguacuccugcgacggggacgagcgcccccugcuggucaagggcacccucaucgccaucgacccguucgacgaccgccgggaggccgggggcgagagcacgguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcgcaccggccuguccaagauguggcucgccgccaccaagaaggccagcuga

SEQ ID NO: 12843 - RNA, 3480 nt, Artificial Sequence
  derived and/or modified CDS sequence (opt1) from RVFV(2007002476)__EU574036.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcgugcucaagugccugaagaucgcgccccggaaggugcugaacccccucauguggaucaccgccuucaucaagugggucuacaagaagaugguggcccgcguggccgacaacaucaaccaggucaaccgggagaucggcuggauggagggcgggcagcuggcccugggcaaccccgcgccgaucccccgccacgcccccaucccccgcuacuccaccuaccucaugcugcugcucaucgugagcuacgccuccgccugcagcgagcugauccaggcguccagccggaucacgaccugcuccaccgagggggugaacaccaagugccgccugagcggcacggcccugauccgggccggguccgucggcgccgaggccugccucaugcugaagggggugaaggaggaccagaccaaguuccugaagaucaagaccgugagcuccgagcucagcugccgcgagggccaguccuacuggaccggcagcuucagcccgaagugccuguccagccggcgcugccaccuggucggggagugccacgugaaccggugccucuccuggcgcgacaacgagacgagcgcggaguucuccuucgugggcgagagcaccaccaugcgggagaacaagugcuucgagcagugcgggggcugggggugcggcugcuucaacgucaaccccuccugccuguucgugcacaccuaccugcagagcgugcgcaaggaggcccuccgggucuucaacugcaucgacugggugcacaagcugacccuggagaucacggacuucgacggcuccgugagcaccaucgaccucggggccuccagcucccgcuucaccaacuggggcagcgucucccugagccuggacgccgaggggaucuccggcagcaacuccuucagcuucaucgagagccccgggaagggcuacgccaucguggacgagcccuucuccgagaucccgcggcagggcuuccucggggagauccgcugcaacagcgaguccagcgugcuguccgcgcacgagagcugccugcgggcccccaaccucgucuccuacaagcccaugaucgaccagcuggagugcaccacgaaccugaucgaccccuucgugguguucgagcgcggcagccucccgcagacccggaacgacaagaccuucgccgccuccaaggggaaccgcggcguccaggccuucagcaagggguccgugcaggcggaccugacccugauguucgacaacuucgagguggacuucgucggcgccgccgugagcugcgacgccgcguuccucaaccugacgggcugcuacuccugcaacgccggggcccgggugugccugagcaucaccuccaccggcaccgggacgcucagcgcccacaacaaggacggcucccugcacaucguccugcccagcgagaacggcaccaaggaccagugccagauccuccacuucaccgugcccgagguggaggaggaguucauguacuccugcgacggggacgagcgcccccugcuggucaagggcacccucaucgccaucgacccguucgacgaccgccgggaggccgggggcgagagcacgguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcgcaccggccuguccaagauguggcucgccgccaccaagaaggccagcuga

SEQ ID NO: 12844 - RNA, 3480 nt, Artificial Sequence
  derived and/or modified CDS sequence (opt1) from RVFV(2269/74)__DQ380222.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccagcacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcgucgccaucaucugccuggccauccuguacaaggugcucaagugccugaagaucgcgcccaagaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccggcacgcccccaucccccgcuacuccaccuaccucaugcugcugcucaucgugagcuacgccuccgccugcagcgagcugauccaggcguccagccgcaucaccacgugcuccaccgagggggugaacaccaagugccggcugagcggcaccgcccugauccgcgccggguccgucggcgccgaggccugccucaugcugaagggggugaaggaggaccagacgaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagaccagcgcggaguucuccuucgugggcgagagcacgaccaugcgcgagaacaagugcuucgagcagugcgggggcugggggugcggcugcuucaacgucaaccccuccugccuguucgugcacaccuaccugcagagcgugcggaaggaggcccuccgcgucuucaacugcaucgacugggugcacaagcugacccuggagaucaccgacuucgacggcuccgugagcacgaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcgcacgagagcugccugcgcgcccccaaccucaucuccuacaagcccaugaucgaccagcuggagugcaccaccaaccugaucgaccccuucgucguguucgagcggggcagccucccgcagacgcgcaacgacaagaccuucgccgccuccaaggggaaccggggcgugcaggccuucagcaagggguccguccaggcggaccugacccugauguucgacaacuucgagguggacuucgugggcgccgccgucagcugcgacgccgcguuccucaaccugaccggcugcuacuccugcaacgccggggcccgcgugugccugagcaucacguccaccggcaccgggacccucagcgcccacaacaaggacggcucccugcacaucgugcugcccagcgagaacggcacgaaggaccagugccagauccuccacuucaccguccccgagguggaggaggaguucauguacuccugcgacggggacgagcggccccugcuggugaagggcacccucaucgccaucgacccguucgacgaccgccgcgaggccgggggcgagagcaccgucgugaaccccaagagcggguccuggaacuucuucgacugguucagcggccugauguccugguucggcgggccccugaagacgauccuccugaucugccuguacgucgcccucagcaucggccuguucuuccugcucaucuaccuggggcggaccggccuguccaagauguggcucgccgccaccaagaaggccagcuga

SEQ ID NO: 12845 - RNA, 3480 nt, Artificial Sequence
  derived and/or modified CDS sequence (opt1) from RVFV(73HB1449)__DQ380211.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagaaccccuccaccgagaucacccucaaguacccggggaucagccaguccagcggcggggacaucggcguccacauggcccacgacgaccaguccgugagcagcaagaucguggcccacugcccgccccaggaccccugccugguccacggcugcaucgugugcgcgcacgggcugaucaacuaccagugccacacggcccucuccgccuucguggucguguucguguucagcuccaucgccaucaucugccuggccauccuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggcuggauggagggcgggcagcugguccugggcaaccccgccccgaucccccgccacgcgcccaucccccgguacagcaccuaccucaugcugcugcucaucguguccuacgccagcgccugcuccgagcugauccaggccagcucccgcaucaccacgugcagcaccgagggggugaacaccaagugccggcuguccggcaccgcgcugauccgcgccgggagcgucggcgccgaggccugccucaugcugaagggggugaaggacgaccagacgaaguuccugaagaucaagaccguguccagcgagcucuccugccgggagggccagagcuacuggaccggcuccuucagcccgaagugccugagcucccgccggugccaccuggucggggagugccacgugaaccgcugccucagcuggcgggacaacgagaccuccgccgaguucagcuucgugggcgaguccacgaccaugcgcgagaacaagugcuucgagcagugcgggggcugggggugcggcugcuucaacgucaaccccagcugccuguucgugcacaccuaccugcaguccgugcggaaggaggcgcuccgcgucuucaacugcaucgacugggugcacaagcugacccuggagaucaccgacuucgacggcagcguguccacgaucgaccucggggccagcuccagccgguucaccaacuggggcuccgucagccugucccuggacgccgaggggaucagcggcuccaacagcuucuccuucaucgagagccccgggaagggcuacgccaucguggacgagcccuucagcgagaucccgcgccagggcuuccucggggagauccggugcaacuccgagagcuccgugcugagcgcccacgaguccugccugcgcgcgcccaaccucaucagcuacaagcccaugaucgaccagcuggagugcaccaccaaccugaucgaccccuucgucguguucgagcggggcucccucccgcagacgcgcaacgagaagaccuucgccgccagcaaggggaaccggggcgugcaggccuucuccaaggggagcguccaggccgaccugacccugauguucgacaacuucgagguggacuucgugggcgcggccgucuccugcgacgccgccuuccucaaccugaccggcugcuacagcugcaacgcgggggcccgcgugugccuguccaucacgagcaccggcaccgggacccucuccgcccacaacaaggacggcagccugcacaucgugcugcccuccgagaacggcacgaaggaccagugccagauccuccacuucaccguccccgagguggaggaggaguucauguacagcugcgacggggacgagcgcccccugcuggugaagggcacccucaucgccaucgacccguucgacgaccggcgcgaggccgggggcgaguccaccgucgugaaccccaagagcgggagcuggaacuucuucgacugguucuccggccugaugagcugguucggcgggccccugaagacgauccuccugaucugccuguacgucgcgcucuccaucggccuguucuuccugcucaucuaccuggggcggaccggccugagcaagauguggcucgccgccaccaagaaggccuccuga

SEQ ID NO: 12846 - RNA, 3480 nt, Artificial Sequence
  derived and/or modified CDS sequence (opt1) from RVFV(SA-51 (Van Wyck))__DQ380195.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccgcggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcggguggucgugaagcgcgagcuguccgccaagccgauccagcgggucgagcccugcacgaccugcaucaccaagugcgagccccacggccugguggugcgcagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacuccaccuaccucaugcugcugcucaucgugagcuacgccuccgccugcagcgagcugauccaggcguccagccgcaucaccacgugcuccaccgagggggugaacaccaagugccggcugagcggcaccgcccugauccgcgccggguccgucggcgccgaggccugccucaugcugaagggggugaaggaggaccagacgaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagaccagcgcggaguucuccuucgugggcgagagcacgaccaugcgcgagaacaagugcuucgagcagugcgggggcugggggugcggcugcuucaacgucaaccccuccugccuguucgugcacaccuaccugcagagcgugcggaaggaggcccuccgcgucuucaacugcaucgacugggugcacaagcugacccuggaggugaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcgcacgagagcugccugcgcgcccccaaccucaucuccuacaagcccaugaucgaccagcuggagugcaccaccaaccugaucgaccccuucgugguguucgagcggggcagccucccgcagacgcgcaacgacaagaccuucgccgccuccaaggggaaccggggcguccaggccuucagcaagggguccgugcaggcggaccugacccugauguucgacaacuucgagguggacuucgucggcgccgccgugagcugcgacgccgcguuccucaaccugaccggcugcuacuccugcaacgccggggcccgcgugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcggaccggccuguccaagauguggcucgccgccaccaagaaggccagcuga

SEQ ID NO: 12847 - RNA, 3480 nt, Artificial Sequence
  derived and/or modified CDS sequence (opt1) from RVFV(KEN/Gar-Msq/131B-04/06)__HM586972.1__NSm-Gn-Gc
augaucgagggcgccugggacagcuuccgcgaggaggagaugcccgaggagcuguccugcagcguguccgggauccgggaggucaagaccagcucccaggagcucuaccgcgcccugaaggcgaucaucgccgccgacggccugaacaacaucacgugccacgggaagaacccggaggacaagaucagccucaucaagggcccgccccacaagaagcggguggggaucgugcgcugcgagcggcgccgggacgccaagcagaucggccgcgagaccauggccggcaucgcgaugaccguccugcccgcccuggccguguucgcccucgcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccugcucgaggccguccacgacaccaucaucgccaaggccgacccgcccagcugcgaccugcaguccgcccacggcaaccccugcaugaaggagaagcuggugaugaagacccacugccccaacgacuaccagagcgcgcacuaccucaacaacgacggcaagauggccuccgugaagugcccgcccaaguacgagcugacggaggacugcaacuucugccgccagaugaccggggccagccugaagaagggcuccuacccccuccaggaccuguucugccagagcuccgaggacgacgggagcaagcugaagaccaagaugaagggcgucugcgaggugggcgugcaggcccucaagaagugcgacgggcagcuguccaccgcccacgaggucgugcccuucgcgguguucaagaacagcaagaaggucuaccuggacaagcucgaccugaagacggaggagaaccugcuccccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccugaaguacccggggaucucccagagcuccggcggggacaucggcgugcacauggcccacgacgaccagagcgugagcuccaagaucgucgcccacugcccgccccaggaccccugccucgugcacggcugcaucgugugcgcgcacgggcugaucaacuaccagugccacacggcccugagcgccuucgucgugaucuucguguucuccagcaccgccaucaucugccucgccguccuguaccgcgugcugaagugccucaagaucgcgccccggaaggugcugaacccccugauguggaucaccgccuucauccgcugggucuacaagaagaugguggcccggguggccgacaacaucaaccaggucaaccgcgagaucggcuggauggagggcgggcagcucgcccugggcaaccccgcgccgaucccccgccacgcccccaucccccgguacuccaccuaccugaugcuccugcugaucgugagcuacgccuccgccugcagcgagcucauccaggcguccagccgcaucacgaccugcuccaccgagggggugaacaccaagugccggcugagcggcacggcccugauccgcgccggguccgucggcgccgaggccugccugaugcucaagggggugaaggaggaccagaccaaguuccugaagaucaagaccgugagcuccgagcugagcugccgggagggccaguccuacuggaccggcagcuucagcccgaagugccucuccagccgccggugccaccuggucggggagugccacgugaaccgcugccuguccuggcgggacaacgagacgagcgcggaguucuccuucgugggcgagagcaccaccaugcgcgagaacaagugcuucgagcagugcgggggcugggggugcggcugcuucaacgucaaccccuccugccucuucgugcacaccuaccugcagagcgugcggaaggaggcccugcgcgucuucaacugcaucgacugggugcacaagcucacccuggagaucacggacuucgacggcuccgugagcaccaucgaccugggggccuccagcucccgguucaccaacuggggcagcgucucccucagccuggacgccgaggggaucuccggcagcaacuccuucagcuucaucgagagccccgggaagggcuacgccaucguggacgagcccuucuccgagaucccgcgccagggcuuccugggggagauccggugcaacagcgaguccagcgugcucuccgcgcacgagagcugccugcgcgcccccaaccuggucuccuacaagcccaugaucgaccagcucgagugcaccacgaaccugaucgaccccuucgugguguucgagcggggcagccugccgcagacccgcaacgacaagaccuucgccgccuccaaggggaaccggggcguccaggccuucagcaagggguccgugcaggcggaccucacccugauguucgacaacuucgagguggacuucgucggcgccgccgugagcugcgacgccgcguuccugaaccucacgggcugcuacuccugcaacgccggggcccgcgugugccugagcaucaccuccaccggcaccgggacgcugagcgcccacaacaaggacggcucccuccacaucguccugcccagcgagaacggcaccaaggaccagugccagauccugcacuucaccgugcccgagguggaggaggaguucauguacuccugcgacggggacgagcgcccccuccuggucaagggcacccugaucgccaucgacccguucgacgaccggcgcgaggccgggggcgagagcacgguggucaaccccaagagcggguccuggaacuucuucgacugguucagcggccucauguccugguucggcgggccccugaagaccauccugcucaucugccuguacguggcccugagcaucggccucuucuuccugcugaucuaccucgggcggaccggccuguccaagauguggcuggccgccaccaagaaggccagcuga

SEQ ID NO: 12848 - RNA, 3480 nt, Artificial Sequence
  derived and/or modified CDS sequence (opt1) from RVFV(2007001107)__EU574047.1__NSm-Gn-Gc
augaucgagggcgccugggacagccugcgcgaggaggagaugcccgaggagcucuccugcagcguguccgggauccgggaggucaagaccagcaaccaggagcuguaccgcgcccugaaggcgaucaucgccgccgacggccucaacaacaucacgugccacgggaagaacccggaggacaagaucucccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcagcuccuucgacgugcugcuggagaaggggaaguucccgcuguuccagagcuacgcgcaccaccggacccuccuggaggccguccacgacaccaucaucgccaaggccgacccgcccuccugcgaccugcagagcgcccacggcaaccccugcaugaaggagaagcucgugaugaagacccacugccccaacgacuaccaguccgcgcacuaccugaacaacgacggcaagauggccagcgugaagugcccgcccaaguacgagcugacggaggacugcaacuucugccgccagaugaccggggccucccucaagaagggcagcuacccccugcaggaccuguucugccaguccagcgaggacgacggguccaagcucaagaccaagaugaagggcgucugcgaggugggcgugcaggcccugaagaagugcgacgggcagcugagcaccgcccacgaggucgugcccuucgcgguguucaagaacuccaagaaggucuaccucgacaagcuggaccugaagacggaggagaaccuccugcccgacagcuucgugugcuucgagcacaagggccaguacaaggggaccauggacagcggccagaccaagcgggagcugaaguccuucgacaucagccagugccccaagaucgggggccacggcuccaagaagugcaccggggacgccgccuucugcagcgccuacgagugcacggcccaguacgcgaacgccuacugcucccacgccaacggcagcgggaucgugcagauccaggucuccggcguguggaagaagccccucugcgugggguacgagcgcgucguggucaagcgggagcugagcgccaagccgauccagcgcguggagcccugcacgaccugcaucaccaagugcgagccccacggccuggugguccgguccaccggcuucaagaucagcuccgcgguggccugcgccagcggggugugcgucaccggcucccagagccccuccaccgagaucacccucaaguacccggggaucagccaguccagcggcggggacaucggcgugcacauggcccacgacgaccaguccgugagcagcaagaucgucgcccacugcccgccccaggaccccugccuggugcacggcugcaucgugugcgcgcacgggcugaucaacuaccagugccacacggcccucuccgccuucgucgugaucuucguguucagcuccaccgccaucaucugccuggccguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacagcaccuaccucaugcugcugcucaucguguccuacgccagcgccugcuccgagcugauccaggcgagcucccgcaucacgaccugcagcaccgagggggugaacaccaagugccggcuguccggcacggcccugauccgcgccgggagcgucggcgccgaggccugccucaugcugaagggggugaaggaggaccagaccaaguuccugaagaucaagaccguguccagcgagcucuccugccgggagggccagagcuacuggaccggcuccuucagcccgaagugccugagcucccgccggugccaccuggucggggagugccacgugaaccgcugccucagcuggcgggacaacgagacguccgcggaguucagcuucgugggcgaguccaccaccaugcgcgagaacaagugcuucgagcagugcgggggcugggggugcggcugcuucaacgucaaccccagcugccuguucgugcacaccuaccugcaguccgugcggaaggaggcccuccgcgucuucaacugcaucgacugggugcacaagcugacccuggagaucacggacuucgacggcagcguguccaccaucgaccucggggccagcuccagccgguucaccaacuggggcuccgucagccugucccuggacgccgaggggaucagcggcuccaacagcuucuccuucaucgagagccccgggaagggcuacgccaucguggacgagcccuucagcgagaucccgcgccagggcuuccucggggagauccggugcaacuccgagagcuccgugcugagcgcgcacgaguccugccugcgcgcccccaaccucgucagcuacaagcccaugaucgaccagcuggagugcaccacgaaccugaucgaccccuucgugguguucgagcggggcucccucccgcagacccgcaacgacaagaccuucgccgccagcaaggggaaccggggcguccaggccuucuccaaggggagcgugcaggcggaccugacccugauguucgacaacuucgagguggacuucgucggcgccgccguguccugcgacgccgcguuccucaaccugacgggcugcuacagcugcaacgccggggcccgcgugugccuguccaucaccagcaccggcaccgggacgcucuccgcccacaacaaggacggcagccugcacaucguccugcccuccgagaacggcaccaaggaccagugccagauccuccacuucaccgugcccgagguggaggaggaguucauguacagcugcgacggggacgagcgcccccugcuggucaagggcacccucaucgccaucgacccguucgacgaccggcgcgaggccgggggcgaguccacgguggucaaccccaagagcgggagcuggaacuucuucgacugguucuccggccugaugagcugguucggcgggccccugaagaccauccuccugaucugccuguacguggcccucuccaucggccuguucuuccugcucaucuaccuggggcggaccggccugagcaagauguggcucgccgccaccaagaaggccuccuga

SEQ ID NO: 12849 - RNA, 3480 nt, Artificial Sequence
  derived and/or modified CDS sequence (opt1) from RVFV(ANK-3837)__DQ380215.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaagcuggacuccggccagaccaagcgggagcucaagagcuucgacaucucccagugccccaagaucgggggccacggcagcaagaagugcaccggggacgccgccuucugcuccgccuacgagugcaccgcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccucguggugcggagcaccggcuucaagaucuccagcgcggucgccugcgccuccggggugugcgugacgggcagccagucccccagcaccgagaucacccugaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcucaucaacuaccagugccacaccgcccugagcgccuucguggucguguucguguucuccagcaucgccaucaucugccuggccauccucuaccgcguccugaagugccugaagaucgcgccccggaaggugcucaacccccugauguggaucacggccuucauccgcuggguguaccggaagauggucgcccgcguggccgacaacaucaaccaggugaaccgcgagaucggcuggauggagggcgggcagcugguccucggcaaccccgccccgaucccccggcacgugcccaucccccgcuacuccaccuaccugaugcugcuccugaucgugagcuacgcguccgccugcagcgagcugauccaggccuccagccggaucacgaccugcuccaccgagggggucaacaccaagugccgccugagcggcaccgcccucauccgggcgggguccgugggcgccgaggccugccugaugcugaagggggugaaggaggaccagaccaaguuccucaagaucaagacggucagcuccgagcugagcugccgcgagggccaguccuacuggaccggcagcuucagcccgaagugccuguccagccggcgcugccaccucgugggggagugccacgugaaccggugccuguccuggcgcgacaacgagaccagcgccgaguucuccuucgucggcgagagcaccacgaugcgggagaacaagugcuucgagcagugcgggggcugggggugcggcugcuucaacgugaaccccuccugccuguucgugcacaccuaccuccagagcguccgcaaggaggcccugcggguguucaacugcaucgacugggugcacaagcugacccucgagaucaccgacuucgacggcuccgucagcaccaucgaccugggggcguccagcucccgcuucacgaacuggggcagcgugucccugagccucgacgccgaggggaucuccggcagcaacuccuucagcuucaucgagagccccgggaagggcuacgccaucguggacgagcccuucuccgagaucccgcggcagggcuuccugggggagauccgcugcaacagcgaguccagcguccuguccgcccacgagagcugccuccgggcccccaaccugaucuccuacaagcccaugaucgaccagcuggagugcaccaccaaccucaucgaccccuucgugguguucgagcgcggcagccugccgcagacccggaacgacaagacguucgcggccuccaaggggaaccgcggcguccaggccuucagcaagggguccgugcaggccgaccugacccucauguucgacaacuucgagguggacuucgucggcgccgcggugagcugcgacgccgccuuccugaaccugaccggcugcuacuccugcaacgccggggcgcgcgugugccucagcaucaccuccacgggcaccgggacccugagcgcccacaacaaggacggcucccugcacaucguccuccccagcgagaacggcaccaaggaccagugccagauccugcacuucacggugcccgagguggaggaggaguucauguacuccugcgacggggacgagcggccccugcucguccgcggcacccugaucgccaucgacccguucgacgaccggcgcgaggccgggggcgagagcaccguggucaaccccaagagcggguccuggaacuucuucgacugguucagcggccugauguccugguucggcgggccccucaagaccauccugcugaucugccucuacguggcccugagcaucggccuguucuuccuccugaucuaccuggggcggacgggccucuccaagauguggcuggcggccaccaagaaggccagcuga

SEQ ID NO: 12850 - RNA, 3480 nt, Artificial Sequence
  derived and/or modified CDS sequence (opt1) from RVFV(Lunyo)__KU167026.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccaugguguccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcguggccaucaucugccuggccauccuguacaaggugcucaagugccugaagaucgcgccccgcaagguccugaacccccucauguggaucaccgccuucauccgguggguguacaagaagaugguggcccgcgucgccgacaacaucaaccaggugaaccgggagaucggcuggauggagggcgggcagcuggcccugggcaaccccgcgccgaucccccgccacgcccccaucccccgcuacuccaccuaccucaugcugcugcucaucgugagcuacgccuccgccugcagcgagcugauccaggcguccagccggaucaccacgugcuccaccgagggggucaacacccgcugccggcugagcggcaccgcccugauccgcgccggguccgugggcgccgaggccugccucaugcugaagggggugaaggaggaccagacgaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgcggaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcccuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcgcacgagagcugccugcgcgcccccaaccucaucuccuacaagcccaugaucgaccagcuggagugcaccaccaaccugaucgaccccuucgugguguucgagcggggcagccucccgcagacgcgcaacgacaagaccuucgccgccuccaaggggaaccggggcguccaggccuucagcaagggguccgugcaggcggaccugacccugauguucgacaacuucgagguggacuucgucggcgccgccgugagcugcgacgccgcguuccucaaccugaccggcugcuacuccugcaacgccggggcccgcgugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcggaccggccuguccaagauguggcucgccgccaccaagaaggccagcuga

SEQ ID NO: 12851 - RNA, 3480 nt, Artificial Sequence
  derived and/or modified CDS sequence (opt1) from RVFV(RVFBJ01/2016)__KX785331.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaagcacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcgucgccaucaucugccuggccauccuguacaaggugcuccgcugccugaagaucgcgcccaagaaggugcugaacccccucauguggaucaccgccuucauccggugggucuacaagaagaugguggcccgcguggccgacaacaucaaccaggucaaccgggagaucggcuggauggagggcgggcagcuggcccugggcaaccccgcgccgaucccccgccacgcccccaucccccgcuacuccaccuaccucaugcugcugcucaucaucagcuacgccuccgccugcagcgagcugauccaggcguccagccggaucaccacgugcuccaccgagggggugaacaccaagugccgccugagcggcaccgcccugauccgggccggguccgugggcgccgaggccugccucaugcugaagggggucaaggaggaccagacgaaguuccugaagaucaagaccgugagcuccgagcucagcugccgcgagggccaguccuacuggaccggcagcuucagcccgaagugccuguccagccggcgcugccaccuggugggggagugccacgucaaccggugccucuccuggcgcgacaacgagaccagcgcggaguucuccuucgugggcgagagcacgaccaugcgggagaacaagugcuucgagcagugcgggggcugggggugcggcugcuucaacgugaaccccuccugccuguucguccacaccuaccugcagagcgugcgcaaggaggcccuccggguguucaacugcaucgacuggguccacaagcugacccuggagaucaccgacuucgacggcuccgugagcacgaucgaccucggggccuccagcucccgcuucaccaacuggggcagcgugucccugagccuggacgccgaggggaucuccggcagcaacuccuucagcuucaucgagagccccgggaagggcuacgccaucgucgacgagcccuucuccgagaucccgcggcagggcuuccucggggagauccgcugcaacagcgaguccagcgugcuguccgcgcacgagagcugccugcgggcccccaaccucaucuccuacaagcccaugaucgaccagcuggagugcaccaccaaccugaucgaccccuucguggucuucgagcgcggcagccucccgcagacgcggaacgacaagaccuucgccgccuccaaggggaaccgcggcgugcaggccuucagcaagggguccgugcaggcggaccugacccugauguucgacaacuucgaggucgacuucgugggcgccgccgugagcugcgacgccgcguuccucaaccugaccggcugcuacuccugcaacgccggggcccgggucugccugagcaucacguccaccggcaccgggacccucagcgcccacaacaaggacggcucccugcacaucgugcugcccagcgagaacggcacgaaggaccagugccagauccuccacuucaccgugcccgaggucgaggaggaguucauguacuccugcgacggggacgagcgcccccugcuggugaagggcacccucaucgccaucgacccguucgacgaccgccgggaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcgcaccggccuguccaagauguggcucgccgccaccaagaaggccagcuga

SEQ ID NO: 12852 - RNA, 3480 nt, Artificial Sequence
  derived and/or modified CDS sequence (opt1) from RVFV(Ken 199800523)__KU978777.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacaccaagcagaucggccgcgagaccauggccggcaucgccaugaccguccugcccgcgcucgccguguucgcccuggcccccguggucuucgcggaggacccccaccuccggaaccgccccgggaagggccacaacuacaucgacgggaugacccaggaggacgccacgugcaagcccgugaccuacgccggcgccugcuccagcuucgacgugcugcuggagaaggggaaguucccgcuguuccaguccuacgcccaccaccggacccuccuggaggcgguccacgacaccaucaucgccaaggccgacccgcccagcugcgaccugcaguccgcccacggcaaccccugcaugaaggagaagcucgugaugaagacgcacugccccaacgacuaccagagcgcccacuaccugaacaacgacggcaagauggcguccgugaagugcccgcccaaguacgagcugaccgaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccacggcccacgaggucgugcccuucgccguguucaagaacagcaagaaggucuaccucgacaagcuggaccugaagaccgaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcacgggggacgcggccuucugcuccgccuacgagugcaccgcccaguacgccaacgcguucugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgccguggcgugcgccuccggggugugcgucaccggcagccagucccccagcaccgagaucacgcucaaguacccggggaucucccagagcuccggcggggacaucggcgugcacauggcccacgacgaccagagcgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcccccaucccccgguacuccaccuaccucaugcugcugcucaucgugagcuacgcguccgccugcagcgagcugauccaggccuccagccgcaucacgaccugcuccaccgagggggucaacaccaagugccggcugagcggcacggcccugauccgcgcgggguccgugggcgccgaggccugccucaugcugaagggggugaaggaggaccagaccaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagacgagcgccgaguucuccuucgucggcgagagcaccaccaugcgcgagaacaagugcuucgagcagugcgggggcugggggugcggcugcuucaacgugaaccccuccugccuguucgugcacaccuaccugcagagcguccggaaggaggcccuccgcguguucaacugcaucgacugggugcacaagcugacccuggagaucacggacuucgacggcuccgucagcaccaucgaccucggggcguccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccugaacgcccacgaguccugccugcgcgcccccaaccucaucagcuacaagcccaugaucgaccagcuggagugcaccacgaaccugaucgaccccuucgugguguucgagcggggcucccucccgcagacccgcaacgacaagaccuucgcggccagcaaggggaaccggggcguccaggccuucuccaaggggagcgugcaggccgaccugacccugauguucgacaacuucgagguggacuucgucggcgccgcgguguccugcgacgccgccuuccucaaccugacgggcugcuacagcugcaacgccggggcgcgcgugugccuguccaucaccagcaccggcaccgggacgcucuccgcccacaacaaggagggcagccugcacaucguccugcccuccgagaacggcaccaaggaccagugccagauccuccacuucaccgugcccgagguggaggaggaguucauguacagcugcgacggggacgagcgcccccugcuggucaagggcacccucaucgccaucgacccguucgacgaccggcgcgaggccgggggcgaguccacgguggucaaccccaagagcgggagcuggaacuucuucgacugguucuccggccugaugagcugguucggcgggccccugaagaccauccuccugaucugccuguacguggcccucuccaucggccuguucuuccugcucaucuaccuggggcggaccggccugagcaagauguggcucgcggccaccaagaaggccuccuga

SEQ ID NO: 12853 - RNA, 3480 nt, Artificial Sequence
  derived and/or modified CDS sequence (opt1) from RVFV__JQ068143.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccaucgacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcugaucaacuaccagugccacacggcccucagcgccuucguggucguguucguguucuccagcgucgccaucaucugccuggccauccuguacaaggugcuccgcugccugaagaucgcgcccaagaaggugcugaacccccucauguggaucaccgccuucauccggugggucuacaagaagaugguggcccgcguggccgacaacaucaaccaggucaaccgggagaucggcuggauggagggcgggcagcuggcccugggcaaccccgcgccgaucccccgccacgcccccaucccccgcuacuccaccuaccucaugcugcugcucaucaucagcuacgccuccgccugcagcgagcugauccaggcguccagccggaucaccacgugcuccaccgagggggugaacaccaagugccgccugagcggcaccgcccugauccgggccggguccgugggcgccgaggccugccucaugcugaagggggucaaggaggaccagacgaaguuccugaagaucaagaccgugagcuccgagcucagcugccgcgagggccaguccuacuggaccggcagcuucagcccgaagugccuguccagccggcgcugccaccuggugggggagugccacgucaaccggugccucuccuggcgcgacaacgagaccagcgcggaguucuccuucgugggcgagagcacgaccaugcgggagaacaagugcuucgagcagugcgggggcugggggugcggcugcuucaacgugaaccccuccugccuguucguccacaccuaccugcagagcgugcgcaaggaggcccuccggguguucaacugcaucgacuggguccacaagcugacccuggagaucaccgacuucgacggcuccgugagcacgaucgaccucggggccuccagcucccgcuucaccaacuggggcagcgugucccugagccuggacgccgaggggaucuccggcagcaacuccuucagcuucaucgagagccccgggaagggcuacgccaucgucgacgagcccuucuccgagaucccgcggcagggcuuccucggggagauccgcugcaacagcgaguccagcgugcuguccgcgcacgagagcugccugcgggcccccaaccucaucuccuacaagcccaugaucgaccagcuggagugcaccaccaaccugaucgaccccuucguggucuucgagcgcggcagccucccgcagacgcggaacgacaagaccuucgccgccuccaaggggaaccgcggcgugcaggccuucagcaagggguccgugcaggcggaccugacccugauguucgacaacuucgaggucgacuucgugggcgccgccgugagcugcgacgccgcguuccucaaccugaccggcugcuacuccugcaacgccggggcccgggucugccugagcaucacguccaccggcaccgggacccucagcgcccacaacaaggacggcucccugcacaucgugcugcccagcgagaacggcacgaaggaccagugccagauccuccacuucaccgugcccgaggucgaggaggaguucauguacuccugcgacggggacgagcgcccccugcuggugaagggcacccucaucgccaucgacccguucgacgaccgccgggaggccgggggcgagagcaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcgcaccggccuguccaagauguggcucgccgccaccaagaaggccagcuga

SEQ ID NO: 12854 - RNA, 3480 nt, Artificial Sequence
  derived and/or modified CDS sequence (opt1) from RVFV(200803169)__JF311384.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacuccaccuaccucaugcugcugcucaucgugagcuacgccuccgccugcagcgagcugauccaggcguccagccgcaucacgaccugcuccaccgagggggugaacaccaagugccggcugagcggcacggcccugauccgcgccggguccgucggcgccgaggccugccucaugcugaagggggugaagguggaccagaccaaguuccugaagaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagacgagcgcggaguucuccuucgucggcgagagcaccaccaugcgcgagaacaagugcuucgagcagugcgggggcugggggugcggcugcuucaacgugaaccccuccugccuguucgugcacaccuaccugcagagcguccggaaggaggcccuccgcguguucaacugcaucgacugggugcacaagcugacccuggagaucacggacuucgacggcuccgucagcaccaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagguccggugcaacagcgaguccagcgugcuguccgcgcacgagagcugccugcgcgcccccaaccucguguccuacaagcccaugaucgaccagcuggagugcaccacgaaccugaucgaccccuucgucguguucgagcggggcagccucccgcagacccgcaacgacaagaccuucgccgccuccaaggggaaccggggcgugcaggccuucagcaagggguccguccaggcggaccugacccugauguucgacaacuucgagguggacuucgugggcgccgccgucagcugcgacgccgcguuccucaaccugacgggcugcuacuccugcaacgccggggcccgcgugugccugagcaucaccuccaccggcaccgggacgcucagcgcccacaacaaggacggcucccugcacaucgugcugcccagcgagaacggcaccaaggaccagugccagauccuccacuucaccguccccgagguggaggaggaguucauguacuccugcgacggggacgagcgcccccugcuggucaagggcacccucaucgccaucgacccguucgacgaccggcgcgaggccgggggcgagagcacgguggugaaccccaagagcggguccuggaacuucuucgacugguucagcggccugauguccugguucggcgggccccugaagaccauccuccugaucugccuguacgucgcccucagcaucggccuguucuuccugcucaucuaccuggggcggaccggccuguccaagauguggcucgccgccaccaagaaggccagcuga

SEQ ID NO: 12855 - RNA, 3480 nt, Artificial Sequence
  derived and/or modified CDS sequence (opt1) from RVFV(2007002445)__EU574037.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacuccaccuaccucaugcugcugcucaucgugagcuacgccuccgccugcagcgagcugauccaggcguccagccgcaucacgaccugcuccaccgagggggugaacaccaagugccggcugagcggcacggcccugauccgcgccggguccgucggcgccgaggccugccucaugcugaagggggugaaggaggaccagaccaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagacgagcgcggaguucuccuucgugggcgagagcaccaccaugcgcgagaacaagugcuucgagcagugcgggggcugggggugcggcugcuucaacgucaaccccuccugccuguucgugcacaccuaccugcagagcgugcggaaggaggcccuccgcgucuucaacugcaucgacugggugcacaagcugacccuggagaucacggacuucgacggcuccgugagcaccaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcgcacgagagcugccugcgcgcccccaaccucgucuccuacaagcccaugaucgaccagcuggagugcaccacgaaccugaucgaccccuucgugguguucgagcggggcagccucccgcagacccgcaacgagaagaccuucgccgccuccaaggggaaccggggcguccaggccuucagcaagggguccauccaggcggaccugacccugauguucgacaacuucgagguggacuucgugggcgccgccgucagcugcgacgccgcguuccucaaccugacgggcugcuacuccugcaacgccggggcccgcgugugccugagcaucaccuccaccggcaccgggacgcucagcgcccacaacaaggacggcucccugcacaucgugcugcccagcgagaacggcaccaaggaccagugccagauccuccacuucaccguccccgagguggaggaggaguucauguacuccugcgacggggacgagcgcccccugcuggugaagggcacccucaucgccaucgacccguucgacgaccggcgcgaggccgggggcgagagcacggucgugaaccccaagagcggguccuggaacuucuucgacugguucagcggccugauguccugguucggcgggccccugaagaccauccuccugaucugccuguacgucgcccucagcaucggccuguucuuccugcucaucuaccuggggcggaccggccuguccaagauguggcucgccgccaccaagaaggccagcuga

SEQ ID NO: 12856 - RNA, 3480 nt, Artificial Sequence
  derived and/or modified CDS sequence (opt1) from RVFV(Hv-B375)__DQ380218.1__NSm-Gn-Gc
augaucgagggcgccugggacagccugcgcgagggggagaugcccgaggagcucuccugcagcaucuccggcauccgggaggugaagaccagcucccaggagcuguaccgcgcccugaaggcgaucaucgccgccgacgggcucaacaacaucacgugccacggcaaggacccggaggacaagaucagccugaucaaggggccgccccacaagaagcgggucggcaucgugcgcugcgagcggcgccgggacgccaagcagaucggccgcgagaccauggccgggaucgcgaugaccgugcugcccgcccucgccgucuucgcccuggcgcccgugguguucgccgaggacccccaccuccggaaccgccccggcaaggggcacaacuacaucgacggcaugacccaggaggacgcgaccugcaagcccgucacguacgccggggccugcuccagcuucgacgugcugcuggagaagggcaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacgggaagauggccuccgugaagugcccgcccaagaacgagcugacggaggacugcaacuucugccgccagaugaccggcgccagccucaagaagggguccuacccccugcaggaccuguucugccagagcuccgaggacgacggcagcaagcucaagaccaagaugaagggcgugugcgaggucggggugcaggcccugaagaagugcgacggccagcuguccaccgcccacgaggugguccccuucgcgguguucaagaacagcaagaagguguaccucgacaagcuggaccugaagacggaggagaaccuccugcccgacagcuucgucugcuucgagcacaaggggcaguacaagggcaccauggacuccgggcagaccaagcgggagcucaagagcuucgacaucucccagugccccaagaucggcggccacgggagcaagaagugcaccggcgacgccgccuucugcuccgccuacgagugcacggcccaguacgcgaacgccuacugcagccacgccaacggguccggcaucgugcagauccaggugagcggggucuggaagaagccccugugcgugggcuacgagcgcguggucgugaagcgggagcuguccgccaagccgauccagcgcgucgagcccugcacgaccugcaucaccaagugcgagccccacggccugguggugcggagcaccggguucaagaucuccagcgcggucgccugcgccuccggcgugugcgugaccgggagccagucccccagcaccgagaucacccucaaguacccgggcaucucccagagcuccgggggcgacaucggcguccacauggcccacgacgaccagagcgugagcuccaagaucguggcccacugcccgccccaggaccccugccugguccacgggugcaucgugugcgcgcacggccugaucaacuaccagugccacacggcccucagcgccuucguggucguguucguguucuccagcaucgccaucaucugccuggccauccuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggguggauggagggcggccagcugguccuggggaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggcgugaacaccaagugccggcugagcgggaccgcgcugauccgcgccggcuccgucggggccgaggccugccucaugcugaagggcgugaaggaggaccagacgaaguuccugaagaucaagaccgugagcuccgagcucagcugccgggagggccaguccuacuggaccgggagcuucagcccgaagugccuguccagccgccggugccaccuggucggcgagugccacgugaaccgcugccucuccuggcgggacaacgagaccagcgccgaguucuccuucgugggggagagcacgaccaugcgcgagaacaagugcuucgagcagugcggcggguggggcugcggcugcuucaacgucaaccccuccugccuguucgugcacaccuaccugcagagcgugcggaaggaggcgcuccgcgucuucaacugcaucgacugggugcacaagcugacccuggagaucaccgacuucgacggguccgugagcacgaucgaccucggcgccuccagcucccgguucaccaacugggggagcgucucccugagccuggacgccgagggcaucuccgggagcaacuccuucagcuucaucgagagccccggcaagggcuacgccaucguggacgagcccuucuccgagaucccgcgccagggguuccucggcgagauccggugcaacagcgaguccagcgugcuguccgcccacgagagcugccugcgcgcgcccaaccucaucuccuacaagcccaugaucgaccagcuggagugcaccaccaaccugaucgaccccuucgucguguucgagcgggggagccucccgcagacgcgcaacgacaagaccuucgccgccuccaagggcaaccgcggggugcaggccuucagcaagggcuccguccaggccgaccugacccugauguucgacaacuucgagguggacuucgugggcgcggccgucagcugcgacgccgccuuccucaaccugaccgggugcuacuccugcaacgcgggcgcccgggugugccugagcaucacguccaccgggaccggcacccucagcgcccacaacaaggacggcucccugcacaucgugcugcccagcgagaacgggacgaaggaccagugccagauccuccacuucaccguccccgagguggaggaggaguucauguacuccugcgacggcgacgagcgcccccugcuggugaaggggacccucaucgccaucgacccguucgacgaccggcgcgaggccggcggggagagcaccgucgugaaccccaagagcggcuccuggaacuucuucgacugguucagcggccugauguccugguucgggggcccccugaagacgauccuccugaucugccuguacgucgcgcucagcaucgggcuguucuuccugcucaucuaccugggccggaccgggcuguccaagauguggcucgccgccaccaagaaggccagcuga

SEQ ID NO: 12857 - RNA, 3480 nt, Artificial Sequence
  derived and/or modified CDS sequence (opt1) from RVFV(clone 13)__DQ380213.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaagcacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagaaccccuccaccgagaucacccucaaguacccggggaucagccaguccagcggcggggacaucggcguccacauggcccacgacgaccaguccgugagcagcaagaucguggcccacugcccgccccaggaccccugccugguccacggcugcaucgugugcgcgcacgggcugaucaacuaccagugccacacggcccucuccgccuucguggucguguucguguucagcuccaucgccaucaucugccuggccauccuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggcuggauggagggcgggcagcugguccugggcaaccccgccccgaucccccgccacgcgcccaucccccgguacagcaccuaccucaugcugcugcucaucguguccuacgccagcgccugcuccgagcugauccaggccagcucccgcaucaccacgugcagcaccgagggggugaacaccaagugccggcuguccggcaccgcgcugauccgcgccgggagcgucggcgccgaggccugccucaugcugaagggggugaaggacgaccagacgaaguuccugaagaucaagaccguguccagcgagcucuccugccgggagggccagagcuacuggaccggcuccuucagcccgaagugccugagcucccgccggugccaccuggucggggagugccacgugaaccgcugccucagcuggcgggacaacgagaccuccgccgaguucagcuucgugggcgaguccacgaccaugcgcgagaacaagugcuucgagcagugcgggggcugggggugcggcugcuucaacgucaaccccagcugccuguucgugcacaccuaccugcaguccgugcggaaggaggcgcuccgcgucuucaacugcaucgacugggugcacaagcugacccuggagaucaccgacuucgacggcagcguguccacgaucgaccucggggccagcuccagccgguucaccaacuggggcuccgucagccugucccuggacgccgaggggaucagcggcuccaacagcuucuccuucaucgagagccccgggaagggcuacgccaucguggacgagcccuucagcgagaucccgcgccagggcuuccucggggagauccggugcaacuccgagagcuccgugcugagcgcccacgaguccugccugcgcgcgcccaaccucaucagcuacaagcccaugaucgaccagcuggagugcaccaccaaccugaucgaccccuucgucguguucgagcggggcucccucccgcagacgcgcaacgagaagaccuucgccgccagcaaggggaaccggggcgugcaggccuucuccaaggggagcguccaggccgaccugacccugauguucgacaacuucgagguggacuucgugggcgcggccgucuccugcgacgccgccuuccucaaccugaccggcugcuacagcugcaacgcgggggcccgcgugugccuguccaucacgagcaccggcaccgggacccucuccgcccacaacaaggacggcagccugcacaucgugcugcccuccgagaacggcacgaaggaccagugccagauccuccacuucaccguccccgagguggaggaggaguucauguacagcugcgacggggacgagcgcccccugcuggugaagggcacccucaucgccaucgacccguucgacgaccggcgcgaggccgggggcgaguccaccgucgugaaccccaagagcgggagcuggaacuucuucgacugguucuccggccugaugagcugguucggcgggccccugaagacgauccuccugaucugccuguacgucgcgcucuccaucggccuguucuuccugcucaucuaccuggggcggaccggccugagcaagauguggcucgccgccaccaagaaggccuccuga

SEQ ID NO: 12858 - RNA, 3480 nt, Artificial Sequence
  derived and/or modified CDS sequence (opt1) from RVFV(Kenya 57 (Rintoul))__DQ380192.1__NSm-Gn-Gc
augaucgagggcgccugggacagccugcgcgaggaggagaugcccgaggagcucuccugcagcaucuccgggauccgggaggugaagaccagcucccaggagcugcaccgcgcccugaaggcgaucaucgccgccgacggccucaacaacaucacgugccacgggaaggacccggaggacaagaucagccugaucaagggcccgccccacaagaagcgggucgggguggugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaucaagcgggagcucaagagcuucgacaucucccagugccccaagaucgggggccacggcagcaagaagugcaccggggacgccgccuucugcuccgccuacgagugcaccgcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucacgggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacaccgcccucagcgccuucgucgugguguucgucuucuccagcguggccaucaucugccuggccauccuguacaaggugcucaagugccugaagaucgcgccccgcaagguccugaacccccucauguggaucacggccuucauccgguggguguacaagaagaugguggcccgcgucgccgacaacaucaaccaggugaaccgggagaucggcuggauggagggcgggcagcuggugcugggcaaccccgccccgaucccccgccacgcgcccaucccccgcuacuccaccuaccucaugcugcugcucaucgucagcuacgccuccgccugcagcgagcugauccaggccuccagccggaucacgaccugcuccaccgagggggugaacaccaagugccgccugagcggcaccgcgcugauccgggccggguccgugggcgccgaggccugccucaugcugaagggggucaaggaggaccagaccaaguuccugaagaucaagacggugagcuccgagcucagcugccgcgagggccaguccuacuggaccggcagcuucagcccgaagugccuguccagccggcgcugccaccuggugggggagugccacgucaaccggugccucuccuggcgcgacaacgagaccagcgccgaguucuccuucgugggcgagagcaccacgaugcgggagaacaagugcuucgagcagugcgggggcugggggugcggcugcuucaacgugaaccccuccugccuguucguccacaccuaccugcagagcgugcgcaaggaggcgcuccggguguucaacugcaucgacuggguccacaagcugacccuggagaucaccgacuucgacggcuccgugagcaccguggaccucggggccuccagcucccgcuucacgaacuggggcagcgucucccugagccuggacgccgaggggaucuccggcagcaacuccuucagcuucaucgagagccccgggaagggcuacgccaucguggacgagcccuucuccgagaucagccggcagggcuuccucggggagauccgcugcaacuccgagagcuccgugcugagcgcccacgaguccugccugcgggcgccgaaccucaucagcuacaagcccaugaucgaccagcuggagugcaccaccaaccugaucgaccccuucgucguguucgagcgcggcucccucccccagacccggaacgacaagacguucgccgccagcaaggggaaccgcggcgugcaggccuucuccaaggggagcguccaggccgaccugacccugauguucgacaacuucgagguggacuucgugggcgcggccgucuccugcgacgccgccuuccucaaccugaccggcugcuacagcugcaacgcgggggcccgggugugccuguccaucaccagcacgggcaccgggacccucuccgcccacaacaaggacggcagccugcacaucgugcugccguccgagaacggcaccaaggaccagugccagauccuccacuucacgguccccgagguggaggaggaguucauguacagcugcgacggggacgagcgcccccugcuggucaagggcacccucaucgccaucgaccccuucgacgaccgccgggaggccgggggcgagagcaccguggugaacccgaaguccgggagcuggaacuucuucgacugguucuccggccugaugagcugguucggcgggccccugaagaccauccuccugaucugccuguacgucgcgcucuccaucggccuguucuuccugcucaucuaccuggggcgcacgggccugagcaagauguggcucgccgccaccaagaaggccuccuga

SEQ ID NO: 12859 - RNA, 3480 nt, Artificial Sequence
  derived and/or modified CDS sequence (opt1) from RVFV(2007001292)__EU574046.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccugggcaaccccgcgccgaucccccgccacgcccccaucccccgguacuccaccuaccucaugcugcugcucaucgugagcuacgccuccgccugcagcgagcugauccaggcguccagccgcaucacgaccugcuccaccgagggggugaacaccaagugccggcugagcggcacggcccugauccgcgccggguccgucggcgccgaggccugccucaugcugaagggggugaaggaggaccagaccaaguuccugaagaucaagaccgugagcuccgagcucagcugccgggagggccaguccuacuggaccggcagcuucagcccgaagugccuguccagccgccggugccaccuggucggggagugccacgugaaccgcugccucuccuggcgggacaacgagacgagcgcggaguucuccuucgugggcgagagcaccaccaugcgcgagaacaagugcuucgagcagugcgggggcugggggugcggcugcuucaacgucaaccccuccugccuguucgugcacaccuaccugcagagcgugcggaaggaggcccuccgcgucuucaacugcaucgacugggugcacaagcugacccuggagaucacggacuucgacggcuccgugagcaccaucgaccucggggccuccagcucccgguucaccaacuggggcagcgucucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcgugcuguccgcgcacgagagcugccugcgcgcccccaaccucgucuccuacaagcccaugaucgaccagcuggagugcaccacgaaccugaucgaccccuucgugguguucgagcggggcagccucccgcagacccgcaacgacaagaccuucgccgccuccaaggggaaccggggcguccaggccuucagcaagggguccgugcaggcggaccugacccugauguucgacaacuucgagguggacuucgucggcgccgccgugagcugcgacgccgcguuccucaaccugacgggcugcuacuccugcaacgccggggcccgcgugugccugagcaucaccuccaccggcaccgggacgcucagcgcccacaacaaggacggcucccugcacaucguccugcccagcgagaacggcaccaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcacgguggucaaccccaagagcggguccuggaaccuguucgacugguucagcggccugauguccugguucggcgggccccucaagaccauccugcugaucugccucuacguggcccugagcaucggccuguucuuccuccugaucuaccuggggcggaccggccucuccaagauguggcuggccgccaccaagaaggccagcuga

SEQ ID NO: 12860 - RNA, 3480 nt, Artificial Sequence
  derived and/or modified CDS sequence (opt1) from RVFV(2007001811)__EU574040.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggggucaacaccaagugccggcugagcggcaccgcgcugauccgcgccggguccgugggcgccgaggccugccucaugcugaagggggugaaggaggaccagacgaaguuccugaugaucaagaccgucagcuccgagcucagcugccgggagggccaguccuacuggaccggcagcuucagcccgaagugccuguccagccgccggugccaccuggugggggagugccacgugaaccgcugccucuccuggcgggacaacgagaccagcgccgaguucuccuucgucggcgagagcacgaccaugcgcgagaacaagugcuucgagcagugcgggggcugggggugcggcugcuucaacgugaaccccuccugccuguucgugcacaccuaccugcagagcguccggaaggaggcgcuccgcguguucaacugcaucgacugggugcacaagcugacccuggagaucaccgacuucgacggcuccgucagcacgaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccgcgccagggcuuccucggggagauccggugcaacagcgaguccagcguccuguccgcccacgagagcugccugcgcgcgcccaaccucaucuccuacaagcccaugaucgaccagcuggagugcaccaccaaccugaucgaccccuucgugguguucgagcggggcagccucccgcagacgcgcaacgagaagaccuucgccgccuccaaggggaaccggggcguccaggccuucagcaagggguccgugcaggccgaccugacccugauguucgacaacuucgagguggacuucgucggcgcggccgugagcugcgacgccgccuuccucaaccugaccggcugcuacuccugcaacgcgggggcccgcgugugccugagcaucacguccaccggcaccgggacccucagcgcccacaacaaggacggcucccugcacaucguccugcccagcgagaacggcacgaaggaccagugccagauccuccacuucaccgugcccgagguggaggaggaguucauguacuccugcgacggggacgagcgcccccugcuggucaagggcacccucaucgccaucgacccguucgacgaccggcgcgaggccgggggcgagagcaccguggucaaccccaagagcggguccuggaacuucuucgacugguucagcggccugauguccugguucggcgggccccugaagacgauccuccugaucugccuguacguggcgcucagcaucggccuguucuuccugcucaucuaccuggggcggaccggccuguccaagauguggcucgccgccaccaagaaggccagcuga

SEQ ID NO: 12861 - RNA, 3480 nt, Artificial Sequence
  derived and/or modified CDS sequence (opt1) from RVFV(ANK-6087)__DQ380216.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaagcuggacuccggccagaccaagcgggagcucaagagcuucgacaucucccagugccccaagaucgggggccacggcagcaagaagugcaccggggacgccgccuucugcuccgccuacgagugcaccgcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccucguggugcggagcaccggcuucaagaucuccagcgcggucgccugcgccuccggggugugcgugacgggcagccagucccccagcaccgagaucacccugaaguacccggggaucucccagagcuccggcggggacaucggcguccacauggcccacgacgaccagagcgugagcuccaagaucguggcccacugcccgccccaggaccccugccugguccacggcugcaucgugugcgcgcacgggcucaucaacuaccagugccacaccgcccugagcgccuucguggucguguucguguucuccagcaucgccaucaucugccuggccauccucuaccgcguccugaagugccugaagaucgcgccccggaaggugcucaacccccugauguggaucacggccuucauccgcuggguguaccggaagauggucgcccgcguggccgacaacaucaaccaggugaaccgcgagaucggcuggauggagggcgggcagcugguccucggcaaccccgccccgaucccccggcacgugcccaucccccgcuacuccaccuaccugaugcugcuccugaucgugagcuacgcguccgccugcagcgagcugauccaggccuccagccggaucacgaccugcuccaccgagggggucaacaccaagugccgccugagcggcaccgcccucauccgggcgggguccgugggcgccgaggccugccugaugcugaagggggugaaggaggaccagaccaaguuccucaagaucaagacggucagcuccgagcugagcugccgcgagggccaguccuacuggaccggcagcuucagcccgaagugccuguccagccggcgcugccaccucgugggggagugccacgugaaccggugccuguccuggcgcgacaacgagaccagcgccgaguucuccuucgucggcgagagcaccacgaugcgggagaacaagugcuucgagcagugcgggggcugggggugcggcugcuucaacgugaaccccuccugccuguucgugcacaccuaccuccagagcguccgcaaggaggcccugcggguguucaacugcaucgacugggugcacaagcugacccucgagaucaccgacuucgacggcuccgucagcaccaucgaccugggggcguccagcucccgcuucacgaacuggggcagcgugucccugagccucgacgccgaggggaucuccggcagcaacuccuucagcuucaucgagagccccgggaagggcuacgccaucguggacgagcccuucuccgagaucccgcggcagggcuuccugggggagauccgcugcaacagcgaguccagcguccuguccgcccacgagagcugccuccgggcccccaaccugaucuccuacaagcccaugaucgaccagcuggagugcagcaccaaccucaucgaccccuucgugguguucaagcgcggcucccugccgcagacccggaacgacaagaccuucgcggccagcaaggggaaccgcggcguccaggccuucuccaaggggagcgugcaggccgaccugacgcucauguucgacaacuucgagguggacuucgucggcgccgcgguguccugcgacgccgccuuccugaaccugaccggcugcuacagcugcaacgccggggcgcgcgugugccucuccaucaccagcaccggcacggggacccuguccgcccacaacaaggacggcagccugcacaucguccuccccuccgagaacggcaccaaggaccagugccagauccugcacuucaccgugcccgagguggaggaggaguucauguacagcugcgacggggacgagcggccccugcucguccgcggcacgcugaucgccaucgacccguucgacgaccggcgcgaggccgggggcgagagcaccguggucaaccccaaguccgggagcuggaacuucuucgacugguucuccggccugaugagcugguucggcgggccccucaagaccauccugcugaucugccucuacguggcccuguccaucggccuguucuuccuccugaucuaccuggggcggaccggccucagcaagauguggcuggcggccacgaagaaggccuccuga

SEQ ID NO: 12862 - RNA, 3480 nt, Artificial Sequence
  derived and/or modified CDS sequence (opt1) from RVFV(2007000234)__JF326191.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagauccgccgggagaccauggccggcaucgcgaugaccguccugcccgcccucgccguguucgcccuggcgcccguggucuucgccgaggacccccaccuccgcaaccggcccggcaaggggcacaacuacaucgacggcaugacccaggaggacgcgaccugcaagcccgugacguacgccggggccugcuccagcuucgacgugcugcuggagaagggcaaguucccgcuguuccaguccuacgcccaccaccgcacccuccuggaggccguccacgacaccaucaucgccaaggccgacccgcccagcugcgaccugcaguccgcccacgggaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccggcagaugaccggcgccagccucaagaagggguccuacccccugcaggaccuguucugccagagcuccgaggacgacggcagcaagcucaagaccaagaugaagggggucugcgaggugggcgugcaggcccugaagaagugcgacggccagcuguccaccgcccacgaggucgugcccuucgcgguguucaagaacagcaagaaggucuaccucgacaagcuggaccugaagacggaggagaaccuccugcccgacagcuucgugugcuucgagcacaaggggcaguacaagggcaccauggacuccgggcagaccaagcgcgagcucaagagcuucgacaucucccagugccccaagaucggcgggcacggcagcaagaagugcaccggcgacgccgccuucugcuccgccuacgagugcacggcccaguacgcgaacgccuacugcagccacgccaacggguccggcaucgugcagauccaggucagcgggguguggaagaagccccugugcgugggcuacgagcgggucguggucaagcgcgagcuguccgccaagccgauccagcggguggagcccugcacgaccugcaucaccaagugcgagccccacgggcuggugguccgcagcaccggcuucaagaucuccagcgcgguggccugcgccuccggcgugugcgucaccgggagccagucccccagcaccgagaucacccucaaguacccgggcaucucccagagcuccgggggcgacaucggggugcacauggcccacgacgaccagagcgugagcuccaagaucgucgcccacugcccgccccaggaccccugccuggugcacggcugcaucgugugcgcgcacggccugaucaacuaccagugccacacggcccucagcgccuucgucgugaucuucguguucuccagcaccgccaucaucugccuggccguccuguaccgggugcucaagugccugaagaucgcgccccgcaaggugcugaacccccucauguggaucaccgccuucauccggugggucuacaagaagaugguggcccgcguggccgacaacaucaaccaggucaaccgcgagaucggguggauggagggcgggcagcuggcccugggcaaccccgcgccgaucccccggcacgcccccaucccccgcuacuccaccuaccucaugcugcugcucaucgugagcuacgccuccgccugcagcgagcugauccaggcguccagccggaucacgaccugcuccaccgagggcgugaacaccaagugccgccugagcgggacggcccugauccgggccggcuccgucggggccgaggccugccucaugcugaagggcgugaaggaggaccagaccaaguuccugaagaucaagaccgugagcuccgagcucagcugccgcgaggggcaguccuacuggaccggcagcuucagcccgaagugccuguccagccggcgcugccaccuggucggcgagugccacgugaaccggugccucuccuggcgcgacaacgagacgagcgcggaguucuccuucgugggggagagcaccaccaugcgggagaacaagugcuucgagcagugcggcggguggggcugcgggugcuucaacgucaaccccuccugccuguucgugcacaccuaccugcagagcgugcgcaaggaggcccuccgggucuucaacugcaucgacugggugcacaagcugacccuggagaucacggacuucgacggcuccgugagcaccaucgaccucggcgccuccagcucccgcuucaccaacugggggagcgucucccugagccuggacgccgagggcaucuccgggagcaacuccuucagcuucaucgagagccccggcaagggguacgccaucguggacgagcccuucuccgagaucccgcggcagggcuuccucggcgagauccgcugcaacagcgaguccagcgugcuguccgcgcacgagagcugccugcgggcccccaaccucgucuccuacaagcccaugaucgaccagcuggagugcaccacgaaccugaucgaccccuucgugguguucgagcgcgggagccucccgcagacccggaacgacaagaccuucgccgccuccaagggcaaccgcgggguccaggccuucagcaagggcuccgugcaggcggaccugacccugauguucgacaacuucgagguggacuucgucggggccgccgugagcugcgacgccgcguuccucaaccugacgggcugcuacuccugcaacgccggcgcccgcgugugccugagcaucaccuccaccgggaccggcacgcucagcgcccacaacaaggacgggucccugcacaucguccugcccagcgagaacggcaccaaggaccagugccagauccuccacuucaccgugcccgagguggaggaggaguucauguacuccugcgacggcgacgagcggccccugcuggucaaggggacccucaucgccaucgacccguucgacgaccgccgggaggcgggcggggagagcacgguggucaaccccaagagcggcuccuggaacuucuucgacugguucagcgggcugauguccugguucggcggcccccugaagaccauccuccugaucugccuguacguggcccucagcaucgggcuguucuuccugcucaucuaccugggccgcaccgggcuguccaagauguggcucgccgccaccaagaaggccagcuga

SEQ ID NO: 12863 - RNA, 3480 nt, Artificial Sequence
  derived and/or modified CDS sequence (opt1) from RVFV(SA-75)__DQ380189.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccuggucaagggcccgccccacaagaagcggguggggaucgugcgcugcgagcggcgccgggacgccaagcagaucggccgcgagaccauggcccggaucgcgaugaccguccugcccgcccucgccguguucgcccuggcgcccguggucuucgccgaggacccccaccuccgcaaccggcccggcaaggggcacaacuacaucgacggcaugacccaggaggacgcgaccugcaagcccgugacguacgccggggccugcuccagcuucgacgugcugcuggagaagggcaaguucccgcuguuccaguccuacgcccaccaccgcacccuccuggaggccguccacgacaccaucaucgccaaggccgacccgcccagcugcgaccugcaguccgcccacgggaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccggcagaugaccggcgccagccucaagaagggguccuacccccugcaggaccuguucugccagagcuccgaggacgacggcagcaagcucaagaccaagaugaagggggucugcgaggugggcgugcaggcccugaagaagugcgacggccagcuguccaccgcccacgaggucgugcccuucgcgguguucaagaacagcaagaaggucuaccucgacaagcuggaccugaagacggaggagaaccuccugcccgacagcuucgugugcuucgagcacaaggggcaguacaagggcaccauggacuccgggcagaccaagcgcgagcucaagagcuucgacaucucccagugccccaagaucggcgggcacggcagcaagaagugcaccggcgacgccgccuucugcuccgccuacgagugcacggcccaguacgcgaacgccuacugcagccacgccaacggguccggcgugguccagauccaggugagcgggguguggaagaagccccugugcgucggcuacgagcggguggucgugaagcgcgagcuguccgccaagccgauccagcggguggagcccugcacgaccugcaucaccaagugcgagccccacgggcuggucgugcgcagcaccggcuucaagaucuccagcgcgguggccugcgccuccggcgucugcgugaccgggagccagucccccagcaccgagaucacccucaaguacccgggcaucucccagagcuccgggggcgacaucggggugcacauggcccacgacgaccagagcgucagcuccaagaucguggcccacugcccgccccaggaccccugccuggugcacggcugcaucgucugcgcgcacggccugaucaacuaccagugccacacggcccucagcgccuucgugguggucuucguguucuccagcguggccaucaucugccuggccauccuguacaagguccucaagugccugaagaucgcgccccggaaggugcugaacccccucauguggaucaccguguucauccgcugggucuacaagaagaugguggcccggguggccgacaacaucaaccaggucaaccgcgagaucggguggauggagggcgggcagcuggcccugggcaaccccgccccgaucccccgccacgcgcccaucccccgguacuccaccuaccucaugcugcugcucaucgugagcuacgccuccgccugcagcgagcugauccaggccuccagccgcaucaccacgugcuccaccgagggcgugaacaccaagugccggcugagcgggaccgcgcugauccgcgccggcuccgucggggccgaggccugccucaugcugaagggcgugaaggaggaccagacgaaguuccugaagaucaagaccgugagcuccgagcucagcugccgggaggggcaguccuacuggaccggcagcuucagcccgaagugccuguccagccgccggugccaccuggucggcgagugccacgugaaccgcugccucuccuggcgggacaacgagaccagcgccgaguucuccuucgugggggagagcacgaccaugcgcgagaacaagugcuucgagcagugcggcggguggggcugcgggugcuucaacgucaaccccuccugccuguucgugcacaccuaccugcagagcgugcggaaggaggcgcuccgcgucuucaacugcaucgacugggugcacaagcugacccuggagaucaccgacuucgacggcuccgugagcacgaucgaccucggcgccuccagcucccgguucaccaacugggggagcgucucccugagccuggacgccgagggcaucuccgggagcaacuccuucagcuucaucgagagccccggcaagggguacgccaucguggacgagcccuucuccgagaucccgcgccagggcuuccucggcgagauccggugcaacagcgaguccagcgugcuguccgcccacgagagcugccugcgcgcgcccaaccucaucuccuacaagcccaugaucgaccagcuggagugcaccaccaaccugaucgaccccuucgucguguucgagcgggggagccucccgcagacgcgcaacgacaagaccuucgccgccuccaagggcaaccgcggggugcaggccuucagcaagggcuccguccaggccgaccugacccugauguucgacaacuucgagguggacuucgugggggcggccgucagcugcgacgccgccuuccucaaccugaccggcugcuacuccugcaacgcgggcgcccgggugugccugagcaucacguccaccgggaccggcacccucagcgcccacaacaaggacgggucccugcacaucgugcugcccagcgagaacggcacgaaggaccagugccagauccuccacuucaccguccccgagguggaggaggaguucauguacuccugcgacggcgacgagcgcccccugcuggucaaggggacccucaucgccaucgacccguucgacgaccggcgcgaggccggcggggagagcaccguggugaaccccaagagcggcuccuggaacuucuucgacugguucagcgggcugauguccugguucggcggcccccugaagacgauccuccugaucugccuguacgucgcgcucagcaucgggcuguucuuccugcucaucuaccugggccggaccgggcuguccaagauguggcucgccgccaccaagaaggccagcuga

SEQ ID NO: 12864 - RNA, 3480 nt, Artificial Sequence
  derived and/or modified CDS sequence (opt1) from RVFV(KEN07-KUR340)__EF460404.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcgcaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugccuggugcacggcugcaucgugugcgcgcacgggcugaucaacuaccagugccacacggcccucagcgccuucgucgugaucuucguguucuccagcaccgccaucaucugccuggccguccuguaccgcaugcucaagugccugaagaucgcgccccggaucgugcugaacccccucauguggaucaccgccuucauccgcuggguguacaagaagauggucgcccggguggccgacaacaucaaccaggugaaccgcgagaucggcuggauggagggcgggcagcuggcccugggcaaccccgcgccgaucccccgccacgcccccaucccccgguacuccaccuaccucaugcugcugcucaucgucagcuacgccuccgccugcagcgagcugauccaggcguccagccgcaucacgaccugcuccaccgagggggugaacaccaagugccggcugagcggcacggcccugauccgcgccggguccgugggcgccgaggccugccucaugcugaagggggucaaggaggaccagaccaaguuccugaagaucaagaccgugagcuccgagcucagcugccgggagggccaguccuacuggaccggcagcuucagcccgaagugccuguccagccgccggugccaccuggugggggagugccacgucaaccgcugccucuccuggcgggacaacgagacgagcgcggaguucuccuucgugggcgagagcaccaccaugcgcgagaacaagugcuucgagcagugcgggggcugggggugcggcugcuucaacgugaaccccuccugccuguucguccacaccuaccugcagagcgugcggaaggaggcccuccgcguguucaacugcaucgacuggguccacaagcugacccuggagaucacggacuucgacggcuccgugagcaccaucgaccucggggccuccagcucccgguucaccaacuggggcagcgugucccugagccuggacgccgaggggaucuccggcagcaacuccuucagcuucaucgagagccccgggaagggcuacgccaucgucgacgagcccuucuccgagaucccgcgccagggcuuccucggggagauccggugcaacagcgaguccagcgugcuguccgcgcacgagagcugccugcgcgcccccaaccucguguccuacaagcccaugaucgaccagcuggagugcaccacgaaccugaucgaccccuucgucguguucgagcggggcagccucccgcagacccgcaacgacaagaccuucgccgccuccaaggggaaccggggcgugcaggccuucagcaagggguccguccaggcggaccugacccugauguucgacaacuucgagguggacuucgugggcgccgccgucagcugcgacgccgcguuccucaaccugacgggcugcuacuccugcaacgccggggcccgcgugugccugagcaucaccuccaccggcaccgggacgcucagcgcccacaacaaggacggcucccugcacaucgugcugcccagcgagaacggcaccaaggaccagugccagauccuccacuucaccguccccgagguggaggaggaguucauguacuccugcgacggggacgagcgcccccugcuggugaagggcacccucaucgccaucgacccguucgacgaccggcgcgaggccgggggcgagagcacggucgugaaccccaagagcggguccuggaacuucuucgacugguucagcggccugauguccugguucggcgggccccugaagaccauccuccugaucugccuguacgucgcccucagcaucggccuguucuuccugcucaucuaccuggggcggaccggccuguccaagauguggcucgccgccaccaagaaggccagcuga

SEQ ID NO: 12865 - RNA, 3480 nt, Artificial Sequence
  derived and/or modified CDS sequence (opt1) from RVFV(35/74)__JF784387.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccuggucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccggggugguccagauccaggugagcggcguguggaagaagccccugugcgucggguacgagcgcguggucgugaagcgggagcuguccgccaagccgauccagcgcguggagcccugcacgaccugcaucaccaagugcgagccccacggccuggucgugcggagcaccggcuucaagaucuccagcgcgguggccugcgccuccggggucugcgugaccggcagccagucccccagcaccgagaucacccucaaguacccggggaucucccagagcuccggcggggacaucggcgugcacauggcccacgacgaccagagcgucagcuccaagaucguggcccacugcccgccccaggaccccugccuggugcacggcugcaucgucugcgcgcacgggcugaucaacuaccagugccacacggcccucagcgccuucgugguggucuucguguucuccagcguggccaucaucugccuggccauccuguacaagguccucaagugccugaagaucgcgccccgcaaggugcuggacccccucauguggaucaccguguucauccggugggucuacaagaagaugguggcccgcguggccgacaacaucaaccaggucaaccgggagaucggcuggauggagggcgggcagcuggcccugggcaaccccgccccgaucccccgccacgcgcccaucccccgcuacuccaccuaccucaugcugcugcucaucgugagcuacgccuccgccugcagcgagcugauccaggccuccagccggaucaccacgugcuccaccgagggggugaacaccaagugccgccugagcggcaccgcgcugauccgggccggguccgucggcgccgaggccugccucaugcugaagggggugaaggaggaccagacgaaguuccugaagaucaagaccgugagcuccgagcucagcugccgcgagggccaguccuacuggaccggcagcuucagcccgaagugccuguccagccggcgcugccaccuggucggggagugccacgugaaccggugccucuccuggcgcgacaacgagaccagcgccgaguucuccuucgugggcgagagcacgaccaugcgggagaacaagugcuucgagcagugcgggggcugggggugcggcugcuucaacgucaaccccuccugccuguucgugcacaccuaccugcagagcgugcgcaaggaggcgcuccgggucuucaacugcaucgacugggugcacaagcugacccuggagaucaccgacuucgacggcuccgugagcacgaucgaccucggggccuccagcucccgcuucaccaacuggggcagcgucucccugagccuggacgccgaggggaucuccggcagcaacuccuucagcuucaucgagagccccgggaagggcuacgccaucguggacgagcccuucuccgagaucccgcggcagggcuuccucggggagauccgcugcaacagcgaguccagcgugcuguccgcccacgagagcugccugcgggcgcccaaccucaucuccuacaagcccaugaucgaccagcuggagugcaccaccaaccugaucgaccccuucgucguguucgagcgcggcagccucccgcagacgcggaacgacaagaccuucgccgccuccaaggggaaccgcggcgugcaggccuucagcaagggguccguccaggccgaccugacccugauguucgacaacuucgagguggacuucgugggcgcggccgucagcugcgacgccgccuuccucaaccugaccggcugcuacuccugcaacgcgggggcccgggugugccugagcaucacguccaccggcaccgggacccucagcgcccacaacaaggacggcucccugcacaucgugcugcccagcgagaacggcacgaaggaccagugccagauccuccacuucaccguccccgagguggaggaggaguucauguacuccugcgacggggacgagcgcccccugcuggucaagggcacccucaucgccaucgacccguucgacgaccgccgggaggccgggggcgagagcaccguggugaaccccaagagcggguccuggaacuucuucgacugguucagcggccugauguccugguucggcgggccccugaagacgauccuccugaucugccuguacgucgcgcucagcaucggccuguucuuccugcucaucuaccuggggcgcaccggccuguccaagauguggcucgccgccaccaagaaggccagcuga

SEQ ID NO: 12866 - RNA, 3480 nt, Artificial Sequence
  derived and/or modified CDS sequence (opt1) from RVFV(200803167)__JF311382.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgccgguggucuucgccgaggaccugcaccuccggaaccgccccgggaagggccacaacuacaucgacgggaugacccaggaggacgcgaccugcaagcccgugacguacgccggcgccugcuccagcuucgacgugcugcuggagaaggggaaguucccccucuuccaguccuacgcgcaccaccggacccugcuggaggccguccacgacaccaucaucgccaaggccgacccgcccagcugcgaccuccaguccgcccacggcaaccccugcaugaaggagaagcuggugaugaagacccacugccccaacgacuaccagagcgcgcacuaccugaacaacgacggcaagauggccuccgugaagugcccgcccaaguacgagcucacggaggacugcaacuucugccgccagaugaccggggccagccugaagaagggcuccuacccccugcaggaccucuucugccagagcuccgaggacgacgggagcaagcugaagaccaagaugaagggcgucugcgaggugggcgugcaggcccugaagaagugcgacgggcagcucuccaccgcccacgaggucgugcccuucgcgguguucaagaacagcaagaaggucuaccuggacaagcuggaccucaagacggaggagaaccugcugccggacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagcccauccagcgcguggagccgugcacgaccugcaucaccaagugcgagccccacggccucgugguccggagcaccggcuucaagaucuccagcgcgguggccugcgccuccggggugugcgucaccggcagccagucccccagcaccgagaucgcccugaaguaccccgggaucucccagagcuccggcggggacaucggcgugcacauggcccacgacgaccagagcgugagcuccaagaucgucgcgcacugcccgccccaggaccccugccuggugcacggcugcaucgugugcgcccacgggcucaucaacuaccagugccacaccgcccugagcgccuucgucgugguguucgucuucuccagcaucgccaucaucugccuggcgauccucuaccgcgugcugaagugccugaagaucgcgccccggaaggugcucaacccgcugauguggaucacggccuucauccgcugggucuacaagaagaugguggcccggguggccgacaacaucaaccaggucaaccgcgagaucggcuggauggagggcgggcagcuggugcucggcaaccccgcccccaucccgcgccacgcccccaucccccgguacuccaccuaccugaugcugcuccugaucgugagcuacgccuccgccugcagcgagcugauccaggcguccagccgcaucacgaccugcuccaccgagggggucaacaccaagugccggcugagcggcaccgcccucauccgcgccggguccgugggcgccgaggccugccugaugcugaagggggugaaggaggaccagaccaaguuccucaagaucaagacggucagcuccgagcugagcugccgggagggccaguccuacuggaccggcagcuucagccccaagugccuguccagccgccggugccaccucgugggggagugccacgugaaccgcugccuguccuggcgggacaacgagaccagcgcggaguucuccuucgucggcgagagcaccacgaugcgcgagaacaagugcuucgagcagugcgggggcugggggugcggcugcuucaacgugaacccguccugccuguucgugcacaccuaccuccagagcguccggaaggaggcccugcgcguguucaacugcaucgacugggugcacaagcugacccucgagaucaccgacuucgacggcuccgucagcaccaucgaccugggggccuccagcucccgguucacgaacuggggcagcgugucccugagccucgacgccgaggggaucuccggcagcaacuccuucagcuucaucgagagccccgggaagggcuacgccaucguggacgagcccuucuccgagaucccccgccagggcuuccugggggagauccggugcaacagcgaguccagcguccuguccgcgcacgagagcugccuccgcgccccgaaccugaucuccuacaagcccaugaucgaccagcuggagugcaccaccaaccucaucgaccccuucgugguguucgagcggggcagccugccccagacccgcaacgacaagacguucgccgccuccaaggggaaccggggcguccaggccuucagcaagggguccgugcaggcggaccugacccucauguucgacaacuucgagguggacuucgucggcgccgccgugagcugcgacgccgcguuccugaaccugaccggcugcuacuccugcaacgccggggcccgcgugugccucagcaucaccuccacgggcaccgggacccugagcgcccacaacaaggacggcucccugcacaucguccucccgagcgagaacggcaccaaggaccagugccagauccugcacuucacggugcccgagguggaggaggaguucauguacuccugcgacggggacgagcgcccccugcucgucaagggcacccugaucgccaucgaccccuucgacgaccggcgcgaggccgggggcgagagcaccguggucaaccccaagagcggguccuggaacuucuucgacugguucagcggccugauguccugguucggcgggccccucaagaccaugcugcugaucugccucuacguggcccugagcaucggccuguucuuccuccugaucuaccuggggcggacgggccucuccaagauguggcuggccgccaccaagaaggccagcuga

SEQ ID NO: 12867 - RNA, 3480 nt, Artificial Sequence
  derived and/or modified CDS sequence (opt1) from RVFV(25010-24)__KM210509.1__NSm-Gn-Gc
augaucgagcgcgccugggacagccugcgggaggaggagaugcccgaggagcucuccugcagcaucuccggcauccgcgaggugaagaccagcucccaggagcuguaccgggcccugaaggcgaucaucgccgccgacgggcucaacaacaucacgugccacggcaaggacccggaggacaagaucagccugaucaaggggccgccccacaagaagcgcgucggcaucgugcggugcgagcgccggcgcgacgccaagcaggucgggcgggagaccauggccggcaucgcgaugaccgugcugcccgcccucgccguguucgcccuggcgcccguggucuucgccgaggacccccaccuccgcaaccggcccggcaaggggcacaacuacaucgacggcaugacccaggaggacgcgaccugcaagcccgugacguacgccggggccugcuccagcuucgacgugcugcuggagaagggcaaguucccgcuguuccaguccuacgcccaccaccgcacccuccuggaggccguccacgacaccaucaucgccaaggccgacccgcccagcugcgaccugcaguccgcccacgggaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccggcagaugaccggcgccagccucaagaagggguccuacccccugcaggaccuguucugccagagcuccgaggacgacggcagcaagcucaagaccaagaugaagggggucugcgaggugggcgugcaggcccugaagaagugcgacggccagcuguccaccgcccacgaggucgugcccuucgcgguguucaagaacagcaagaaggucuaccucgacaagcuggaccugaagacggaggagaaccuccugcccgacagcuucgugugcuucgagcacaaggggcaguacaagggcaccauggacuccgggcagaccaagcgcgagcucaagagcuucgacaucucccagugccccaagaucggcgggcacggcagcaagaagugcaccggcgacgccgccuucugcuccgccuacgagugcacggcccaguacgcgaacgccuacugcagccacgccaacggguccggcaucgugcagauccaggucagcgggguguggaagaagccccugugcgugggcuacgagcgggucguggucaagcgcgagcuguccgccaagccgauccagcggguggagcccugcacgaccugcaucaccaagugcgagccccacgggcugaucgugcgcagcaccggcuucaagaucuccagcgcggucgccugcgccuccggcgugugcgugaccgggagccagucccccagcaccgagaucacccucaaguacccgggcaucucccagagcuccgggggcgacaucgggguccacauggcccacgacgaccagagcgugagcuccaagaucguggcccacugcccgccccaggaccccugccugguccacggcugcaucgugugcgcgcacggccugaucaacuaccagugccacacggcccucagcgccuucguggucguguucguguucuccagcgucgccaucaucugccuggccauccuguacaaggugcucaagugccugaagaucgcgcccaagaaggugcugaacccccucauguggaucaccgccuucauccggugggucuacaagaagaugguggcccgcguggccgacaacaucaaccaggucaaccgggagaucggguggauggagggcgggcagcuggcccugggcaaccccgcgccgaucccccgccacgcccccaucccccgcuacuccaccuaccucaugcugcugcucaucgugagcuacgccuccgccugcagcgagcugauccaggcguccagccggaucaccacgugcuccaccgagggcgugaacaccaagugccgccugagcgggaccgcccugauccgggccggcuccgucggggccgaggccugccucaugcugaagggcgugaaggacgaccagacgaaguuccugaagaucaagaccgugagcuccgagcucagcugccgcgaggggcaguccuacuggaccggcagcuucagcccgaagugccuguccagccggcgcugccaccuggucggcgagugccacgugaaccggugccucuccuggcgcgacaacgagaccagcgcggaguucuccuucgugggggagagcacgaccaugcgggagaacaagugcuucgagcagugcggcggguggggcugcgggugcuucaacgucaaccccuccugccuguucgugcacaccuaccugcagagcgugcgcaaggaggcccuccgggucuucaacugcaucgacugggugcacaagcugacccuggagaucaccgacuucgacggcuccgugagcacgaucgaccucggcgccuccagcucccgcuucaccaacugggggagcgucucccugagccuggacgccgagggcaucuccgggagcaacuccuucagcuucaucgagagccccggcaagggguacgccaucguggacgagcccuucuccgagaucccgcggcagggcuuccucggcgagauccgcugcaacagcgaguccagcgugcuguccgcgcacgagagcugccugcgggcccccaaccucaucuccuacaagcccaugaucgaccagcuggagugcaccaccaaccugaucgaccccuucgucguguucgagcgcgggagccucccgcagacgcggaacgacaagaccuucgccgccuccaagggcaaccgcggggugcaggccuucagcaagggcuccguccaggcggaccugacccugauguucgacaacuucgagguggacuucgugggggccgccgucagcugcgacgccgcguuccucaaccugaccggcugcuacuccugcaacgccggcgcccgggugugccugagcaucacguccaccgggaccggcacccucagcgcccacaacaaggacgggucccugcacaucgugcugcccagcgagaacggcacgaaggaccagugccagauccuccacuucaccguccccgagguggaggaggaguucauguacuccugcgacggcgacgagcgcccccugcuggugaaggggacccucaucgccaucgacccguucgacgaccgccgggaggcgggcggggagagcaccgucgugaaccccaagagcggcuccuggaacuucuucgacugguucagcgggcugauguccugguucggcggcccccugaagacgauccuccugaucugccuguacgucgcccucagcaucgggcuguucuuccugcucaucuaccugggccgcaccgggcuguccaagauguggcucgccgccaccaagaaggccagcuga

SEQ ID NO: 12868 - RNA, 3480 nt, Artificial Sequence
  derived and/or modified CDS sequence (opt1) from RVFV(Sudan 2V-2007)__JQ820490.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgcgucguggucaagcgggagcuguccgccaagccgauccagcgcguggagcccugcacgaccugcaucaccaagugcgagccccacggccuggugguccggagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucgcccacugcccgccccaggaccccugcagcgugcacggcugcaucgugugcgcgcacgggcugaucaacuaccagugccacacggcccuguccgccuucgucgugguguucgucuucagcuccaucgccaucaucugccucgccauccuguaccgcgugcugaagugccucaagaucgcgccccggaaggugcugaacccccugauguggaucaccgccuucauccgcugggucuacaagaagaugguggcccggguggccgacaacaucaaccaggucaaccgcgagaucggcuggauggagggcgggcagcucgugcugggcaaccccgccccgaucccccgccacgcgcccaucccccgguacagcaccuaccugaugcuccugcugaucgugucccacgccagcgccugcuccgagcucauccaggccagcucccgcaucaccacgugcagcaccgagggggucaacaccaagugccggcuguccggcaccgcgcugauccgcgccgggagcgugggcgccgaggccugccugaugcucaagggggugaaggaggaccagacgaaguuccugaagaucaagaccgucuccagcgagcuguccugccgggagggccagagcuacuggaccggcagcuucuccccgaagugccucagcucccgccggugccaccuggugggggagugccacgugaaccgcugccugagcuggcgggacaacgagaccuccgccgaguucagcuucgucggcgaguccacgaccaugcgcgagaacaagugcuucgagcagugcgggggcugggggugcggcugcuucaacgugaaccccagcugccucuucgugcacaccuaccugcaguccguccggaaggaggcgcugcgcguguucaacugcaucgacugggugcacaagcucacccuggagaucaccgacuucgacggcagcgucuccacgaucgaccugggggccagcuccagccgguucaccaacuggggcuccgugagccucucccuggacgccgaggggaucagcggcuccaacagcuucagcuucaucgagucccccgggaagggcuacgccaucguggacgagcccuucagcgagaucccgcgccagggcuuccugggggagauccggugcaacuccgagagcuccguccucagcgcccacgaguccugccugcgcgcgcccaaccugaucagcuacaagcccaugaucgaccagcucgagugcaccaccaaccugaucgaccccuucgugguguucgagcggggcucccugccgcagacgcgcaacgacaagaccuucgccgccagcaaggggaaccggggcguccaggccuucuccaaggggagcgugcaggccgaccucacccugauguucgacaacuucgagguggacuucgucggcgcggccguguccugcgacgccgccuuccugaaccucaccggcugcuacagcugcaacgcgggggcccgcgugugccuguccaucacgagcaccggcaccgggacccuguccgcccacaacaaggacggcagccuccacaucguccugcccuccgagaacggcacgaaggaccagugccagauccugcacuucaccgugcccgagguggaggaggaguucauguacagcugcgacggggacgagcgcccccuccuggucaagggcacccugauggccaucgacccguucgacgaccggcgcgaggccgggggcgagagcaccguggucaaccccaaguccgggagcuggaacuucuucgacugguucuccggccucaugagcugguucggcgggccccugaagacgauccugcucaucugccuguacguggcgcuguccaucggccucuucuuccugcugaucuaccucgggcggaccggccugagcaagauguggcuggccgccaccaagaaggccuccuga

SEQ ID NO: 12869 - RNA, 3480 nt, Artificial Sequence
  derived and/or modified CDS sequence (opt1) from RVFV(SAUDI 200010901)__KU978778.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcggccggcgccgggacaccaagcagaucggccgcgagaccauggccgggaucgccaugaccguccugcccgcgcucgccguguucgcccuggcccccguggucuucgcggaggacccccaccuccggaaccgccccggcaaggggcacaacuacaucgacggcaugacccaggaggacgccacgugcaagcccgugaccuacgccggggccugcuccagcuucgacgugcugcuggagaagggcaaguucccgcuguuccaguccuacgcccaccaccggacccuccuggaggcgguccacgacaccaucaucgccaaggccgacccgcccagcugcgaccugcaguccgcccacggcaaccccugcaugaaggagaagcucgugaugaagacgcacugccccaacgacuaccagagcgcccacuaccugaacaacgacgggaagauggcguccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagaccaagaugaagggcgucugcgaggugggggugcaggcccugaagaagugcgacggccagcuguccacggcccacgaggucgugcccuucgccguguucaagaacagcaagaaggucuaccucgacaagcuggaccugaagaccgaggagaaccuccugcccgacagcuucgugugcuucgagcacaaggggcaguacaagggcaccauggacuccgggcagaccaagcgggagcucaagagcuucgacaucucccagugccccaagaucggcggccacgggagcaagaagugcacgggcgacgcggccuucugcuccgccuacgagugcaccgcccaguacgccaacgcguucugcagccacgccaacggguccggcaucgugcagauccaggucagcgggguguggaagaagccccugugcgugggcuacgagcgcgucguggucaagcgggagcuguccgccaagccgauccagcgcguggagcccugcacgaccugcaucaccaagugcgagccccacggccuggugguccggagcaccggguucaagaucuccagcgccguggcgugcgccuccggcgugugcgucaccgggagccagucccccagcaccgagaucacgcucaaguacccgggcaucucccagagcuccgggggcgacaucggcgugcacauggcccacgacgaccagagcgugagcuccaagaucgucgcccacugcccgccccaggaccccugccuggugcacgggugcaucgugugcgcccacggccugaucaacuaccagugccacaccgcgcucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggguggauggagggcggccagcuggugcuggggaaccccgccccgaucccccgccacgcccccaucccccgguacuccaccuaccucaugcugcugcucaucaucagcuacgcguccgccugcagcgagcugauccaggccuccagccgcaucacgaccugcuccaccgagggcgugaacaccaagugccggcugagcgggacggcccugauccgcgcgggcuccgucggggccgaggccugccucaugcugaagggcgugaaggaggaccagaccaaguuccugaagaucaagaccgugagcuccgagcucagcugccgggagggccaguccuacuggaccgggagcuucagcccgaagugccuguccagccgccggugccaccuggucggcgagugccacgugaaccgcugccucuccuggcgggacaacgagacgagcgccgaguucuccuucgugggggagagcaccaccaugcgcgagaacaagugcuucgagcagugcggcggguggggcugcggcugcuucaacgucaaccccuccugccuguucgugcacaccuaccugcagagcgugcggaaggaggcccuccgcgucuucaacugcaucgacugggugcacaagcugacccuggagaucacggacuucgacggguccgugagcaccaucgaccucggcgcguccagcucccgguucaccaacugggggagcgucucccugagccuggacgccgagggcaucuccgggagcaacuccuucagcuucaucgagagccccggcaagggcuacgccaucguggacgagcccuucuccgagaucccgcgccagggguuccucggcgagauccggugcaacagcgaguccagcgugcuguccgcccacgagagcugccugcgcgcccccaaccucaucuccuacaagcccaugaucgaccagcuggagugcaccacgaaccugaucgaccccuucgucguguucgagcgggggagccucccgcagacccgcaacgagaagaccuucgcggccuccaagggcaaccgcggggugcaggccuucagcaagggcuccguccaggccgaccugacccugauguucgacaacuucgagguggacuucgugggcgccgcggucagcugcgacgccgccuuccucaaccugacggggugcuacuccugcaacgccggcgcgcgggugugccugagcaucaccuccaccgggaccggcacgcucagcgcccacaacaaggacggcucccugcacaucgugcugcccagcgagaacgggaccaaggaccagugccagauccuccacuucaccguccccgagguggaggaggaguucauguacuccugcgacggcgacgagcgcccccugcuggugaaggggacccucaucgccaucgacccguucgacgaccggcgcgaggccggcggggagagcacggucgugaaccccaagagcggcuccuggaacuucuucgacugguucagcggccugauguccugguucgggggcccccugaagaccauccuccugaucugccuguacgucgcccucagcaucgggcuguucuuccugcucaucuaccugggccggaccgggcuguccaagauguggcucgcggccaccaagaaggccagcuga

SEQ ID NO: 12870 - RNA, 3480 nt, Artificial Sequence
  derived and/or modified CDS sequence (opt1) from RVFV(2373/74)__DQ380194.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugcuacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacgggaugacccaggaggacgcgaccugcaagcccgucacguacgccggcgccugcuccagcuucgacgugcugcuggagaaggggaaguucccgcuguuccaguccuacgcgcaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggugagcggcgucuggaagaagccccugugcgugggguacgagcgcguggucgugaagcgggagcuguccgccaagccgauccagcgcgucgagcccugcacgaccugcaucaccaagugcgagccccacggccugguggugcggagcaccggcuucaagaucuccagcgcggucgccugcgccuccggggugugcgugaccggcagccagucccccagcaccgagaucacccucaaguacccggggaucucccagagcuccggcggggacaucggcguccacauggcccacgacgaccagagcgugagcuccaagaugguggcccacugcccgccccaggaccccugccugguccacggcugcaucgugugcgcgcacgggcugaucaacuaccagugccacacggcccucagcgccuucguggucguguucguguucuccagcgucgccaucaucugccuggccauccuguacaaggugcucaagugccugaagaucgcgccccgcaaggugcugaacccccucauguggaucaccgccuucauccggugggucuacaagaagaugguggcccgcguggccgacaacaucaaccaggucaaccgggagaucggcuggauggagggcgggcagcuggcccugggcaaccccgcgccgaucccccgccacgcccccaucccccgcuacuccaccuaccucaugcugcugcucaucgugagcuacgccuccgccugcagcgagcugauccaggcguccagccggaucaccacgugcuccaccgagggggugaacaccaagugccgccugagcggcaccgcccugauccgggccggguccgucggcgccgaggccugccucaugcugaagggggugaaggaggaccagacgaaguuccugaagaucaagaccgugagcuccgagcucagcugccgcgagggccaguccuacuggaccggcagcuucagcccgaagugccuguccagccggcgcugccaccuggucggggagugccacgugaaccggugccucuccuggcgcgacaacgagaccagcgcggaguucuccuucgugggcgagagcacgaccaugcgggagaacaagugcuucgagcagugcgggggcugggggugcggcugcuucaacgucaaccccuccugccuguucgugcacaccuaccugcagagcgugcgcaaggaggcccuccgggucuucaacugcaucgacugggugcacaagcugacccuggagaucaccgacuucgacggcuccgugagcacgcucgaccugggggccuccagcucccgcuucaccaacuggggcagcgucucccugagccucgacgccgaggggaucuccggcagcaacuccuucagcuucaucgagagccccgggaagggcuacgccaucguggacgagcccuucuccgagaucccgcggcagggcuuccugggggagauccgcugcaacagcgaguccagcgugcuguccgcgcacgagagcugccuccgggcccccaaccugaucuccuacaagcccaugaucgaccagcuggagugcaccaccaaccucaucgaccccuucgucguguucgagcgcggcagccugccgcagacgcggaacgagaagaccuucgccgccuccaaggggaaccgcggcgugcaggccuucagcaagggguccguccaggcggaccugacccucauguucgacaacuucgagguggacuucgugggcgccgccgucagcugcgacgccgcguuccugaaccugaccggcugcuacuccugcaacgccggggcccgggugugccucagcaucacguccaccggcaccgggacccugagcgcccacaacaaggacggcucccugcacaucgugcuccccagcgagaacggcacgaaggaccagugccagauccugcacuucaccguccccgagguggaggaggaguucauguacuccugcgacggggacgagcgcccccugcucgugaagggcacccugaucgccaucgacccguucgacgaccgccgggaggccgggggcgagagcaccgucgugaaccccaagagcggguccuggaacuucuucgacugguucagcggccugauguccugguucggcgggccccucaagacgauccugcugaucugccucuacgucgcccugagcaucggccuguucuuccuccugaucuaccuggggcgcaccggccucuccaagauguggcuggccgccaccaagaaggccagcuga

SEQ ID NO: 12871 - RNA, 3480 nt, Artificial Sequence
  derived and/or modified CDS sequence (opt1) from RVFV(KEN/Kil-006/07)__HM586966.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcgggugggggugguccgcugcgagcggcgccgggacgccaagcagaucggccgcgagaccauggccggcaucgcgaugaccgugcugcccgcccucgccguguucgcccuggcgccggucguguucgccgaggacccccaccuccggaaccgccccgggaagggccacaacuacaucgacgggaugacccaggaggacgcgaccugcaagcccgugacguacgccggcgccugcuccagcuucgacguccugcuggagaaggggaaguucccgcuguuccaguccuacgcgcaccaccggacccuccuggaggccgugcacgacaccaucaucgccaaggccgacccgcccagcugcgaccugcaguccgccgacggcaacaagugcaugaaggagaagcucgugaugaagacccacugccccaacgacuaccagagcgcgcacuaccugaacaacgacggcaagauggccuccgucaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggugggcguccaggcccugaagaagugcgacgggcagcuguccaccgcccacgagguggugcccuucgcggucuucaagaacagcaagaagguguaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucguccagauccaggugagcggcguguggaagaagccccugugcgucggguacgagcgcguggucgugaagcgggagcuguccgccaagcccauccagcgcguggagccgugcacgaccugcaucaccaagugcgagccccacggccuggucgugcggagcaccggcuucaagaucuccagcgcgguggccugcgccuccggggucugcgugaccggcagccagucccccagcaccgagaucacccucaaguaccccgggaucucccagagcuccggcggggacaucggcgugcacauggcccacgacgaccagagcgucagcuccaagaucguggcccacugcccgccccaggaccccugccuggugcacggcugcaucgucugcgcgcacgggcugaucaacuaccagugccacacggcccucagcgccuucguggugaucuucgucuucuccagcaccgccaucaucugccuggccgugcuguaccgcgugcucaagugccugaagaucgcgccccggaagguccugaacccgcucauguggaucaccgccuucauccgcuggguguacaagaagaugguggcccgggucgccgacaacaucaaccaggugaaccgcgagaucggcuggauggagggcgggcagcuggcccugggcaaccccgcgcccaucccgcgccacgcccccaucccccgguacuccaccuaccucaugcugcugcucaucgugagcuacgccuccgccugcagcgagcugauccaggcguccagccgcaucacgaccugcuccaccgagggggucaacaccaagugccggcugagcggcacggcccugauccgcgccggguccgugggcgccgaggccugccucaugcugaagggggugaaggaggaccagaccaaguuccugaagaucaagaccgucagcuccgagcucagcugccgggagggccaguccuacuggaccggcagcuucagccccaagugccuguccagccgccggugccaccuggugggggagugccacgugaaccgcugccucuccuggcgggacaacgagacgagcgcggaguucuccuucgucggcgagagcaccaccaugcgcgagaacaagugcuucgagcagugcgggggcugggggugcggcugcuucaacgugaacccguccugccuguucgugcacaccuaccugcagagcguccggaaggaggcccuccgcguguucaacugcaucgacugggugcacaagcugacccuggagaucacggacuucgacggcuccgucagcaccaucgaccucggggccuccagcucccgguucaccaacuggggcagcgugucccugagccuggacgccgaggggaucuccggcagcaacuccuucagcuucaucgagagccccgggaagggcuacgccaucguggacgagcccuucuccgagaucccccgccagggcuuccucggggagauccggugcaacagcgaguccagcguccuguccgcgcacgagagcugccugcgcgccccgaaccucguguccuacaagcccaugaucgaccagcuggagugcaccacgaaccugaucgaccccuucguggucuucgagcggggcagccucccccagacccgcaacgacaagaccuucgccgccuccaaggggaaccggggcgugcaggccuucagcaagggguccgugcaggcggaccugacccugauguucgacaacuucgaggucgacuucgugggcgccgccgugagcugcgacgccgcguuccucaaccugacgggcugcuacuccugcaacgccggggcccgcgucugccugagcaucaccuccaccggcaccgggacgcucagcgcccacaacaaggacggcucccugcacaucgugcugccgagcgagaacggcaccaaggaccagugccagauccuccacuucaccgugcccgaggucgaggaggaguucauguacuccugcgacggggacgagcgcccccugcuggugaagggcacccucaucgccaucgaccccuucgacgaccggcgcgaggccgggggcgagagcacggucgugaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgccgccaccaagaaggccagcuga

SEQ ID NO: 12872 - RNA, 3480 nt, Artificial Sequence
  derived and/or modified CDS sequence (opt1) from RVFV(MgH824)__DQ380210.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggcuacaacuacaucgacgggaugacccaggaggacgcgaccugcaagcccgucacguacgccggcgccugcuccagcuucgacgugcugcuggagaaggggaaguucccgcuguuccaguccuacgcccaccaccggacccuccuggaggccgugcacgacaccaucaucgccaaggccgacccgcccagcugcgaccugcaguccgcccacggcaaccccugcaugaaggagaagcucgucaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgugugcgaggucggcgugcaggcccugaagaagugcgacgggcagcuguccaccgcccacgaggugguccccuucgcgguguucaagaacagcaagaagguguaccucgacaagcuggaccugaagacggaggagaaccuccugcccgacagcuucgucugcuucgagcggaagggccaguacaaggggaccauggacuccggccagaccaagcgcgagcucaagagcuucgacaucucccagugccccaagaucgggggccacggcagcaagaagugcaccggggacgccgccuucugcuccgccuacgagugcacgacccaguacgccaacgcguacugcagccacgccaacggcuccgggguggugcagauccaggucagcggcguguggaagaagccccugugcgugggguacgagcgggucguggucaagcgcgagcuguccgccaagccgauccagcggguggagcccugcacgaccugcaucaccaagugcgagccccacggccuggugguccgcagcaccggcuucaagaucuccagcgccguggcgugcgccuccggggugugcgucaccggcagccagucccccagcaccgagaucacgcucaaguacccggggaucucccagagcuccggcggggacaucggcgugcacauggcccacgacgaccagagcgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcaucgccaucaucugccuggccauccuguaccgggugcucaagugccugaagaucgcgccccgcaaggugcugaacccccucauguggaucaccgccuucauccgguggaucuacaagaagauggucgcccgcguggccgacaacaucaaccaggugaaccgcgagaucggcuggauggagggcgggcagcugguccugggcaaccccgccccgaucccccggcacgcccccaucccccgcuacuccaccuaccucaugcugcugcucaucgugagcuacgcguccgccugcagcgagcugauccaggccuccagccggaucacgaccugcuccaccgaggggguggacaccaagugccgccugagcggcacggcccugauccgggcgggguccgucggcgccgaggccugccucaugcugaagggggugaaggaggaccagaccaaguuccugaagaucaagaccgugagcuccgagcucagcugccgcgagggccaguccuacuggaccggcagcuucagcccgaagugccuguccagccggcgcugccaccuggucggggagugccacgugaaccggugccucuccuggcgcgacaacgagacgagcgccgaguucuccuucgugggcgagagcaccaccaugcgggagaacaagugcuucgagcagugcgggggcugggggugcggcugcuucaacgucaaccccuccugccuguucgugcacaccuaccugcagagcgugcgcaaggaggcccuccgggucuucaacugcaucgacugggugcacaagcugacccuggagaucacggacuucgacggcuccgugagcaccaucgaccucggggcguccagcucccgcuucaccaacuggggcagcgucucccugagccuggacgccgaggggaucuccggcagcaacuccuucagcuucaucgagagccccgggaagggcuacgccaucguggacgagcccuucccggagaucccccggcagggcuuccucggggagauccgcugcaacuccgagagcuccgugcugagcgcccacgaguccugccugcgggcccccaaccucaucagcuacaagcccaugaucgaccagcuggagugcaccacgaaccugaucgacccguucgucguguucgagcgcggcucccucccccagacccggaacgacaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcgcgcgugugccuguccaucaccagcaccggcaccgggucccucagcgcccacaacaaggacggcucccugcacaucgugcugcccagcgagaacggcacgaaggaccagugccagauccuccacuucaccguccccgagguggaggaggaguucauguacuccugcgacggggacgagcggccgcugcuggugaagggcacccucaucgccaucgaccccuucgacgaccgccgggaggccgggggcgagagcaccgucgugaaccccaagagcggguccuggaacuucuucgacugguucagcggccugauguccugguucggcgggccccugaagacgauccuccugaucugccuguacgucgcccucagcaucggccuguucuuccugcucaucuaccuggggcgcaccggccuguccaagauguggcucgcggccaccaagaaggccagcuga

SEQ ID NO: 12873 - RNA, 3480 nt, Artificial Sequence
  derived and/or modified CDS sequence (opt1) from RVFV(SA01-1322)__KX096942.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcggccggcgccgggacaccaagcagaucggccgcgagaccauggccgggaucgccaugaccguccugcccgcgcucgccguguucgcccuggcccccguggucuucgcggaggacccccaccuccggaaccgccccggcaaggggcacaacuacaucgacggcaugacccaggaggacgccacgugcaagcccgugaccuacgccggggccugcuccagcuucgacgugcugcuggagaagggcaaguucccgcuguuccaguccuacgcccaccaccggacccuccuggaggcgguccacgacaccaucaucgccaaggccgacccgcccagcugcgaccugcaguccgcccacggcaaccccugcaugaaggagaagcucgugaugaagacgcacugccccaacgacuaccagagcgcccacuaccugaacaacgacgggaagauggcguccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagaccaagaugaagggcgucugcgaggugggggugcaggcccugaagaagugcgacggccagcuguccacggcccacgaggucgugcccuucgccguguucaagaacagcaagaaggucuaccucgacaagcuggaccugaagaccgaggagaaccuccugcccgacagcuucgugugcuucgagcacaaggggcaguacaagggcaccauggacuccgggcagaccaagcgggagcucaagagcuucgacaucucccagugccccaagaucggcggccacgggagcaagaagugcacgggcgacgcggccuucugcuccgccuacgagugcaccgcccaguacgccaacgcguucugcagccacgccaacggguccggcaucgugcagauccaggucagcgggguguggaagaagccccugugcgugggcuacgagcgcgucguggucaagcgggagcuguccgccaagccgauccagcgcguggagcccugcacgaccugcaucaccaagugcgagccccacggccuggugguccggagcaccggguucaagaucuccagcgccguggcgugcgccuccggcgugugcgucaccgggagccagucccccagcaccgagaucacgcucaaguacccgggcaucucccagagcuccgggggcgacaucggcgugcacauggcccacgacgaccagagcgugagcuccaagaucgucgcccacugcccgccccaggaccccugccuggugcacgggugcaucgugugcgcccacggccugaucaacuaccagugccacaccgcgcucagcgccuucgucgugguguucgucuucuccagcaucgccaucaucugccuggccauccuguaccgcgugcucaagugccugaagaucgcgccccggaaggugcugaacccccucauguggaucaccgccuucauccgcugggucuacaagaagaugguggcccggguggccgacaacaucaaccaggucaaccgcgagaucggguggauggagggcggccagcuggugcugggggaccccgccccgaucccccgccacgcccccaucccccgguacuccaccuaccucaugcugcugcucaucaucagcuacgcguccgccugcagcgagcugauccaggccuccagccgcaucacgaccugcuccaccgagggcgugaacaccaagugccggcugagcgggacggcccugauccgcgcgggcuccgucggggccgaggccugccucaugcugaagggcgugaaggaggaccagaccaaguuccugaagaucaagaccgugagcuccgagcucagcugccgggagggccaguccuacuggaccgggagcuucagcccgaagugccuguccagccgccggugccaccuggucggcgagugccacgugaaccgcugccucuccuggcgggacaacgagacgagcgccgaguucuccuucgugggggagagcaccaccaugcgcgagaacaagugcuucgagcagugcggcggguggggcugcggcugcuucaacgucaaccccuccugccuguucgugcacaccuaccugcagagcgugcggaaggaggcccuccgcgucuucaacugcaucgacugggugcacaagcugacccuggagaucacggacuucgacggguccgugagcaccaucgaccucggcgcguccagcucccgguucaccaacugggggagcgucucccugagccuggacgccgagggcaucuccgggagcaacuccuucagcuucaucgagagccccggcaagggcuacgccaucguggacgagcccuucuccgagaucccgcgccagggguuccucggcgagauccggugcaacagcgaguccagcgugcuguccgcccacgagagcugccugcgcgcccccaaccucaucuccuacaagcccaugaucgaccagcuggagugcaccacgaaccugaucgaccccuucgucguguucgagcgggggagccucccgcagacccgcaacgagaagaccuucgcggccuccaagggcaaccgcggggugcaggccuucagcaagggcuccguccaggccgaccugacccugauguucgacaacuucgagguggacuucgugggcgccgcggucagcugcgacgccgccuuccucaaccugacggggugcuacuccugcaacgccggcgcgcgggugugccugagcaucaccuccaccgggaccggcacgcucagcgcccacaacaaggacggcucccugcacaucgugcugcccagcgagaacgggaccaaggaccagugccagauccuccacuucaccguccccgagguggaggaggaguucauguacuccugcgacggcgacgagcgcccccugcuggugaaggggacccucaucgccaucgacccguucgacgaccggcgcgaggccggcggggagagcacggucgugaaccccaagagcggcuccuggaacuucuucgacugguucagcggccugauguccugguucgggggcccccugaagaccauccuccugaucugccuguacgucgcccucagcaucgggcuguucuuccugcucaucuaccugggccggaccgggcuguccaagauguggcucgcggccaccaagaaggccagcuga

SEQ ID NO: 12874 - RNA, 3480 nt, Artificial Sequence
  derived and/or modified CDS sequence (opt1) from RVFV(Kenya 56 (IB8))__DQ380190.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcaggucgggaucgugcggugcgagcgccggcgcgacgccaagcagaucggccgggagaccauggccggcaucgcgaugaccgugcugcccgcccucgccgucuucgcccuggcgcccgugguguucgccgaggacccccaccuccgcaaccggcccgggaagggccacaacuacaucgacgggaugacccagggcgacgcgaccugcaagcccgucacguacgccggggccugcuccagcuucgacgugcuccuggagaagggcaaguucccgcuguuccaguccuacgcccaccaccgcacccuccuggaggccgugcacgacaccaucaucgccaaggccgacccgcccagcugcgaccugcaguccgcccacggcaaccccugcaugaaggagaagcucgucaugaagacccacugccccaaggacuaccagagcgcgcacuaccugaacaacgacgggaagauggccuccgugaagugcccgcccaaguacgagcugacggaggacugcaacuucugccggcagaugaccggcgccagccucaagaagggguccuacccccugcaggaccuguucugccagagcuccgaggacgacggcagcaagcucaagaccaagaugaagggcgugugcgaggucggggugcaggcccugaagaagugcgacggccagcuguccaccgcccacgaggugguccccuucgcgguguucaagaacagcaagaagguguaccucgacaagcuggaccugaagacggaggagaaccuccugcccgacagcuucgucugcuucgagcacaaggggcaguacaagggcaccauggacuccgggcagaccaagcgcgagcucaagagcuucgacaucucccagugccccaagaucggcggccacgggagcaagaagugcaccggcgacgccgccuucugcuccgccuacgagugcacggcccaguacgcgaacgccuacugcagccacgccaacggguccggcaucgugcagauccaggugagcggggucuggaagcggccccugugcgugggcuacgagcgcguggucgugaagcgggagcuguccgccaagccgauccagcgcgucgagcccugcacgaccugcaucaccaagugcgagccccacggccugguggugcggagcaccggguucaagaucuccagcgcggucgccugcgccuccggcgugugcgugaccgggagccagucccccagcaccgagaucacccucaaguacccgggcaugucccagagcuccgggggcgacaucggcguccacauggcccacgacgaccagagcgugagcuccaagaucguggcccacugcccgccccaggaccccugccugguccacgggugcaucgugugcgcgcacggccugaucaacuaccagugccacacggcccucagcgccuucguggucguguucguguucuccagcgucgccaucaucugccuggccauccuguacaaggugcucaagugccugaagaucgcgccccgcaaggugcugaacccccucauguggaucaccgccuucauccggugggucuacaagaagaugguggcccgcguggccgacaacaucaaccaggucaaccgggagaucggguggauggagggcggccagcccgcccuggggaacccggcgcccaucccccgccacgcccccaucccgcgcuacuccaccuaccugaugcuccugcugaucgugagcuacgccuccgccugcagcgagcucauccaggcguccagccggaucaccacgugcuccaccgagggcgugaacaccaagugccgccugagcgggaccgcccugauccgggccggcuccgucggggccgaggccugccugaugcucaagggcgugaaggaggaccagacgaaguuccugaagaucaagaccgugagcuccgagcugagcugccgcgagggccaguccuacuggaccgggagcuucagccccaagugccucuccagccggcgcugccaccuggucggcgagugccacgugaaccggugccuguccuggcgcgacaacgagaccagcgcggaguucuccuucgugggggagagcacgaccaugcgggagaacaagugcuucgagcagugcggcggguggggcugcggcugcuucaacgucaaccccuccugccucuucgugcacaccuaccugcagagcgugcgcaaggaggcccugcgggucuucaacugcaucgacugggugcacaagcucacccuggagaucaccgacuucgacggguccgugagcacgaucgaccugggcgccuccagcucccgcuucaccaacugggggagcgucucccucagccuggacgccgagggcaucuccgggagcaacuccuucagcuucaucgagagccccggcaagggcuacgccaucguggacgagccguucuccgagaucccccggcagggguuccugggcgagauccgcugcaacagcgaguccagcgugcucuccgcgcacgagagcugccugcgggcccccaaccugaucuccuacaagcccaugaucgaccagcucgagugcaccaccaaccugaucgacccguucgucgccuucgagcgcgggagccugccccagacgcggaacgacaagaccuucgccgccuccaagggcaaccgcggggugcaggcguucagcaagggcuccgugcaggccgaccucacccugauguucgacaacuucgaggucgacuucgugggcgccgccgugagcugcgacgcggccuuccugaaccucaccgggugcuacuccugcaacgccggcgcccgggucugccugagcaucacguccaccgggaccggcacccugagcgcccacaacaaggacggcucccuccacaucgugcugcccagcgagaacgggacgaaggaccagugccagauccugcacuucaccgugcccgaggucgaggaggaguucauguacuccugcgacggcgacgagcgcccgcuccuggugaaggggacccugaucgcgaucgaccccuucgacgaccgccgggaggccggcggggagagcaccguggucaaccccaagagcggcuccuggaacuucuucgacugguucagcggccucauguccugguucgggggcccccugaagacgauccugcucaucugccuguacguggcccugagcaucgggcuguucuuccugcugaucuaccucggccgcaccgggcuguccaagauguggcuggccgccaccaagaaggcgagcuga

SEQ ID NO: 12875 - RNA, 3480 nt, Artificial Sequence
  derived and/or modified CDS sequence (opt1) from RVFV(KEN/Mal-032/07)__HM586967.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgccgguggucuucgccgaggacccccaccuccggaaccgccccgggaagggccacaacuacaucgacgggcggcugcaggaggacgcgaccugcaagcccgugaccuacgccggcgccugcuccagcuucgacgugcugcuggagaaggggaaguucccccucuuccaguccuacgcgcaccaccgcacgcugcuggaggccguccacgacaccaucaucgccaaggccgacccgcccagcugcgaccuccaguccgccgacggcaacaagugcaugaaggagaagcuggugaugaagacccacugccccaacgacuaccagagcgcgcacuaccugaacaacgacggcaagauggccuccgugaagugcccgcccaaguacgagcucaccgaggacugcaacuucugccggcagaugacgggggccagccugaagaagggcuccuacccccugcaggaccucuucugccagagcuccgaggacgacgggagcaagcugaagaccaagaugaagggcgucugcgaggugggcgugcaggcccugaagaagugcgacgggcagcucuccaccgcccacgaggucgugcccuucgcgguguucaagaacagcaagaaggucuaccuggacaagcuggaccucaagaccgaggagaaccugcugccggacagcuucgugugcuucgagcacaagggccaguacaaggggacgauggacuccggccagaccaagcgcgagcucaagagcuucgacaucucccagugccccaagaucgggggccacggcagcaagaagugcaccggggacgccgccuucugcuccgccuacgagugcaccgcccaguacgcgaacgccuacugcagccacgccaacggcuccgggaucgugcagauccaggucagcggcguguggaagaagccccugugcgugggguacgagcgggucguggucaagcgcgagcuguccgccaagcccauccagcggguggagccgugcacgaccugcaucaccaagugcgagccccacggccucgugguccgcagcaccggcuucaagaucuccagcgcgguggccugcgccuccggggugugcgucacgggcagccagucccccagcaccgagaucacccugaaguaccccgggaucucccagagcuccggcggggacaucggcgugcacauggcccacgacgaccagagcgugagcuccaagaucgucgcccacugcccgccccaggaccccugccuggugcacggcugcaucgugugcgcgcacgggcucaucaacuaccagugccacaccgcccugagcgccuucgucgugaucuucguguucuccagcacggccaucaucugccuggccguccucuaccgggugcugaagugccugaagaucgcgccccgcaaggugcucaacccgcugauguggaucaccgccuucauccggugggucuacaagaagaugguggcccgcguggccgacaacaucaaccaggucaaccgcgagaucggcuggauggagggcgggcagcuggcccucggcaaccccgcgcccaucccgcggcacgcccccaucccccgcuacuccaccuaccugaugcugcuccugaucgugagcuacgccuccgccugcagcgagcugauccaggcguccagccggaucaccacgugcuccaccgagggggugaacaccaagugccgccugagcggcaccgcccucauccgggccggguccgucggcgccgaggccugccugaugcugaagggggugaaggaggaccagacgaaguuccucaagaucaagaccgugagcuccgagcugagcugccgcgagggccaguccuacuggaccggcagcuucagccccaagugccuguccagccggcgcugccaccucgucggggagugccacgugaaccggugccuguccuggcgcgacaacgagaccagcgcggaguucuccuucgugggcgagagcacgaccaugcgggagaacaagugcuucgagcagugcgggggcugggggugcggcugcuucaacgucaacccguccugccuguucgugcacaccuaccuccagagcgugcgcaaggaggcccugcgggucuucaacugcaucgacugggugcacaagcugacccucgagaucaccgacuucgacggcuccgugagcacgaucgaccugggggccuccagcucccgcuucaccaacuggggcagcgucucccugagccucgacgccgaggggaucuccggcagcaacuccuucagcuucaucgagagccccgggaagggcuacgccaucguggacgagcccuucuccgagaucccccggcagggcuuccugggggagauccgcugcaacagcgaguccagcgugcuguccgcgcacgagagcugccuccgggccccgaaccuggucuccuacaagcccaugaucgaccagcuggagugcaccaccaaccucaucgaccccuucgugguguucgagcgcggcagccugccccagacgcggaacgacaagaccuucgccgccuccaaggggaaccgcggcguccaggccuucagcaagggguccgugcaggcggaccugacccucauguucgacaacuucgagguggacuucgucggcgccgccgugagcugcgacgccgcguuccugaaccugaccggcugcuacuccugcaacgccggggcccgcgugugccucagcaucacguccaccggcaccgggacccugagcgcccacaacaaggacggcucccugcacaucguccucccgagcgagaacggcacgaaggaccagugccagauccugcacuucaccgugcccgagguggaggaggaguucauguacuccugcgacggggacgagcggccccugcucgucaagggcacccugaucgccaucgaccccuucgacgaccgccgggaggccgggggcgagagcaccguggucaaccccaagagcggguccuggaacuucuucgacugguucagcggccugauguccugguucggcgggccccucaagacgauccugcugaucugccucuacguggcccugagcaucggccuguucuuccuccugaucuaccuggggcgcaccggccucuccaagauguggcuggccgccaccaagaaggccagcuga

SEQ ID NO: 12876 - RNA, 3480 nt, Artificial Sequence
  derived and/or modified CDS sequence (opt1) from RVFV(KEN/Gar-008/06)__HM586965.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgccgguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagccgcguguggaagaagccccugugcgugggcuacgagcgggucguggucaagcgcgagcuguccgccaagccgauccagcggguggagcccugcacgaccugcaucaccaagugcgagccccacgggcuggugguccgcagcaccggcuucaagaucuccagcgcgguggccugcgccuccggcgugugcgucaccgggagccagucccccagcaccgagaucacccucaaguacccgggcaucucccagagcuccgggggcgacaucggggugcacauggcccacgacgaccagagcgugagcuccaagaucgucgcccacugcccgccccaggaccccugccuggugcacggcugcaucgugugcgcgcacggccugaucaacuaccagugccacacggcccucagcgccuucgucgugaucuucguguucuccagcaccgccaucaucugccuggccguccuguaccgggugcucaagugccugaagaucgcgccccgcaaggugcugaacccccucauguggaucaccgccuucauccggugggucuacaagaagaugguggcccgcguggccgacaacaucaaccaggucaaccgcgagaucggguggauggagggcgggcagcuggcccugggcaaccccgcgccgaucccccggcacgcccccaucccccgcuacuccaccuaccucaugcugcugcucaucgugagcuacgccuccgccugcagcgagcugauccaggcguccagccggaucacgaccugcuccaccgagggcgugaacaccaagugccgccugagcgggacggcccugauccgggccggcuccgucggggccgaggccugccucaugcugaagggcgugaaggaggaccagaccaaguuccugaagaucaagaccgugagcuccgagcucagcugccgcgaggggcaguccuacuggaccggcagcuucagcccgaagugccuguccagccggcgcugccaccuggucggcgagugccacgugaaccggugccucuccuggcgcgacaacgagacgagcgcggaguucuccuucgugggggagagcaccaccaugcgggagaacaagugcuucgagcagugcggcggguggggcugcgggugcuucaacgucaaccccuccugccuguucgugcacaccuaccugcagagcgugcgcaaggaggcccuccgggucuucaacugcaucgacugggugcacaagcugacccuggagaucacggacuucgacggcuccgugagcaccaucgaccucggcgccuccagcucccgcuucaccaacugggggagcgucucccugagccuggacgccgagggcaucuccgggagcaacuccuucagcuucaucgagagccccggcaagggguacgccaucguggacgagcccuucuccgagaucccgcggcagggcuuccucggcgagauccgcugcaacagcgaguccagcgugcuguccgcgcacgagagcugccugcgggcccccaaccucgucuccuacaagcccaugaucgaccagcuggagugcaccacgaaccugaucgaccccuucgugguguucgagcgcgggagccucccgcagacccggaacgacaagaccuucgccgccuccaagggcaaccgcgggguccaggccuucagcaagggcuccgugcaggcggaccugacccugauguucgacaaccucaagguggacuucgucggggccgccgugagcugcgacgccgcguuccugaaccugacgggcugcuacuccugcaacgccggcgcccgcgugugccucagcaucaccuccaccgggaccggcacgcugagcgcccacaacaaggacgggucccugcacaucguccuccccagcgagaacggcaccaaggaccagugccagauccugcacuucaccgugcccgaggugaaggaggaguucauguacuccugcgacggcgacgagcgggcccugcucaugaaggggacccugaucgcgaucgaccccuucgacgaccgccgggaggccggcggggagagcacggucgugaaccccaagagcggcuccuggaacuucuucgacugguucagcgggcugauguccugguucggcggcccccucaagaccauccugcugaucugccucuacgucgcccugagcaucgggcuguucuuccuccugaucuaccugggccgcaccgggcucuccaagauguggcuggccgccaccaagaaggcgagcuga

SEQ ID NO: 12877 - RNA, 3480 nt, Artificial Sequence
  derived and/or modified CDS sequence (opt1) from RVFV(Beijing-01)__KX611606.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaucaucgccgccgacggccucaacaacaucacgugccacgggaaggacccggaggacaagaucagccugaucaagggcccgccccacaagaagcgggucgggaucgugcgcugcgagcggcgccgggacgccaagcagaucggccgcgagaccauggccggcaucgcgaugaccgugcugcccgcccucgccgucuucgcccuggcgcccgugguguucgccgaggacccccaccuccggaaccgccccgggaagggccacaacuacaucgacggggucacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcggcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgcgagcucaagagcuucgacaucucccagugccccaagaucgggggccacggcagcaagaagugcaccggggacgccgccuucugcuccgccuacgagugcacggcccaguacgcgaacgccuacugcagccacgccaacggcuccgggaucgugcagauccaggucagcggcguguggaagaagccccugugcgugggguacgagcgggucguggucaagcgcgagcuguccgccaagccgauccagcggguggagcccugcacgaccugcaucaccaagugcgagccccacggccuggugguccgcagcaccggcuucaagaucuccagcgcgguggccugcgccuccggggugugcgucaccggcagccagucccccagcaccgagaucacccucaaguacccggggaucucccagagcuccggcggggacaucggcgugcacauggcccacgacgaccagagcgugagcuccaagaucgucuucgacugcccgccccaggaccccugccuggugcacggcugcaucgugugcgcccacgggcugaucaacuaccagugccacacggcgcucagcgccuucgucgugguguucgucuucuccagcguggccaucaucugccuggccauccuguacaaggugcuccggugccugaagaucgcccccaagaagguccugaacccccucauguggaucaccgcguucauccgcuggguguacaagaagaugguggcccgggucgccgacaacaucaaccaggugaaccgcgagaucggcuggauggagggcgggcagcuggcccugggcaaccccgccccgaucccccgccacgcgcccaucccccgguacuccaccuaccucaugcugcugcucaucaucagcuacgccuccgccugcagcgagcugauccaggccuccagccgcaucaccacgugcuccaccgagggggugaacaccaagugccggcugagcggcaccgcgcugauccgcgccggguccgucggcgccgaggccugccucauguucgagggggugaaggaggaccagacgaaguuccugaagaucaagaccgugagcuccgagcugagcugccgggagggccaguccuacuggaccggcagcuucagcccgaagugccucuccagccgccggugccaccuggucggggagugccacgugaaccgcugccuguccuggcgggacaacgagaccagcgccgaguucuccuucgugggcgagagcacgaccaugcgcgagaacaagugcuucgagcagugcgggggcugggggugcggcugcuucaacgucaaccccuccugccucuucgugcacaccuaccugcagagcgugcggaaggaggcgcugcgcgucuucaacugcaucgacugggugcacaagcucacccuggagaucaccgacuucgacggcuccgugagcacgaucgaccugggggccuccagcucccgguucaccaacuggggcagcgucucccucagccuggacgccgaggggaucuccggcagcaacuccuucagcuucaucgagagccccgggaagggcuacgccaucguggacgagcccuucuccgagaucccgcgccagggcuuccugggggagauccggugcaacagcgaguccagcgugcucuccgcccacgagagcugccugcgcgcgcccaaccugaucuccuacaagcccaugaucgaccagcucgagugcaccaccaaccugaucgaccccuucgucguguucgagcggggcagccugccgcagacgcgcaacgacaagaccuucgccgccuccaaggggaaccggggcgugcaggccuucagcaagggguccguccaggccgaccucacccugauguucgacaacuucgagguggacuucgugggcgcggccgucagcugcgacgccgccuuccugaaccucaccggcugcuacuccugcaacgcgggggcccgcgugugccugagcaucacguccaccggcaccgggacccugagcgcccacaacaaggacggcucccuccacaucgugcugcccagcgagaacggcacgaaggaccagugccagauccugcacuucaccguccccgagguggaggaggaguucauguacuccugcgacggggacgagcgcccccuccuggugaagggcacccugaucgccaucgacccguucgacgaccggcgcgaggccgggggcgagagcaccgucgugaaccccaagagcggguccuggaacuucuucgacugguucagcggccucauguccugguucggcgggccccugaagacgauccugcucaucugccuguacgucgcgcugagcaucggccucuucuuccugcugaucuaccucgggcggaccggccuguccaagauguggcuggccgccaccaagaaggccagcuga

SEQ ID NO: 12878 - RNA, 3480 nt, Artificial Sequence
  derived and/or modified CDS sequence (opt1) from RVFV(KEN/Bar-035/07)__HM586969.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgccgguggucuucgccgaggacccccaccuccggaaccgccccgggaagggccacaacuacaucgacgggcggcugcaggaggacgcgaccugcaagcccgugaccuacgccggcgccugcuccagcuucgacgugcugcuggagaaggggaaguucccccucuuccaguccuacgcccaccaccgcacgcugcuggaggccguccacgacaccaucaucgccaaggccgacccgcccagcugcgaccuccaguccgccgacggcaacaagugcaugaaggagaagcuggugaugaagacccacugccccaacgacuaccagagcgcgcacuaccugaacaacgacggcaagauggccuccgugaagugcccgcccaaguacgagcucaccgaggacugcaacuucugccggcagaugacgggggccagccugaagaagggcuccuacccccugcaggaccucuucugccagagcuccgaggacgacgggagcaagcugaagaccaagaugaagggcgucugcgaggugggcgugcaggcccugaagaagugcgacgggcagcucuccaccgcccacgaggucgugcccuucgcgguguucaagaacagcaagaaggucuaccuggacaagcuggaccucaagaccgaggagaaccugcugccggacagcuucgugugcuucgagcacaagggccaguacaaggggacgauggacuccggccagaccaagcgcgagcucaagagcuucgacaucucccagugccccaagaucgggggccacggcagcaagaagugcaccggggacgccgccuucugcuccgccuacgagugcaccgcccaguacgcgaacgccuacugcagccacgccaacggcuccgggaucgugcagauccaggucagcggcguguggaagaagccccugugcgugggguacgagcgggucguggucaagcgcgagcuguccgccaagcccauccagcggguggagccgugcacgaccugcaucaccaagugcgagccccacggccucgugguccgcagcaccggcuucaagaucuccagcgcgguggccugcgccuccggggugugcgucacgggcagccagucccccagcaccgagaucacccugaaguaccccgggaucucccagagcuccggcggggacaucggcgugcacauggcccacgacgaccagagcgugagcuccaagaucgucgcccacugcccgccccaggaccccugccuggugcacggcugcaucgugugcgcgcacgggcucaucaacuaccagugccacaccgcccugagcgccuucgucgugaucuucguguucuccagcacggccaucaucugccuggccguccucuaccgggugcugaagugccugaagaucgcgccccgcaaggugcucaacccgcugauguggaucaccgccuucauccggugggucuacaagaagaugguggcccgcguggccgacaacaucaaccaggucaaccgcgagaucggcuggauggagggcgggcagcuggcccucggcaaccccgcgcccaucccgcggcacgcccccaucccccgcuacuccaccuaccugaugcugcuccugaucgugagcuacgccuccgccugcagcgagcugauccaggcguccagccggaucaccacgugcuccaccgagggggugaacaccaagugccgccugagcggcaccgcccucauccgggcccgcuccgucggggccgaggccugccugaugcugaagggcgugaaggaggaccagacgaaguuccucaagaucaagaccgugagcuccgagcugagcugccgggaggggcaguccuacuggaccggcagcuucagccccaagugccuguccagccgccggugccaccucgucggcgagugccacgugaaccgcugccuguccuggcgggacaacgagaccagcgcggaguucuccuucgugggggagagcacgaccaugcgcgagaacaagugcuucgagcagugcggcggguggggcugcgggugcuucaacgucaacccguccugccuguucgugcacaccuaccuccagagcgugcggaaggaggcccugcgcgucuucaacugcaucgacugggugcacaagcugacccucgagaucaccgacuucgacggcuccgugagcacgaucgaccugggcgccuccagcucccgguucaccaacugggggagcgucucccugagccucgacgccgagggcaucuccgggagcaacuccuucagcuucaucgagagccccggcaagggguacgccaucguggacgagcccuucuccgagaucccccgccagggcuuccugggcgagauccggugcaacagcgaguccagcgugcuguccgcgcacgagagcugccuccgcgccccgaaccuggucuccuacaagcccaugaucgaccagcuggagugcaccaccaaccucaucgaccccuucgugguguucgagcgggggagccugccccagacgcgcaacgacaagaccuucgccgccuccaagggcaaccgcgggguccaggccuucagcaagggcuccgugcaggcggaccugacccucauguucgacaacuucgagguggacuucgucggggccgccgugagcugcgacgccgcguuccugaaccugaccggcugcuacuccugcaacgccggcgcccgggugugccucagcaucacguccaccgggaccggcacccugagcgcccacaacaaggacgggucccugcacaucguccucccgagcgagaacggcacgaaggaccagugccagauccugcacuucaccgugcccgagguggaggaggaguucauguacuccugcgacggcgacgagcgcccccugcucgucaaggggacccugaucgccaucgaccccuucgacgaccggcgcgaggcgggcggggagagcaccguggucaaccccaagagcggcuccuggaacuucuucgacugguucagcgggcugauguccugguucggcggcccccucaagacgauccugcugaucugccucuacguggcccugagcaucgggcuguucuuccuccugaucuaccugggccggaccgggcucuccaagauguggcuggccgccaccaagaaggccagcuga

SEQ ID NO: 12879 - RNA, 3480 nt, Artificial Sequence
  derived and/or modified CDS sequence (opt1) from RVFV(KEN/Bar-032/07)__HM586968.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgccgguggucuucgccgaggacccccaccuccggaaccgccccgggaagggccacaacuacaucgacgggcggcugcaggaggacgcgaccugcaagcccgugaccuacgccggcgccugcuccagcuucgacgugcugcuggagaaggggaaguucccccucuuccaguccuacgcgcaccaccgcacgcugcuggaggccguccacgacaccaucaucgccaaggccgacccgcccagcugcgaccuccaguccgccgacggcaacaagugcaugaaggagaagcuggugaugaagacccacugccccaacgacuaccagagcgcgcacuaccugaacaacgacggcaagauggccuccgugaagugcccgcccaaguacgagcucaccgaggacugcaacuucugccggcagaugacgggggccagccugaagaagggcuccuacccccugcaggaccucuucugccagagcuccgaggacgacgggagcaagcugaagaccaagaugaagggcgucugcgaggugggcgugcaggcccugaagaagugcgacgggcagcucuccaccgcccacgaggucgugcccuucgcgguguucaagaacagcaagaaggucuaccuggacaagcuggaccucaagaccgaggagaaccugcugccggacagcuucgugugcuucgagcacaagggccaguacaaggggacgauggacuccggccagaccaagcgcgagcucaagagcuucgacaucucccagugccccaagaucgggggccacggcagcaagaagugcaccggggacgccgccuucugcuccgccuacgagugcaccgcccaguacgcgaacgccuacugcagccacgccaacggcuccgggaucgugcagauccaggucagcggcguguggaagaagccccugugcgugggguacgagcgggucguggucaagcgcgagcuguccgccaagcccauccagcggguggagccgugcacgaccugcaucaccaagugcgagccccacggccucgugguccgcagcaccggcuucaagaucuccagcgcgguggccugcgccuccggggugugcgucacgggcagccagucccccagcaccgagaucacccugaaguaccccgggaucucccagagcuccgugggcgacaucggggugcacauggcccacgacgaccagagcgucagcuccaagaucguggcccacugcccgccccaggaccccugccuggugcacggcugcaucgucugcgcgcacggccucaucaacuaccagugccacaccgcccugagcgccuucguggugaucuucgucuucuccagcacggccaucaucugccuggccgugcucuaccgggugcugaagugccugaagaucgcgccccgcaagguccucaacccgcugauguggaucaccgccuucauccgguggguguacaagaagaugguggcccgcgucgccgacaacaucaaccaggugaaccgcgagaucggguggauggagggcgggcagcuggcccucggcaaccccgcgcccaucccgcggcacgcccccaucccccgcuacuccaccuaccugaugcugcuccugaucgugagcuacgccuccgccugcagcgagcugauccaggcguccagccggaucaccacgugcuccaccgagggcgucaacaccaagugccgccugagccacaccgcccucauccgggccggguccgugggcgccgaggccugccugaugcugaagggggugaaggaggaccagacgaaguuccucaagaucaagaccgucagcuccgagcugagcugccgcgagggccaguccuacuggaccgggagcuucagccccaagugccuguccagccggcgcugccaccucgugggcgagugccacgugaaccggugccuguccuggcgcgacaacgagaccagcgcggaguucuccuucgucggcgagagcacgaccaugcgggagaacaagugcuucgagcagugcgggggcugggggugcggcugcuucaacgugaacccguccugccuguucgugcacaccuaccuccagagcguccgcaaggaggcccugcggguguucaacugcaucgacugggugcacaagcugacccucgagaucaccgacuucgacggguccgucagcacgaucgaccugggcgccuccagcucccgcuucaccaacuggggcagcgugucccugagccucgacgccgaggggaucuccggcagcaacuccuucagcuucaucgagagccccgggaagggcuacgccaucguggacgagcccuucuccgagaucccccggcagggguuccugggcgagauccgcugcaacagcgaguccagcguccuguccgcgcacgagagcugccuccgggccccgaaccugguguccuacaagcccaugaucgaccagcuggagugcaccaccaaccucaucgaccccuucguggucuucgagcgcggcagccugccccagacgcggaacgacaagaccuucgccgccuccaaggggaaccgcggcgugcaggccuucagcaagggguccgugcaggcggaccugacccuccgcuucgacaacuucgaggucgacuucgugggcgccgccgugagcugcgacgccgcguuccugaaccugaccgggugcuacuccugcaacgccggcgcccgggucugccucagcaucacguccaccggcaccgggacccugagcgcccacaacaaggacggcucccugcacaucgugcucccgagcgagaacgggacgaaggaccagugccagauccugcacuucaccgugcccgaggucgaggaggaguucauguacuccugcgacggcgacgagcgcccccugcucgugaagggcacccugaucgccaucgaccccuucgacgaccggcgcgaggccgggggcgagagcaccgucgugaaccccaagagcggguccuggaacuucuucgacugguucagcggccugauguccugguucgggggcccccucaagacgauccugcugaucugccucuacguggcccugagcaucggccuguucuuccuccugaucuaccuggggcggaccggccucuccaagauguggcuggccgccaccaagaaggccagcuga

SEQ ID NO: 12880 - RNA, 3480 nt, Artificial Sequence
  derived and/or modified CDS sequence (opt1) from RVFV(TAN/Dod-002/07)__HM586971.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagcaagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggccgcaagaagugcaccggggacgccgccuucugcagcgccuacgagugcacggcccaguacgcgaacgccuacugcucccacgccaacggcagcgggaucgugcagauccaggucuccggcguguggaagaagccccugugcgugggguacgagcgggucguggucaagcgcgagcugagcgccaagccgauccagcggguggagcccugcacgaccugcaucaccaagugcgagccccacggccuggugguccgcuccaccggcuucaagaucagcuccgcgguggccugcgccagcggggugugcgucaccggcucccagagccccuccaccgagaucacccucaaguacccggggaucagccaguccagcggcggggacaucggcgugcacauggcccacgacgaccaguccgugagcagcaagaucgucgcccacugcccgccccaggaccccugccuggugcacggcugcaucgugugcgcgcaggccuggaucaucucccaguggcacacggcccugagcgccuucgucgugaucuucguguucuccagcaccgccaucaucugccucgcgguccuguaccgggugcugaagugccucaagaucgcgccccgcaaggugcugaacccccugauguggaucaccgccuucauccggugggucuacaagaagaugguggcccgcguggccgacaacaucaaccaggucaaccgcgagaucggguggauggagggcgggcagcucgcccugggcaaccccgccccgaucccccggcacgcccccaucccccgcuacuccaccuaccugaugcuccugcugaucgugagcuacgccuccgcgugcagcgagcucauccaggccuccagccggaucacgaccugcuccaccgagggcgugaacaccaagugccgccugagcgggacggcccugauccgggccggcuccgucggggccgaggcgugccugaugcucaagggcgugaaggaggaccagaccaaguuccugaagaucaagaccgugagcuccgagcugagcugccgcgaggggcaguccuacuggaccggcagcuucagcccgaagugccucuccagccggcgcugccaccuggucggcgagugccacgugaaccggugccuguccuggcgcgacaacgagacgagcgccgaguucuccuucgugggggagagcaccaccaugcgggagaacaagugcuucgagcagugcggcggguggggcugcgggugcuucaacgucaaccccuccugccucuucgugcacaccuaccugcagagcgugcgcaaggaggcccugcgggucuucaacugcaucgacugggugcacaagcucacccuggagaucacggacuucgacggcuccgugagcaccaucgaccugggcgccuccagcucccgcuucaccaacugggggagcgucucccucagccuggacgccgagggcaucuccgggagcaacuccuucagcuucaucgagagccccggcaagggguacgcgaucguggacgagcccuucuccgagaucccgcggcagggcuuccugggcgagauccgcugcaacagcgaguccagcgugcucuccgcccacgagagcugccugcgggcccccaaccuggucuccuacaagcccaugaucgaccagcucgagugcaccacgaaccugaucgaccccuucgugguguucgagcgcgggagccugccgcagacccggaacgacaagaccuucgccgccuccaagggcaaccgcgggguccaggcguucagcaagggcuccgugcaggccgaccucacccugauguucgacaacuucgagguggacuucgucggggccgccgugagcugcgacgcggccuuccugaaccucacgggcugcuacuccugcaacgccggcgcccgcgugugccugagcaucaccuccaccgggaccggcacgcugagcgcccacaacaaggacgggucccuccacaucguccugcccagcgagaacggcaccaaggaccagugccagauccugcacuucaccgugcccgagguggaggaggaguucauguacuccugcgacggcgacgagcggccccuccuggucaaggggacccugaucgcgaucgacccguucgacgaccgccgggaggccggcggggagagcacgguggucaaccccaagagcggcuccuggaacuucuucgacugguucagcgggcucauguccugguucggcggcccccugaagaccauccugcucaucugccuguacguggcccugagcaucggccucuucuuccugcugaucuaccucgggcgcaccgggcuguccaagauguggcuggccgccaccaagaaggcgagcuga

SEQ ID NO: 12881 - RNA, 3480 nt, Artificial Sequence
  derived and/or modified CDS sequence (opt1) from RVFV(Smithburn)__DQ380193.1__NSm-Gn-Gc
augaucgagggcgccugggacagccugcgcgaggaggagaugcccgaggagcucuccugcagcaucuccgggauccgggaggugaagaccagcucccaggagcuguaccgcgcccugaaggcgaccaucgccgccgacggccucaacaacaucacgugccacgggaaggacccggaggacaagaucagccugaucaagggcccgccccacaagaagcgggucgggguggugcgcugcgagcggcagcgcgacgccaagcagaucggccggggcaccauggccgggaucgcgaugaccgucuuccccgcccuggugguguucgcccucgcccccgucguguucgcggaggacccccaccuccgcaaccggcccggcaaggggcacaacuacaucgacggcaugacccaggaggacgccacgugcaagcccgugaccuacgccggggccugcuccagcuucgacguccugcuggagaagggcaaguucccgcuguuccaguccuacgcccaccaccgcacccugcucgaggcggugcacgacaucaucaucgccaaggccgacccgcccagcugcaaccugcaguccgcccacggcaaccccugcaugaaggagaagcuggugaugaagaccuacugccccaacgacuaccagagcgcccacuaccucaacaacgacgggaagauggcguccgucaagugcccgcccaagcacgagcugacggaggacugcaacuucugccggcagaugaccggcgccagccugaaggagggguccuacccccuccaggaccuguucugccagagcuccgaggacgacggcagcaagcugaagaccaagaugaagggcgugugcgagguggggguccaggugcucaagaagugcgacggccagcuguccaccgcccacgaggugguccccuucgccguguucaagaacagcaagaagguguaccuggacaagcucgaccugaagacggaggagaaccugcuccccgacagcuucgucugcuucgagcacaaggggcaguacaagggcaccauggacuccgggcagaucaagcgcgagcucaagagcuucgacaucucccagugccccaagaucggcggccacgggagcaagaagugcaccggcgacgccgcguucugcuccgccuacgagugcaccgcccaguacgccaacgccuacugcagccacgcgaacggguccggcaucgugcagauccaggugagcggggucuggaagaagccccugugcgugggcuacgagcgggucguggugaagcgcgagcuguccgccaagccgauccagcgggucgagcccugcacgaccugcaucaccaagugcgagccccacggccugguggugcgcagcaccggguucaagaucuccagcgccgucgccugcgcguccggcgugugcgugacggggagccagucccccagcaccgagaucacccugaaguacccgggcaucucccagagcuccgggggcgacaucggcguccacauggcccacgacgaccagagcgugagcuccaagaucguggcccacugcccgccccaggaccccugccucguccacgggugcaucgugugcgcccacggccugaucaacuaccagugccacaccgccuucagcgcguucguggucguguucguguucuccagcgucgugaucaucugccuggccauccucuacaaggugcugaagugccugaagaucgcgccccggaagguccucaacccccugauguggaucacggccuucauccgcuggguguacaagaagaugguggcccgggucgccgacaacaucaaccaggugaaccgcgagaucggguggauggagggcggccagcuggugcucgggaaccccgccccgaucccccggcacgcccccaucccccgcuacuccaccuaccugaugcugcuccugaucgucagcuacgccuccgccugcagcgagcugauccaggcguccagccgcaucacgaccugcuccaccgagggcgugaacaccaagugccggcucagcgggaccgcccugauccgcgccggcuccgugggggccgaggcgugccugaugcugaagggcgucaaggaggaccagaccaaguuccucaagaucaagacggugagcuccgagcugagcugccgggagggccaguccuacuggaccgggagcuucagcccgaagugccuguccagccgccggugccaccucgugggcgagugccacgucaaccgcugccuguccuggcgggacaacgagaccagcgccgaguucuccuucgugggggagagcaccacgaugcgcgagaacaagugcuucgagcagugcggcggguggggcugcggcugcuucaacgugaaccccuccugccuguucguccacaccuaccuccagagcgugcggaaggaggcccugcgcguguucaacugcaucgacuggguccacaagcugacccucgagaucaccgacuucgacggguccgugagcaccguggaccugggcgccuccagcucccgguucacgaacugggggagcgucucccugagccucgacgccgagggcaucuccgggagcaacuccuucagcuucaucgagagccccggcaagggcuacgcgaucguggacgagcccuucuccgagaucccgcgccagggguuccugggcgagauccggugcaacagcgaguccagcgugcuguccgcccacgagagcugccuccgcgcccccaaccugaucuccuacaagcccaugaucgaccagcuggagugcaccaccaaccucaucgaccccuucgucguguucgagcgggggagccugccgcagacccgcaacgacaagacguucgccgccuccaagggcaaccgcggggugcaggcguucagcaagggcuccguccaggccgaccugacccucauguucgacaacuucgagguggacuucgugggcgccgccgucagcugcgacgccgcguuccugaaccugaccgggugcuacuccugcaacgccggcgcccgggugugccucagcaucaccuccacggggaccggcacccugagcgcccacaacaaggacggcucccugcacaucguccuccccagcgagaacgggaccaaggaccagugccagauccugcacuucacggugcccgagguggaggaggaguucauguacuccugcgacggcgacgagcggccccugcucgucaaggggacccugaucgcgaucgacccguucgacgaccgccgcgaggccggcggggagagcaccguggugaaccccaagagcggcuccuggaacuucuucgacugguucagcggccugauguccugguucgggggcccccucaagaccauccugcugaucugccucuacgucgcccugagcaucgggcuguucuucuuccucaucuaccugggccggacggggcuguccaagauguggcucgccgccaccaagaaggcgagcuga

SEQ ID NO: 12882 - RNA, 3480 nt, Artificial Sequence
  derived and/or modified CDS sequence (opt1) from RVFV(KEN/Gar-004/06)__HM586964.1__NSm-Gn-Gc
augaucgagggcgccugggacagccugcgcgaggaggagaugcccgaggagcucuccugcagcguguccgggauccgggaggucaagaccagcucccaggagcuguaccgcgcccugaaggcgaucaucgccgccgacggccucaacaacaucacgugccacgggaagaacccggaggacaagaucagccugaucaagggcccgccccacaagaagcggguggggaucgugcgcugcgagcggcgccgggacgccaagcagaucggccgcgagaccauggccggcaucgcgaugaccguccugcccgcccucgccguguucgcccuggcgcccguggucuucgccgaggacccccaccuccggaaccgccccgggaagggccacaacuacaucgacgggaugacccaggaggacgcgaccugcaagcccgugacguacgccggcgccugcuccagcuucgacgugcugcuggagaaggggaaguucccgcuguuccaguccuacgcccaccaccggacccuccuggaggccguccacgacaccaucaucgccaaggccgacccgcccagcugcgaccugcaguccgcccacggcaaccccugcaugaaggagaagcucgugaugaagacccacugccccaacgacuaccagagcgcgcacuaccugaacaacgacggcaagauggccuccgugaagugcccgcccaaguacgagcugacggaggacugcaacuucugccgccagaugaccggggccagccucaagaagggcuccuacccccugcaggaccuguucugccagagcuccgaggacgacgggagcaagcucaagaccaagaugaagggcgucugcgaggugggcgugcaggcccugaagaagugcgacgggcagcuguccaccgcccacgaggucgugcccuucgcgguguucaagaacagccagaaggucuaccucgacaagcuggaccugaagacggaggagaaccuccugcccgacagcuucgugugcuucgagcacaagggccaguacaaggggaccauggacuccggccagaccaagcgggagcucaagagcuucgacaucucccagugccccaagaucgggggccacggccgcaagaagcggaccggggacgccgccuucugcagcgccuacgagugcacggcccaguacgcgaacgccuacugcucccgcgccaacggcagcgggaucgugcagauccaggucucccggguguggaagaagccccugugcgugggcuacgagcgcgucguggucaagcgggagcugagcgccaagccgauccagcgcguggagcccugcacgaccugcaucaccaagugcgagccccacgggcuggugguccgguccaccggcuucaagaucagcuccgcgguggccugcgccagcggcgugugcgucaccgggucccagagccccuccaccgagaucacccucaaguacccgggcaucagccaguccagcgggggcgacaucggggugcacauggcccacgacgaccaguccgugagcagcaagaucgucgcccacugcccgccccaggaccccugccuggugcacggcugcaucgugugcgcgcacggccugaucaacaaccagucccacagcgcccucuccgccuucgucgugaucuucguguucagcuccacggccaucaucugccuggccguccuguaccgcgugcucaagugccugaagaucgcgccccgcaaggugcugaacccccucauguggaucaccgccuucauccggugggucuacaagaagaugguggcccgcguggccgacaacaucaaccaggucaaccgggagaucggguggauggagggcgggcagcuggcccugggcaaccccgcgccgaucccccgccacgcccccaucccccgguacagcaccuaccucaugcugcugcucaucguguccuacgccagcgccugcuccgagcugauccaggcgagcucccgcaucaccacgugcagcaccgagggcgugaacaccaagugccggcuguccgggaccgcccugauccgcgccggcagcgucggggccgaggccugccucaugcugaagggcgugaaggaggaccagacgaaguuccugaagaucaagaccguguccagcgagcucuccugccgggaggggcagagcuacuggaccggcagcuucuccccgaagugccugagcucccgccggugccaccuggucggcgagugccacgugaaccgcugccucagcuggcgggacaacgagaccuccgcggaguucagcuucgugggggaguccacgaccaugcgcgagaacaagugcuucgagcagugcggcggguggggcugcgggugcuucaacgucaaccccagcugccuguucgugcacaccuaccugcaguccgugcggaaggaggcccuccgcgucuucaacugcaucgacugggugcacaagcugacccuggagaucaccgacuucgacggcagcguguccacgaucgaccucggcgccagcuccagccgguucaccaacuggggguccgucagccugucccuggacgccgagggcaucagcggguccaacagcuucagcuucaucgagucccccggcaagggguacgccaucguggacgagcccuucagcgagaucccgcgccagggcuuccucggcgagauccggugcaacuccgagagcuccgugcugagcgcgcacgaguccugccugcgcgcccccaaccucgucagcuacaagcccaugaucgaccagcuggagugcaccaccaaccugaucgaccccuucgugguguucgagcgcgggucccucccgcagacgcggaacgacaagaccuucgccgccagcaagggcaaccgcgggguccaggccuucuccaagggcagcgugcaggcggaccugacccugcgguucgacaacuucgagguggacuucgucggggccgccguguccugcgacgccgcguuccucaaccugaccggcugcuacagcugcaacgccggcgcccgcgugugccuguccaucacgagcaccgggaccggcacccucuccgcccacaacaaggacgggagccugcacaucguccugcccuccgagaacggcacgaaggaccagugccagauccuccacuucaccgugcccgagguggaggaggaguucauguacagcugcgacggcgacgagcggccccugcuggucaaggggacccucaucgccaucgacccguucgacgaccgccgggaggcgggcggggagagcaccguggucaaccccaaguccggcagcuggaacuucuucgacugguucuccgggcugaugagcugguucggcggcccccugaagacgauccuccugaucugccuguacguggcccucuccaucgggcuguucuuccugcucaucuaccugggccgcaccgggcugagcaagauguggcucgccgccaccaagaaggccuccuga

SEQ ID NO: 12883 - RNA, 3204 nt, Artificial Sequence
  derived and/or modified CDS sequence (opt1) from RVFV(ZH-548)__DQ380206.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgccgacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgccugcuccgagcugauccaggccagcucccgcaucacgaccugcagcaccgagggggugaacaccaagugccggcucuccggcacggcccugauccgcgccggcagcgugggggcggaggccugccugaugcucaagggcgucaaggaggaccagaccaaguuccugaagaucaagaccguguccagcgagcuguccugccgggaggggcagagcuacuggaccggcuccuucagcccgaagugccuguccagccgccggugccaccucgugggcgagugccacgucaaccgcugccuguccuggcgcgacaacgagacgagcgccgaguucuccuucgugggggagagcaccaccaugcgggagaacaagugcuucgagcagugcggcggguggggcugcgggugcuucaacgugaaccccagcugccuguucguccacaccuaccuccaguccgugcgcaaggaggcccugcggguguucaacugcaucgacuggguccacaagcugacgcucgagaucaccgacuucgacggcagcguguccaccaucgaccugggcgcgagcuccagccgcuucaccaacuggggguccgugagccugucccucgacgccgagggcaucagcggguccaacagcuucuccuucaucgagagccccggcaagggguacgccaucgucgacgagcccuucuccgagaucccgcggcagggcuuccugggcgagauccgcugcaacagcgaguccagcgugcuguccgcccacgagagcugccuccgggcccccaaccugaucagcuacaagcccaugaucgaccagcuggagugcaccacgaaccucaucgaccccuucguggucuucgagcgcgggucccugccgcagacccggaacgacaagaccuucgcggccagcaagggcaaccgcggggugcaggccuucuccaagggcagcgugcaggccgaccugacccucauguucgacaacuucgaggucgacuucgugggggccgcgguguccugcgacgccgccuuccugaaccugacgggcugcuacagcugcaacgccggcgcccgggucugccucuccaucaccagcaccgggaccggcucccugagcgcgcacaacaaggacgggucccugcacaucgugcuccccagcgagaacggcacgaaggaccagugccagauccugcacuucaccgugcccgaggucgaggaggaguucauguacuccugcgacggggacgagcgcccccugcucgugaagggcacccugaucgccaucgacccguucgacgaccggcgcgaggccggcggggagagcaccguggucaaccccaaguccggcagcuggaacuucuucgacugguucuccgggcugaugagcugguucggcggcccccucaagacgauccugcugaucugccucuacguggcccuguccaucgggcuguucuuccuccugaucuaccugggccggaccgggcucagcaagauguggcuggcggccaccaagaaggccagcuga

SEQ ID NO: 12884 - RNA, 3204 nt, Artificial Sequence
  derived and/or modified CDS sequence (opt1) from RVFV(2007000094)__EU574055.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgacaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggacgcucuccgcgcacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacccucaucgccaucgacccguucgacgaccggcgcgaggccgggggcgaguccacggucgugaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12885 - RNA, 3204 nt, Artificial Sequence
  derived and/or modified CDS sequence (opt1) from RVFV(ZH-548M12)__M25276.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcuccuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccaccaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgccgacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgccugcuccgagcugauccaggccagcucccgcaucacgaccugcagcaccgagggggugaacaccaagugccggcucuccggcacggcccugauccgcgccggcagcgugggggcggaggccugccugaugcucaagggcgucaaggaggaccagaccaaguuccugaagcugaagaccguguccagcgagcuguccugccgggaggggcagagcuacuggaccggcuccuucagcccgaagugccucuccagccgccggugccaccuggugggcgagugccacgucaaccgcugccuguccuggcgcgacaacgagacgagcgccgaguucuccuucgugggggagagcaccaccaugcgggagaacaagugcuucgagcagugcggcggguggggcugcgggugcuucaacgugaaccccagcugccucuucguccacaccuaccugcaguccgugcgcaaggaggcccugcggguguucaacugcaucgacuggguccacaagcucacgcuggagaucaccgacuucgacggcagcguguccaccaucgaccugggcgcgagcuccagccgcuucaccaacuggggguccgugagccucucccuggacgccgagggcaucagcggguccaacagcuucuccuucaucgagagccccggcaagggguacgccaucgucgacgagcccuucuccgagaucccgcggcagggcuuccugggcgagauccgcugcaacagcgaguccagcgugcucuccgcccacgagagcugccugcgggcccccaaccugaucagcuacaagcccaugaucgaccagcucgagugcaccacgaaccugaucgaccccuucguggucuucgagcgcgggucccugccgcagacccggaacgacaagaccuucgcggccagcaagggcaaccgcggggugcaggccuucuccaagggcagcgugcaggccgaccucacccugauguucgacaacuucgaggucgacuucgugggggccgcgguguccugcgacgccgccuuccugaaccucacgggcugcuacagcugcaacgccggcgcccgggucugccuguccaucaccagcaccgggaccggcucccugagcgcgcacaacaaggacgggucccuccacaucgugcugcccagcgagaacggcacgaaggaccagugccagauccugcacuucaccgugcccgaggucgaggaggaguucauguacuccugcgacggggacgagcgcccccuccuggugaagggcacccugaucgccaucgacccguucgacgaccggcgcgaggccggcggggagagcaccguggucaaccccaaguccggcagcuggaacuucuucgacugguucuccgggcucaugagcugguucggcggcccccugaagacgauccugcucaucugccuguacguggcccuguccaucgggcuguucuuccugcugaucuaccucggcgggaccggccugagcaagauguggcuggcggccaccaagaaggccagcuga

SEQ ID NO: 12886 - RNA, 3204 nt, Artificial Sequence
  derived and/or modified CDS sequence (opt1) from RVFV(Sudan 86-2010)__JQ820489.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucaucuucgagcgcggcucccucccgcagacccggaacgacaagaccuucgcggccagcaaggggaaccgcggcgugcaggccuucuccaaggggagcgugcaggccgaccugacccugauguucgacaacuucgaggucgacuucgugggcgccgcgguguccugcgacgccgccuuccucaaccugacgggcugcuacagcugcaacgccggggcccgggucugccuguccaucaccagcaccggcaccgggacgcucuccgcgcacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacccucaucgccaucgacccguucgacgaccggcgcgaggccgggggcgaguccacgguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12887 - RNA, 3204 nt, Artificial Sequence
  derived and/or modified CDS sequence (opt1) from RVFV(ZS-6365)__DQ380205.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggaucuacaagaagaugguggcccgcgucgccgacaacaucaaccaggugaaccgggagaucggcuggauggagggcgggcagcuggugcuggggaaccccgcccccaucccgcgccacgcccccaucccccgguacuccaccuaccucaugcugcugcucaucgucagcuacgcgagcgccugcuccgagcugauccaggccagcucccgcaucacgaccugcagcaccgagggcgugaacaccaagugccggcuguccggcacggcccucauccgcgccgggagcgugggcgcggaggccugccugaugcugaagggggucaaggaggaccagaccaaguuccucaagaucaagaccguguccagcgagcuguccugccgggagggccagagcuacuggaccggcuccuucagcccgaagugccuguccagccgccggugccaccuggugggggagugccacgucaaccgcugccucuccuggcgcgacaacgagacgagcgccgaguucuccuucgugggcgagagcaccaccaugcgggagaacaagugcuucgagcagugcgggggcugggggugcggcugcuucaacgugaaccccagcugccuguucguccacaccuaccugcaguccgugcgcaaggaggcccuccggguguucaacugcaucgacuggguccacaagcugacgcuggagaucaccgacuucgacggcagcguguccaccaucgaccucggggcgagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucguggucuucgagcgcggcucccucccgcagacccggaacgacaagaccuucgcggccagcaaggggaaccgcggcgugcaggccuucuccaaggggagcgugcaggccgaccugacccugauguucgacaacuucgaggucgacuucgugggcgccgcgguguccugcgacgccgccuuccucaaccugacgggcugcuacagcugcaacgccggggcccgggucugccuguccaucaccagcaccggcaccgggucccucagcgcgcacaacaaggacggcucccugcacaucgugcugcccagcgagaacgggacgaaggaccagugccagauccuccacuucaccgugcccgaggucgaggaggaguucauguacuccugcgacggcgacgagcgcccccugcuggugaagggcacccucaucgccaucgacccguucgacgaccggcgcgaggccgggggcgagagcaccguggucaaccccaaguccgggagcuggaacuucuucgacugguucuccggccugaugagcugguucggcgggccccugaagacgauccuccugaucugccuguacguggcccucuccaucggccuguucuuccugcucaucuaccuggggcggaccggccugagcaagauguggcucgcggccaccaagaaggccagcuga

SEQ ID NO: 12888 - RNA, 3204 nt, Artificial Sequence
  derived and/or modified CDS sequence (opt1) from RVFV(1853/78)__DQ380220.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcaucgccaucaucugccuggccauccuguaccgggugcucaagugccugaagaucgcgccccgcaaggugcugaacccccucauguggaucaccgccuucauccggugggucuacaagaagaugguggcccgcguggccgacaacaucaaccaggucaaccgggagaucggcuggauggagggcgggcagcuggugcuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgucaacaccaagugccggcuguccggcacggcccucauccgcgccgggagcgugggcgcggaggccugccugaugcugaagggggugaaggaggaccagaccaaguuccucaagaucaagaccgucuccagcgagcuguccugccgggagggccagagcuacuggaccggcuccuucagcccgaagugccuguccagccgccggugccaccuggugggggagugccacgugaaccgcugccucuccuggcgcgacaacgagacgagcgccgaguucuccuucgucggcgagagcaccaccaugcgggagaacaagugcuucgagcagugcgggggcugggggugcggcugcuucaacgugaaccccagcugccuguucgugcacaccuaccugcaguccguccgcaaggaggcccuccggguguucaacugcaucgacugggugcacaagcugacgcuggagaucaccgacuucgacggcagcgucuccaccaucgaccucggggcgagcuccagccgcuucaccaacuggggcuccgugagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcguccuguccgcccacgagagcugccugcgggcccccaaccucaucagcuacaagcccaugaucgaccagcuggagugcaccacgaaccugaucgaccccuucgugguguucgagcgcggcucccucccgcagacccggaacgacaagaccuucgcggccagcaaggggaaccgcggcguccaggccuucuccaaggggagcgugcaggccgaccugacccugauguucgacaacuucgagguggacuucgucggcgccgcgguguccugcgacgccgccuuccucaaccugacgggcugcuacagcugcaacgccggggcccgggugugccuguccaucaccagcaccggcaccgggacgcucuccgcgcacaacaaggacggcagccugcacaucguccugcccuccgagaacgggaccaaggaccagugccagauccuccacuucaccgugcccgagguggaggaggaguucauguacagcugcgacggcgacgagcgcccccugcuggucaagggcacccucaucgccaucgacccguucgacgaccggcgcgaggccgggggcgaguccacgguggugaaccccaagagcggguccuggaacuucuucgacugguucagcggccugauguccugguucggcgggccccugaagaccauccuccugaucugccuguacgucgcccucagcaucggccuguucuuccugcucaucuaccuggggcggaccggccuguccaagauguggcucgcggccaccaagaaggccagcuga

SEQ ID NO: 12889 - RNA, 3204 nt, Artificial Sequence
  derived and/or modified CDS sequence (opt1) from RVFV(T1)__DQ380201.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccguccuguaccgggugcucaagugccugaagaucgcgccccgcaaggugcugaacccccucauguggaucaccgccuucauccgguggaucuacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgacaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggucccucagcgcgcacaacaaggacggcucccugcacaucgugcugcccagcgagaacgggacgaaggaccagugccagauccuccacuucaccguccccgagguggaggaggaguucauguacuccugcgacggcgacgagcgcccccugcuggugaagggcacccucaucgccaucgacccguucgacgaccggcgcgaggccgggggcgagagcaccgucgugaaccccaaguccgggagcuggaacuucuucgacugguucuccggccugaugagcugguucggcgggccccugaagacgauccuccugaucugccuguacguggcccucuccaucggccuguucuuccugcucaucuaccuggggcggaccggccugagcaagauguggcucgcggccaccaagaaggccagcuga

SEQ ID NO: 12890 - RNA, 3204 nt, Artificial Sequence
  derived and/or modified CDS sequence (opt1) from RVFV(Kenya 83 (21445))__DQ380198.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccaccuaccucaugcugcugcucaucgucagcuacgccagcgccugcuccgagcugauccaggccagcucccgcaucacgaccugcagcaccgagggcgugaacaccaagugccggcuguccggcacggcccucauccgcgcggggagcgugggcgccgaggccugccugaugcugaagggggucaaggaggaccagaccaaguuccucaagaucaagaccguguccagcgagcuguccugccgggagggccagagcuacuggaccggcuccuucagcccgaagugccuguccagccgccggugccaccuggugggggagugccacgucaaccgcugccucuccuggcgcgacaacgagacgagcgccgaguucuccuucgugggcgagagcaccaccaugcgggagaacaagugcuucgagcagugcgggggcugggggugcggcugcuucaacgugaaccccagcugccuguucguccacaccuaccugcaguccgugcgcaaggaggcgcuccggguguucaacugcaucgacuggguccacaagcugacgcuggagaucaccgacuucgacggcagcguguccaccaucgaccucggggccagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcgcccaaccucaucagcuacaagcccaugaucgaccagcuggagugcaccacgaaccugaucgaccccuucguggucuucgagcgcggcucccucccgcagacccggaacgacaagaccuucgccgccagcaaggggaaccgcggcgugcaggccuucuccaaggggagcgugcaggccgaccugacccugauguucgacaacuucgaggucgacuucgugggcgcggccguguccugcgacgccgccuuccucaaccugacgggcugcuacagcugcaacgccggggcgcgggucugccuguccaucaccagcaccggcaccgggacgcucuccgcccacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacccucaucgccaucgacccguucgacgaccggcgcgaggccgggggcgaguccacgguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccaccaagaaggccagcuga

SEQ ID NO: 12891 - RNA, 3204 nt, Artificial Sequence
  derived and/or modified CDS sequence (opt1) from RVFV(Sudan 85-2010)__JQ820488.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgagaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggacgcucuccgcgcacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacccucaucgccaucgacccguucgacgaccggcgcgaggccgggggcgaguccacggucgugaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12892 - RNA, 3204 nt, Artificial Sequence
  derived and/or modified CDS sequence (opt1) from RVFV(2007004194)__EU574031.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugagcaacgacggcaagauggcguccgugaagugcccgcccaaguacgagcugaccgaggacugcaacuucugccggcagaugaccggggccagccucaagaagggcuccuacccccugcaggaccuguucugccagagcuccgaggacgacgggagcaagcucaagaccaagaugaagggcgugugcgaggucggggugcaggcccugaagaagugcgacggccagcuguccacggcccacgaggugguccccuucgccguguucaagaacagcaagaagguguaccucgacaagcuggaccugaagaccgaggagaaccuccugcccgacuccuucgucugcuucgagcacaagggccaguacaaggggaccauggacagcggccagaccaagcgcgagcugaaguccuucgacaucagccagugccccaagaucgggggccacggcuccaagaagugcacgggggacgcggccuucugcagcgccuacgagugcaccgcccaguacgccaacgcguacugcagccacgccaacggcuccgggaucgugcagauccaggugagcggcgucuggaagaagccccucugcgugggguacgagcggguggucgugaagcgcgagcuguccgccaagccgauccagcggguggagcccugcacgaccugcaucaccaagugcgagccccacggccuggucgugcgcagcaccggcuucaagaucuccagcgccgucgccugcgcguccggggugugcgugaccggcagccagucccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacagcaccuaccucaugcugcugcucaucgugagcuacgcguccgccugcagcgagcugauccaggccuccagccgcaucacgaccugcuccaccgagggcgugaacaccaagugccggcugagcggcacggcccucauccgcgccggguccgucggcgcggaggccugccugaugcugaagggggugaaggaggaccagaccaaguuccucaagaucaagaccgugagcuccgagcugagcugccgggagggccaguccuacuggaccggcagcuucuccccgaagugccugagcucccgccggugccaccuggucggggagugccacgugaaccgcugccucagcuggcgcgacaacgagacguccgccgaguucagcuucgugggcgagagcaccaccaugcgggagaacaagugcuucgagcagugcgggggcugggggugcggcugcuucaacgucaaccccuccugccuguucgugcacaccuaccugcagagcgugcgcaaggaggcccuccgggucuucaacugcaucgacugggugcacaagcugacgcuggagaucaccgacuucgacggcuccgugagcaccaucgaccucggggcguccagcucccgcuucaccaacuggggcagcgucucccugagccuggacgccgaggggaucuccggcagcaacuccuucagcuucaucgagucccccgggaagggcuacgccaucguggacgagcccuucagcgagaucccgcggcagggcuuccucggggagauccgcugcaacuccgagagcuccgugcugagcgcccacgagagcugccugcgggcccccaaccucaucuccuacaagcccaugaucgaccagcuggagugcaccacgaaccugaucgaccccuucgucguguucgagcgcggcagccucccgcagacccggaacgacaagaccuucgcggccuccaaggggaaccgcggcgugcaggccuucagcaagggguccguccaggccgaccugacccugauguucgacaacuucgagguggacuucgugggcgccgcggucagcugcgacgccgccuuccucaaccugacgggcugcuacuccugcaacgccggggcccgggugugccugagcaucaccuccaccggcaccgggacgcucagcgcgcacaacaaggacggcucccugcacaucgugcugcccagcgagaacgggaccaaggaccagugccagauccuccacuucaccguccccgagguggaggaggaguucauguacuccugcgacggcgacgagcgcccccugcuggugaagggcacccucaucgccaucgacccguucgacgaccggcgcgaggccgggggcgagagcacggucgugaaccccaaguccgggagcuggaacuucuucgacugguucuccggccugaugagcugguucggcgggccccugaagaccauccuccugaucugccuguacguggcccucuccaucggccuguucuuccugcucaucuaccuggggcggaccggccugagcaagauguggcucgcggccaccaagaaggccagcuga

SEQ ID NO: 12893 - RNA, 3204 nt, Artificial Sequence
  derived and/or modified CDS sequence (opt1) from RVFV(2250/74)__DQ380209.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggaucuacaagaagaugguggcccgcgucgccgacaacaucaaccaggugaaccgggagaucggcuggauggagggcgggcagcuggugcuggggaaccccgcccccaucccgcgccacgcccccaucccccgguacuccaccuaccucaugcugcugcucaucgucagcuacgcgagcgccugcuccgagcugauccaggccagcucccgcaucacgaccugcagcaccgagggcgugaacaccaagugccggcuguccggcacggcccucauccgcgccgggagcgugggcgcggaggccugccugaugcugaagggggucaaggaggaccagaccaaguuccucaagaucaagaccguguccagcgagcuguccugccgggagggccagagcuacuggaccggcuccuucagcccgaagugccuguccagccgccggugccaccuggugggggagugccacgucaaccgcugccucuccuggcgcgacaacgagacgagcgccgaguucuccuucgugggcgagagcaccaccaugcgggagaacaagugcuucgagcagugcgggggcugggggugcggcugcuucaacgugaaccccagcugccuguucguccacaccuaccugcaguccgugcgcaaggaggcccuccggguguucaacugcaucgacuggguccacaagcugacgcuggagaucaccgacuucgacggcagcguguccaccaucgaccucggggcgagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucguggucuucgagcgcggcucccucccgcagacccggaacgacaagaccuucgcggccagcaaggggaaccgcggcgugcaggccuucuccaaggggagcgugcaggccgaccugacccugauguucgacaacuucgaggucgacuucgugggcgccgcgguguccugcgacgccgccuuccucaaccugacgggcugcuacagcugcaacgccggggccaaggucugccuguccaucaccagcaccggcaccgggucccucagcgcgcacaacaaggacggcucccugcacaucgugcugcccagcgagaacgggacgaaggaccagugccagauccuccacuucaccgugcccgaggucgaggaggaguucauguacuccugcgacggcgacgagcggccccugcuggugaagggcacccucaucgccaucgacccguucgacgaccgccgggaggccgggggcgagagcaccguggucaaccccaaguccgggagcuggaacuucuucgacugguucuccggccugaugagcugguucggcgggccccugaagacgauccuccugaucugccuguacguggcccucuccaucggccuguucuuccugcucaucuaccuggggcgcaccggccugagcaagauguggcucgcggccaccaagaaggccagcuga

SEQ ID NO: 12894 - RNA, 3204 nt, Artificial Sequence
  derived and/or modified CDS sequence (opt1) from RVFV(Sudan 28-2010)__JQ820491.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgacaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggacgcucuccgcgcacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacccucaucgccaucgacccguucgacgaccggcgcgaggccgggggcgaguccacggucgugaaccccaagagcggguccuggaacuucuucgacugguucagcggccugauguccugguucggcgggccccugaagaccauccuccugaucugccuguacgugguccucagcaucggccuguucuuccugcucaucuaccuggggcggaccggccuguccaagauguggcucgccgcgaccaagaaggccagcuga

SEQ ID NO: 12895 - RNA, 3204 nt, Artificial Sequence
  derived and/or modified CDS sequence (opt1) from RVFV(2007000324)__JF326195.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccacguaccucaugcugcugcucaucgucagcuacgccagcgccugcuccgagcugauccaggccagcucccgcaucacgaccugcagcaccgagggcgugaacaccaagugccggcuguccggcaccgcccucauccgcgcggggagcgugggcgccgaggccugccugaugcugaagggggucaaggaggaccagaccaaguuccucaagaucaagaccguguccagcgagcuguccugccgggagggccagagcuacuggacgggcuccuucagcccgaagugccuguccagccgccggugccaccuggugggggagugccacgucaaccgcugccucuccuggcgcgacaacgagaccagcgccgaguucuccuucgugggcgagagcaccaccaugcgggagaacaagugcuucgagcagugcgggggcugggggugcggcugcuucaacgugaaccccagcugccuguucguccacacguaccugcaguccgugcgcaaggaggcgcuccggguguucaacugcaucgacuggguccacaagcugacccuggagaucaccgacuucgacggcagcguguccaccaucgaccucggggccagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcgcccaaccucgugagcuacaagcccaugaucgaccagcuggagugcacgaccaaccugaucgaccccuucgucguguucgagcgcggcucccucccgcagacccggaacgacaagaccuucgccgccagcaaggggaaccgcggcgugcaggccuucuccaaggggagcguccaggccgaccugacgcugauguucgacaacuucgagguggacuucgugggcgcggccgucuccugcgacgccgccuuccucaaccugaccggcugcuacagcugcaacgccggggcgcgggugugccuguccaucaccagcaccggcacggggacccucuccgcccacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacgcucaucgccaucgacccguucgacgaccggcgcgaggccgggggcgaguccaccgucgugaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccacgaagaaggccagcuga

SEQ ID NO: 12896 - RNA, 3204 nt, Artificial Sequence
  derived and/or modified CDS sequence (opt1) from RVFV(ZM-657)__DQ380204.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaaggcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggaucuacaagaagaugguggcccgcgucgccgacaacaucaaccaggugaaccgggagaucggcuggauggagggcgggcagcuggugcuggggaaccccgcccccaucccgcgccacgcccccaucccccgguacuccaccuaccucaugcugcugcucaucgucagcuacgcgagcgccugcuccgagcugauccaggccagcucccgcaucacgaccugcagcaccgagggcgugaacaccaagugccggcuguccggcacggcccucauccgcgccgggagcgugggcgcggaggccugccugaugcugaagggggucaaggaggaccagaccaaguuccucaagaucaagaccguguccagcgagcuguccugccgggagggccagagcuacuggaccggcuccuucagcccgaagugccuguccagccgccggugccaccuggugggggagugccacgucaaccgcugccucuccuggcgcgacaacgagacgagcgccgaguucuccuucgugggcgagagcaccaccaugcgggagaacaagugcuucgagcagugcgggggcugggggugcggcugcuucaacgugaaccccagcugccuguucguccacaccuaccugcaguccgugcgcaaggaggcccuccggguguucaacugcaucgacuggguccacaagcugacgcuggagaucaccgacuucgacggcagcguguccaccaucgaccucggggcgagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucguggucuucgagcgcggcucccucccgcagacccggaacgacaagaccuucgcggccagcaaggggaaccgcggcgugcaggccuucuccaaggggagcgugcaggccgaccugacccugauguucgacaacuucgaggucgacuucgugggcgccgcgguguccugcgacgccgccuuccucaaccugacgggcugcuacagcugcaacgccggggcccgggucugccuguccaucaccagcaccggcaccgggucccucagcgcgcacaacaaggacggcucccugcacaucgugcugcccagcgagaacgggacgaaggaccagugccagauccuccacuucaccgugcccgaggucgaggaggaguucauguacuccugcgacggcgacgagcgcccccugcuggugaagggcacccucaucgccaucgacccguucgacgaccggcgcgaggccgggggcgagagcaccguggucaaccccaaguccgggagcuggaacuucuucgacugguucuccggccugaugagcugguucggcgggccccugaagacgauccuccugaucugccuguacguggcccucuccaucggccuguucuuccugcucaucuaccuggggcggaccggccugagcaagauguggcucgcggccaccaagaaggccagcuga

SEQ ID NO: 12897 - RNA, 3204 nt, Artificial Sequence
  derived and/or modified CDS sequence (opt1) from RVFV(T-46 (228113))__DQ380199.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccaaggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccguccuguaccgggugcucaagugccugaagaucgcgccccgcaaggugcugaacccccucauguggaucaccgccuucauccgguggaucuacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgacaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggucccucagcgcgcacaacaaggacggcucccugcacaucgugcugcccagcgagaacgggacgaaggaccagugccagauccuccacuucaccguccccgagguggaggaggaguucauguacuccugcgacggcgacgagcgcccccugcuggugaagggcacccucaucgccaucgacccguucgacgaccggcgcgaggccgggggcgagagcaccgucgugaaccccaaguccgggagcuggaacuucuucgacugguucuccggccugaugagcugguucggcgggccccugaagacgauccuccugaucugccuguacguggcccucuccaucggccuguucuuccugcucaucuaccuggggcggaccggccugagcaagauguggcucgcggccaccaagaaggccagcuga

SEQ ID NO: 12898 - RNA, 3204 nt, Artificial Sequence
  derived and/or modified CDS sequence (opt1) from RVFV(MP12)__Z30318.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcuccuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccaccaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgcccacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgccugcuccgagcugauccaggccagcucccgcaucacgaccugcagcaccgagggggugaacaccaagugccggcucuccggcacggcccugauccgcgccggcagcgugggggcggaggccugccugaugcucaagggcgucaaggaggaccagaccaaguuccugaagcugaagaccguguccagcgagcuguccugccgggaggggcagagcuacuggaccggcuccuucagcccgaagugccucuccagccgccggugccaccuggugggcgagugccacgucaaccgcugccuguccuggcgcgacaacgagacgagcgccgaguucuccuucgugggggagagcaccaccaugcgggagaacaagugcuucgagcagugcggcggguggggcugcgggugcuucaacgugaaccccagcugccucuucguccacaccuaccugcaguccgugcgcaaggaggcccugcggguguucaacugcaucgacuggguccacaagcucacgcuggagaucaccgacuucgacggcagcguguccaccaucgaccugggcgcgagcuccagccgcuucaccaacuggggguccgugagccucucccuggacgccgagggcaucagcggguccaacagcuucuccuucaucgagagccccggcaagggguacgccaucgucgacgagcccuucuccgagaucccgcggcagggcuuccugggcgagauccgcugcaacagcgaguccagcgugcucuccgcccacgagagcugccugcgggcccccaaccugaucagcuacaagcccaugaucgaccagcucgagugcaccacgaaccugaucgaccccuucguggucuucgagcgcgggucccugccgcagacccggaacgacaagaccuucgcggccagcaagggcaaccgcggggugcaggccuucuccaagggcagcgugcaggccgaccucacccugauguucgacaacuucgaggucgacuucgugggggccgcgguguccugcgacgccgccuuccugaaccucacgggcugcuacagcugcaacgccggcgcccgggucugccuguccaucaccagcaccgggaccggcucccugagcgcgcacaacaaggacgggucccuccacaucgugcugcccagcgagaacggcacgaaggaccagugccagauccugcacuucaccgugcccgaggucgaggaggaguucauguacuccugcgacggggacgagcgcccccuccuggugaagggcacccugaucgccaucgacccguucgacgaccggcgcgaggccggcggggagagcaccguggucaaccccaaguccggcagcuggaacuucuucgacugguucuccgggcucaugagcugguucggcggcccccugaagacgauccugcucaucugccuguacguggcccuguccaucgggcuguucuuccugcugaucuaccucggcgggaccggccugagcaagauguggcuggcggccaccaagaaggccagcuga

SEQ ID NO: 12899 - RNA, 3204 nt, Artificial Sequence
  derived and/or modified CDS sequence (opt1) from RVFV(200803166)__JF311381.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcugaagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgacggccugcagcgagcugauccaggccuccagccgcaucacgaccugcuccaccgagggcgugaacaccaagugccggcugagcggcaccgcccucauccgcgccggguccgucggcgcggaggccugccugaugcugaagggggugaaggaggaccagaccaaguuccucaagaucaagaccgugagcuccgagcugagcugccgggagggccaguccuacuggacgggcagcuucuccccgaagugccugagcucccgccggugccaccuggucggggagugccacgugaaccgcugccucagcuggcgcgacaacgagaccuccgccgaguucagcuucgugggcgaguccaccaccaugcgggagaacaagugcuucgagcagugcgggggcugggggugcggcugcuucaacgucaaccccagcugccuguucgugcacacguaccugcagagcgugcgcaaggaggcccuccgggucuucaacugcaucgacugggugcacaagcugacccuggagaucaccgacuucgacggcuccgugagcaccaucgaccucggggcguccagcucccgcuucaccaacuggggcagcgucucccugagccuggacgccgaggggaucuccggcagcaacuccuucagcuucaucgagucccccgggaagggcuacgccaucguggacgagcccuucagcgagaucccgcggcagggcuuccucggggagauccgcugcaacuccgagagcuccgugcugagcgcccacgaguccugccugcgggcccccaaccucaucagcuacaagcccaugaucgaccagcuggagugcacgaccaaccugaucgaccccuucgucguguucgagcgcggcagccucccgcagacccggaacgacaagaccuucgcggccuccaaggggaaccgcggcgugcaggccuucagcaagggguccguccaggccgaccugacgcugauguucgacaacuucgagguggacuucgugggcgccgcggucagcugcgacgccgccuuccucaaccugaccggcugcuacuccugcaacgccggggcccgggugugccugagcaucaccuccaccggcacggggacccucagcgcgcacaacaaggacggcucccugcacgugguccugcccagcgagaacgggaccaaggaccagugccagauccuccacuucaccgugcccgagguggaggaggaguucauguacuccugcgacggcgacgagcgcccccugcuggucaagggcacgcucaucgccaucgacccguucgacgaccggcgcgaggccgggggcgagagcaccguggugaaccccaaguccgggagcuggaacuucuucgacugguucuccggccugaugagcugguucggcgggccccugaagaccauccuccugaucugccuguacgucgcccucuccaucggccuguucuuccugcucaucuaccuggggcggaccggccugagcaagauguggcucgcggccacgaagaaggccuccuga

SEQ ID NO: 12900 - RNA, 3204 nt, Artificial Sequence
  derived and/or modified CDS sequence (opt1) from RVFV(200803162)__JF311377.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucgccaagugcgagccccacggccuggucgugcgcuccaccggcuucaagaucagcuccgccgucgcgugcgccagcggggugugcgugaccggcucccagagccccuccaccgagaucacccucaaguacccggggaucagccaguccagcggcggggacaucggcguccacauggcccacgacgaccaguccgugagcuccaagaucguggcccacugcccgccccaggaccccugccugguccacgacugcaucgugugcgcgcacggccugaucaacuaccagugccacacggcccucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggguggauggagggcgggcagcuggcccugcgcaaccccgcgcccaucccgcggcacgcccccaucccccgcuacuccaccuaccucaugcugcugcucaucgucagcuacgccagcgccugcuccgagcugauccaggccagcucccggaucacgaccugcagcaccgagggcgugaacaccaagugccgccuguccgggacggcgcucauccgggccggcagcgugggcgccgaggccugccugaugcugaagggggucaaggaggaccagaccaaguuccucaagaucaagaccguguccagcgagcuguccugccgcgagggccagagcuacuggaccggguccuucagcccgaagugccuguccagccggcgcugccaccuggugggcgagugccacgucaaccgcugccucuccuggcgggacaacgagacgagcgcggaguucuccuucgugggcgagagcaccaccaugcgcgagaacaagugcuucgagcagugcgggggcugggggugcggcugcuucaacgugaaccccagcugccuguucguccacaccuaccugcaguccgugcggaaggaggcccuccgcguguucaacugcaucgacuggguccacaagcugacgcuggagaucaccgacuucgacgggagcguguccaccaucgaccucggcgccagcuccagccgguucaccaacuggggcuccgugagccugucccuggacgccgaggggaucagcggcuccaacagcuucuccuucaucgagagccccgggaagggcuacgccaucgucgacgagcccuucuccgagaucccgcgccagggguuccucggcgagauccggugcaacagcgaguccagcgugcuguccgcgcacgagagcugccugcgcgcccccaaccucgugagcuacaagcccaugaucgaccagcuggagugcaccacgaaccugaucgaccccuucgucguguucgagcggggcucccucccgcagacccgcaacgacaagaccuucgccgccagcaaggggaaccggggcgugcaggccuucuccaaggggagcguccaggcggaccugacccugauguucgacaacuucgagguggacuucgugggcgccgccgucuccugcgacgccgccuuccucaaccugacggggugcuacagcugcaacgcgggcgcccgcgugugccuguccaucaccagcaccggcaccgggacgcucuccgcccacaacaaggacggcagccugcacaucgugcugcccuccgagaacgggaccaaggaccagugccagauccuccacuucaccguccccgagguggaggaggaguucauguacagcugcgacggcgacgagcggccccugcuggugaaggggacccucaucgccaucgacccguucgacgaccgccgggaggcgggcggcgaguccacggucgugaaccccaagagcggguccuggaacuucuucgacugguucagcggccugauguccugguucgggggcccccugaagaccauccuccugaucugccuguacguggcccucagcaucggccuguucuuccugcucaucuaccuggggcgcaccggccuguccaagauguggcucgccgccaccaagaaggccagcuga

SEQ ID NO: 12901 - RNA, 3204 nt, Artificial Sequence
  derived and/or modified CDS sequence (opt1) from RVFV(Hv-B375)__DQ380218.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaagaacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgacaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggacgcucuccgcgcacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacccucaucgccaucgacccguucgacgaccggcgcgaggccgggggcgaguccacggucgugaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12902 - RNA, 3204 nt, Artificial Sequence
  derived and/or modified CDS sequence (opt1) from RVFV(1260/78)__DQ380214.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccugcaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggacgaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgacaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggacgcucuccgcgcacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacccucaucgccaucgacccguucgacgaccggcgcgaggccgggggcgaguccacggucgugaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12903 - RNA, 3204 nt, Artificial Sequence
  derived and/or modified CDS sequence (opt1) from RVFV(ZH-501-777)__DQ380202.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggaccccggccagaccaagcgcgagcugaaguccuucgacaucagccagugccccaagaucgggggccacggcuccaagaagugcacgggggacgcggccuucugcagcgccuacgagugcaccgcccaguacgccaacgcguacugcucccacgccaacggcagcgggaucgugcagauccaggugagcggcgucuggaagaagccgcucugcgugggguacgagcggguggucgugaagcgcgagcuguccgccaagcccauccagcggguggagcccugcacgaccugcaucaccaagugcgagccccacggccuggucgugcgcagcaccggcuucaagaucuccagcgccgucgccugcgcguccggggugugcgugaccggcagccaguccccgagcaccgagaucacgcucaaguaccccgggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccguccuguaccgggugcucaagugccugaagaucgcgccccgcaaggugcugaacccccucauguggaucaccgccuucauccgguggaucuacaagaagauggucgcccgcguggccgacaacaucaaccaggugaaccgggagaucggcuggauggagggcgggcagcugguccuggggaaccccgccccgaucccccgccacgcccccaucccgcgguacagcaccuaccucaugcugcugcucaucguguccuacgcgagcgccugcagcgagcugauccaggccuccagccgcaucacgaccugcuccaccgagggcgugaacaccaagugccggcugagcggcacggcccucauccgcgccggguccgucggcgcggaggccugccugaugcugaagggggugaaggaggaccagaccaaguuccucaagaucaagaccgugagcuccgagcugagcugccgggagggccaguccuacuggaccggcagcuucucccccaagugccugagcucccgccggugccaccuggucggggagugccacgugaaccgcugccucagcuggcgcgacaacgagacguccgccgaguucagcuucgugggcgaguccaccaccaugcgggagaacaagugcuucgagcagugcgggggcugggggugcggcugcuucaacgucaaccccagcugccuguucgugcacaccuaccugcagagcgugcgcaaggaggcccuccgggucuucaacugcaucgacugggugcacaagcugacgcuggagaucaccgacuucgacggcuccgugagcaccaucgaccucggggcguccagcucccgcuucaccaacuggggcagcgucucccugagccuggacgccgaggggaucuccggcagcaacuccuucagcuucaucgagucccccgggaagggcuacgccaucguggacgagccguucagcgagaucccccggcagggcuuccucggggagauccgcugcaacuccgagagcuccgugcugagcgcccacgaguccugccugcgggcccccaaccucaucagcuacaagcccaugaucgaccagcuggagugcaccacgaaccugaucgacccguucgucguguucgagcgcggcagccucccccagacccggaacgacaagaccuucgcggccuccaaggggaaccgcggcgugcaggccuucagcaagggguccguccaggccgaccugacccugauguucgacaacuucgagguggacuucgugggcgccgcggucagcugcgacgccgccuuccucaaccugacgggcugcuacuccugcaacgccggggcccgggugugccugagcaucaccuccaccggcaccgggagccucuccgcgcacaacaaggacggcagccugcacaucgugcugcccuccgagaacgggacgaaggaccagugccagauccuccacuucaccguccccgagguggaggaggaguucauguacagcugcgacggcgacgagcgcccgcugcuggugaagggcacccucaucgccaucgaccccuucgacgaccggcgcgaggccgggggcgaguccaccgucgugaaccccaagagcggguccuggaacuucuucgacugguucagcggccugauguccugguucggcgggccccugaagacgauccuccugaucugccuguacguggcccucagcaucggccuguucuuccugcucaucuaccuggggcggaccggccuguccaagauguggcucgcggccaccaagaaggccagcuga

SEQ ID NO: 12904 - RNA, 3204 nt, Artificial Sequence
  derived and/or modified CDS sequence (opt1) from RVFV(OS-3)__DQ380184.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccugaacccccucauguggaucaccgccuucauccgcuggguguacaagaagaugguggcccgggucgccgacaacaucaaccaggugaaccgcgagaucggcuggauggagggcgggcagcuggcccuggggaaccccgcccccaucccgcggcacgcgcccaucccccgcuacuccaccuaccucaugcugcugcucaucgugagcuacgccagcgccugcuccgagcugauccaggccagcucccggaucacgaccugcagcaccgagggcgucaacaccaagugccgccuguccggcacggcccucauccgggcggggagcgugggcgccgaggccugccugaugcugaagggggugaaggaggaccagaccaaguuccucaagaucaagaccgucuccagcgagcuguccugccgcgagggccagagcuacuggaccggcuccuucagcccgaagugccuguccagccggcgcugccaccuggugggggagugccacgugaaccggugccucuccuggcgcgacaacgagacgagcgccgaguucuccuucgucggcgagagcaccaccaugcgcgagaacaagugcuucgagcagugcgggggcugggggugcggcugcuucaacgugaaccccagcugccuguucgugcacaccuaccugcaguccguccggaaggaggcgcuccgcguguucaacugcaucgacugggugcacaagcugacgcuggagaucaccgacuucgacggcagcgucuccaccaucgaccucggggccagcuccagccgguucaccaacuggggcuccgugagccugucccuggacgccgaggggaucagcggcuccaacagcuucuccuucaucgagagccccgggaagggcuacgccaucguggacgagcccuucuccgagaucccgcgccagggcuuccucggggagauccggugcaacagcgaguccagcguccuguccgcccacgagagcugccugcgcgcgcccaaccucaucagcuacaagcccaugaucgaccagcuggagugcaccacgaaccugaucgaccccuucgugguguucgagcggggcucccucccgcagacccgcaacgacaagaccuucgccgccagcaaggggaaccggggcguccaggccuucuccaaggggagcgugcaggccgaccugacccugauguucgacaacuucgagguggacuucgucggcgcggccguguccugcgacgccgccuuccucaaccugacgggcugcuacagcugcaacgccggggcgcgcgugugccuguccaucaccagcaccggcaccgggacgcucuccgcccacaacaaggacggcagccugcacaucguccugcccuccgagaacgggaccaaggaccagugccagauccuccacuucaccgugcccgagguggaggaggaguucauguacagcugcgacggcgacgagcggccccugcuggucaagggcacccucaucgccaucgacccguucgacgaccgccgggaggccgggggcgaguccacgguggugaaccccaagagcggguccuggaacuucuucgacugguucagcggccugauguccugguucggcgggccccugaagaccauccuccugaucugccuguacgucgcgcucagcaucggccuguucuuccugcucaucuaccuggggcgcaccggccuguccaagauguggcucgccgccaccaagaaggccagcuga

SEQ ID NO: 12905 - RNA, 3204 nt, Artificial Sequence
  derived and/or modified CDS sequence (opt1) from RVFV(SAUDI 200010901)__KU978778.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguucugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucaucagcuacgcgagcgccugcuccgagcugauccaggccagcucccgcaucacgaccugcagcaccgagggcgugaacaccaagugccggcuguccggcacggcccucauccgcgccgggagcgugggcgcggaggccugccugaugcugaagggggucaaggaggaccagaccaaguuccucaagaucaagaccguguccagcgagcuguccugccgggagggccagagcuacuggaccggcuccuucagcccgaagugccuguccagccgccggugccaccuggugggggagugccacgucaaccgcugccucuccuggcgcgacaacgagacgagcgccgaguucuccuucgugggcgagagcaccaccaugcgggagaacaagugcuucgagcagugcgggggcugggggugcggcugcuucaacgugaaccccagcugccuguucguccacaccuaccugcaguccgugcgcaaggaggcccuccggguguucaacugcaucgacuggguccacaagcugacgcuggagaucaccgacuucgacggcagcguguccaccaucgaccucggggcgagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucguggucuucgagcgcggcucccucccgcagacccggaacgagaagaccuucgcggccagcaaggggaaccgcggcgugcaggccuucuccaaggggagcgugcaggccgaccugacccugauguucgacaacuucgaggucgacuucgugggcgccgcgguguccugcgacgccgccuuccucaaccugacgggcugcuacagcugcaacgccggggcccgggucugccuguccaucaccagcaccggcaccgggacgcucuccgcgcacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacccucaucgccaucgacccguucgacgaccggcgcgaggccgggggcgaguccacgguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12906 - RNA, 3204 nt, Artificial Sequence
  derived and/or modified CDS sequence (opt1) from RVFV(2007001811)__EU574040.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaugaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucgucguguucgagcgcggcucccucccgcagacccggaacgagaagaccuucgcggccagcaaggggaaccgcggcgugcaggccuucuccaaggggagcguccaggccgaccugacccugauguucgacaacuucgagguggacuucgugggcgccgcggucuccugcgacgccgccuuccucaaccugacgggcugcuacagcugcaacgccggggcccgggugugccuguccaucaccagcaccggcaccgggacgcucuccgcgcacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacccucaucgccaucgacccguucgacgaccggcgcgaggccgggggcgaguccacggucgugaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12907 - RNA, 3204 nt, Artificial Sequence
  derived and/or modified CDS sequence (opt1) from RVFV(2007000253)__JF326192.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccacguaccucaugcugcugcucaucgucagcuacgccagcgccugcuccgagcugauccaggccagcucccgcaucacgaccugcagcaccgagggcgugaacaccaagugccggcuguccggcaccgcccucauccgcgcggggagcgccggcgccgaggccugccugaugcugaagggggugaaggaggaccagaccaaguuccucaagaucaagaccgucuccagcgagcuguccugccgggagggccagagcuacuggacgggcuccuucagcccgaagugccuguccagccgccggugccaccuggugggggagugccacgugaaccgcugccucuccuggcgcgacaacgagaccagcgcggaguucuccuucgucggcgagagcaccaccaugcgggagaacaagugcuucgagcagugcgggggcugggggugcggcugcuucaacgugaaccccagcugccuguucgugcacacguaccugcaguccguccgcaaggaggcccuccggguguucaacugcaucgacugggugcacaagcugacccuggagaucaccgacuucgacggcagcgucuccaccaucgaccucggggccagcuccagccgcuucaccaacuggggcuccgugagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcguccuguccgcgcacgagagcugccugcgggcccccaaccucgugagcuacaagcccaugaucgaccagcuggagugcacgaccaaccugaucgaccccuucguggucuucgagcgcggcucccucccgcagacccggaacgacaagaccuucgccgccagcaaggggaaccgcggcgugcaggccuucuccaaggggagcgugcaggcggaccugacgcugauguucgacaacuucgaggucgacuucgugggcgccgccguguccugcgacgccgccuuccucaaccugaccggcugcuacagcugcaacgcgggggcccgggucugccuguccaucaccagcaccggcacggggacccucuccgcccacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacgcucaucgccaucgacccguucgacgaccggcgcgaggccgggggcgaguccaccguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccacgaagaaggccagcuga

SEQ ID NO: 12908 - RNA, 3204 nt, Artificial Sequence
  derived and/or modified CDS sequence (opt1) from RVFV(2007001292)__EU574046.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccacguaccucaugcugcugcucaucgucagcuacgccagcgccugcuccgagcugauccaggccagcucccgcaucacgaccugcagcaccgagggcgugaacaccaagugccggcuguccggcaccgcccucauccgcgcggggagcgugggcgccgaggccugccugaugcugaagggggucaaggaggaccagaccaaguuccucaagaucaagaccguguccagcgagcuguccugccgggagggccagagcuacuggacgggcuccuucagcccgaagugccuguccagccgccggugccaccuggugggggagugccacgucaaccgcugccucuccuggcgcgacaacgagaccagcgccgaguucuccuucgugggcgagagcaccaccaugcgggagaacaagugcuucgagcagugcgggggcugggggugcggcugcuucaacgugaaccccagcugccuguucguccacacguaccugcaguccgugcgcaaggaggcgcuccggguguucaacugcaucgacuggguccacaagcugacccuggagaucaccgacuucgacggcagcguguccaccaucgaccucggggccagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcgcccaaccucgugagcuacaagcccaugaucgaccagcuggagugcacgaccaaccugaucgaccccuucgucguguucgagcgcggcucccucccgcagacccggaacgacaagaccuucgccgccagcaaggggaaccgcggcgugcaggccuucuccaaggggagcguccaggccgaccugacgcugauguucgacaacuucgagguggacuucgugggcgcggccgucuccugcgacgccgccuuccucaaccugaccggcugcuacagcugcaacgccggggcgcgggugugccuguccaucaccagcaccggcacggggacccucuccgcccacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacgcucaucgccaucgacccguucgacgaccggcgcgaggccgggggcgaguccaccgucgugaaccccaagagcggguccuggaaccuguucgacugguucagcggccugauguccugguucggcgggccccucaagaccauccugcugaucugccucuacguggcgcugagcaucggccuguucuuccuccugaucuaccuggggcggaccggccucuccaagauguggcuggccgccacgaagaaggccagcuga

SEQ ID NO: 12909 - RNA, 3204 nt, Artificial Sequence
  derived and/or modified CDS sequence (opt1) from RVFV(2007002476)__EU574036.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucaucaaguggguguacaagaagauggucgcccggguggccgacaacaucaaccaggugaaccgcgagaucggcuggauggagggcgggcagcuggcccuggggaaccccgcccccaucccgcggcacgcgcccaucccccgcuacuccacguaccucaugcugcugcucaucgucagcuacgccagcgccugcuccgagcugauccaggccagcucccggaucacgaccugcagcaccgagggcgugaacaccaagugccgccuguccggcaccgcccucauccgggcggggagcgugggcgccgaggccugccugaugcugaagggggucaaggaggaccagaccaaguuccucaagaucaagaccguguccagcgagcuguccugccgcgagggccagagcuacuggacgggcuccuucagcccgaagugccuguccagccggcgcugccaccuggugggggagugccacgucaaccggugccucuccuggcgcgacaacgagaccagcgccgaguucuccuucgugggcgagagcaccaccaugcgcgagaacaagugcuucgagcagugcgggggcugggggugcggcugcuucaacgugaaccccagcugccuguucguccacacguaccugcaguccgugcggaaggaggcgcuccgcguguucaacugcaucgacuggguccacaagcugacccuggagaucaccgacuucgacggcagcguguccaccaucgaccucggggccagcuccagccgguucaccaacuggggcuccgugagccugucccuggacgccgaggggaucagcggcuccaacagcuucuccuucaucgagagccccgggaagggcuacgccaucgucgacgagcccuucuccgagaucccgcgccagggcuuccucggggagauccggugcaacagcgaguccagcgugcuguccgcccacgagagcugccugcgcgcgcccaaccucgugagcuacaagcccaugaucgaccagcuggagugcacgaccaaccugaucgaccccuucgucguguucgagcggggcucccucccgcagacccgcaacgacaagaccuucgccgccagcaaggggaaccggggcgugcaggccuucuccaaggggagcguccaggccgaccugacgcugauguucgacaacuucgagguggacuucgugggcgcggccgucuccugcgacgccgccuuccucaaccugaccggcugcuacagcugcaacgccggggcgcgcgugugccuguccaucaccagcaccggcacggggacccucuccgcccacaacaaggacggcagccugcacaucgugcugcccuccgagaacgggaccaaggaccagugccagauccuccacuucaccguccccgagguggaggaggaguucauguacagcugcgacggcgacgagcggccccugcuggugaagggcacgcucaucgccaucgacccguucgacgaccgccgggaggccgggggcgaguccaccgucgugaaccccaagagcggguccuggaacuucuucgacugguucagcggccugauguccugguucggcgggccccugaagaccauccuccugaucugccuguacguggcgcucagcaucggccuguucuuccugcucaucuaccuggggcgcaccggccuguccaagauguggcucgccgccacgaagaaggccagcuga

SEQ ID NO: 12910 - RNA, 3204 nt, Artificial Sequence
  derived and/or modified CDS sequence (opt1) from RVFV(73HB1230)__DQ380221.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagaaggagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcgcguggucgugaagcgggagcugagcgccaagccgauccagcgcguggagcccugcacgaccugcaucaccaagugcgagccccacggccuggucgugcgguccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggcuggauggagggcgggcagcugguccuggggaaccccgcccccaucccgcggcacgcccccaucccccgcuacuccaccuaccucaugcugcugcucaucgugagcuacgcgagcgccugcuccgagcugauccaggccagcucccggaucacgaccugcagcaccgagggcgugaacaccaagugccgccuguccggcacggcccucauccgggccgggagcgucggcgcggaggccugccugaugcugaagggggugaaggaggaccagaccaaguuccucaagaucaagaccguguccagcgagcuguccugccgcgagggccagagcuacuggaccggcuccuucagcccgaagugccuguccagccggcgcugccaccuggucggggagugccacgugaaccggugccucuccuggcgcgacaacgagacgagcgccgaguucuccuucgugggcgagagcaccaucaugcgcgagaacaagugcuucgagcagugcgggggcugggggugcggcugcuucaacgucaaccccagcugccuguucgugcacaccuaccugcaguccgugcggaaggaggcccuccgcgucuucaacugcaucgacugggugcacaagcugacccuggagaucacggacuucgacggcagcguguccaccaucgaccucggggcgagcuccagccgguucaccaacuggggcuccgucagccugucccuggacgccgaggggaucagcggcuccaacagcuucuccuucaucgagagccccgggaagggcuacgccaucguggacgagcccuucuccgagaucccgcgccagggcuuccucggggagauccggugcaacagcgaguccagcgugcuguccgcccacgagagcugccugcgcgcccccaaccucaucagcuacaagcccaugaucgaccagcuggagugcaccaccaaccugaucgaccccuucgucguguucgagcggggcucccucccgcagacgcgcaacgacaagaccuucgcggccagcaaggggaaccggggcgugcaggccuucuccaaggggagcguccaggccgaccugacccugauguucgacaacuucgagguggacuucgugggcgccgcggucuccugcgacgccgccuuccucaaccugaccggcugcuacagcugcaacgccggggcccgcgugugccuguccaucacgagcaccggcaccgggacccucuccgcgcacaacaaggacggcagccugcacaucgugcugcccuccgagaacgggacgaaggaccagugccagauccuccacuucaccguccccgagguggaggaggaguucauguacagcugcgacggcgacgagcggccccugcuggugaagggcacccucaucgccaucgacccguucgacgaccgccgggaggccgggggcgaguccaccgucgugaaccccaagagcggguccuggaacuucuucgacugguucagcggccugauguccugguucggcgggccccugaagacgauccuccugaucugccuguacguggcccucagcaucggccuguucuuccugcucaucuaccuggggcgcaccggccuguccaagauguggcucgcggccaccaagaaggccagcuga

SEQ ID NO: 12911 - RNA, 3204 nt, Artificial Sequence
  derived and/or modified CDS sequence (opt1) from RVFV(ZINGA J83 R1)__KU978776.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcucaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggguguaccgcaagauggucgcccggguggccgacaacaucaaccaggugaaccgcgagaucggcuggauggagggcgggcagcugguccucgggaaccccgcccccaucccgcggcacgugcccaucccccgcuacuccaccuaccugaugcugcuccugaucgugagcuacgccagcgcgugcuccgagcugauccaggccagcucccggaucacgaccugcagcaccgagggcgucaacaccaagugccgccucuccggcacggcccugauccgggccgggagcgugggcgccgaggcgugccugaugcucaagggggugaaggaggaccagaccaaguuccugaagaucaagaccgucuccagcgagcuguccugccgcgagggccagagcuacuggaccggcuccuucagcccgaagugccuguccagccggcgcugccaccucgugggggagugccacgugaaccgcugccuguccuggcgggacaacgagacgagcgccgaguucuccuucgucggcgagagcaccaccaugcgcgagaacaagugcuucgagcagugcgggggcugggggugcggcugcuucaacgugaaccccagcugccuguucgugcacaccuaccuccaguccguccggaaggaggcccugcgcguguucaacugcaucgacugggugcacaagcugacgcucgagaucaccgacuucgacggcagcgucuccaccaucgaccugggggccagcuccagccgguucaccaacuggggcuccgugagccugucccucgacgcggaggggaucagcggcuccaacagcuucuccuucaucgagagccccgggaagggcuacgccaucguggacgagcccuucuccgagaucccgcgccagggcuuccugggggagauccggugcaacagcgaguccagcguccuguccgcccacgagagcugccuccgcgcccccaaccugaucagcuacaagcccaugaucgaccagcuggagugcaccacgaaccucaucgaccccuucgugguguucgagcggggcucccugccgcagacccgcaacgacaagaccuucgccgcgagcaaggggaaccggggcguccaggccuucuccaaggggagcgugcaggccgaccugacccucauguucgacaacuucgagguggacuucgucggcgccgccguguccugcgacgcggccuuccugaaccugacgggcugcuacagcugcaacgccggggcccgcgugugccucuccaucaccagcaccggcaccgggacgcuguccgcccacaacaaggacggcagccugcacaucguccuccccuccgagaacgggaccaaggaccagugccagauccugcacuucaccgugcccgagguggaggaggaguucauguacagcugcgacggcgacgagcggccccugcucguccgcggcacccugaucgcgaucgacccguucgacgaccggcgcgaggccgggggcgaguccacgguggugaaccccaagagcggguccuggaacuucuucgacugguucagcggccugauguccugguucggcgggccccucaagaccauccugcugaucugccucuacgucgcccugagcaucggccuguucuuccuccugaucuaccuggggcggaccggccucuccaagauguggcuggccgcgaccaagaaggccagcuga

SEQ ID NO: 12912 - RNA, 3204 nt, Artificial Sequence
  derived and/or modified CDS sequence (opt1) from RVFV(2008/00101)__HE687306.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccacguaccucaugcugcugcucaucgucagcuacgccagcgccugcuccgagcugauccaggccagcucccgcaucacgaccugcagcaccgagggcgugaacaccaagugccggcuguccggcaccgcccucauccgcgcggggagcgugggcgccgaggccugccugaugcugaagggggucaaggaggaccagaccaaguuccucaagaucaagaccguguccagcgagcuguccugccgggagggccagagcuacuggacgggcuccuucagcccgaagugccuguccagccgccggugccaccuggugggggagugccacgucaaccgcugccucuccuggcgcgacaacgagaccagcgccgaguucuccuucgugggcgagagcaccaccaugcgggagaacaagugcuucgagcagugcgggggcugggggugcggcugcuucaacgugaaccccagcugccuguucguccacacguaccugcaguccgugcgcaaggaggcgcuccggguguucaacugcaucgacuggguccacaagcugacccuggagaucaccgacuucgacggcagcguguccaccaucgaccucggggccagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcgcccaaccucgugagcuacaagcccaugaucgaccagcuggagugcacgaccaaccugaucgaccccuucgucguguucgagcgcggcucccucccgcagacccggaacgacaagaccuucgccgccagcaaggggaaccgcggcgugcaggccuucuccaaggggagcguccaggccgaccugacgcugauguucgacaacuucgagguggacuucgugggcgcggccgucuccugcgacgccgccuuccucaaccugaccggcugcuacagcugcaacgccggggcgcgggugugccuguccaucaccagcaccggcacggggacccucuccgcccacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacgcucaucgccaucgacccguucgacgaccggcgcgaggccgggggcgaguccaccgucgugaaccccaagagcggguccuggaacuucuucgacugguucagcggccugauguccugguucggcgggccccugaagaccacccuccugaucugccuguacguggcgcucagcaucggccuguucuuccugcucaucuaccuggggcggacgggccuguccaagauguggcucgccgccaccaagaaggccagcuga

SEQ ID NO: 12913 - RNA, 3204 nt, Artificial Sequence
  derived and/or modified CDS sequence (opt1) from RVFV(2007002445)__EU574037.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccacguaccucaugcugcugcucaucgucagcuacgccagcgccugcuccgagcugauccaggccagcucccgcaucacgaccugcagcaccgagggcgugaacaccaagugccggcuguccggcaccgcccucauccgcgcggggagcgugggcgccgaggccugccugaugcugaagggggucaaggaggaccagaccaaguuccucaagaucaagaccguguccagcgagcuguccugccgggagggccagagcuacuggacgggcuccuucagcccgaagugccuguccagccgccggugccaccuggugggggagugccacgucaaccgcugccucuccuggcgcgacaacgagaccagcgccgaguucuccuucgugggcgagagcaccaccaugcgggagaacaagugcuucgagcagugcgggggcugggggugcggcugcuucaacgugaaccccagcugccuguucguccacacguaccugcaguccgugcgcaaggaggcgcuccggguguucaacugcaucgacuggguccacaagcugacccuggagaucaccgacuucgacggcagcguguccaccaucgaccucggggccagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcgcccaaccucgugagcuacaagcccaugaucgaccagcuggagugcacgaccaaccugaucgaccccuucgucguguucgagcgcggcucccucccgcagacccggaacgagaagaccuucgccgccagcaaggggaaccgcggcgugcaggccuucuccaaggggagcauccaggccgaccugacgcugauguucgacaacuucgaggucgacuucgugggcgcggccguguccugcgacgccgccuuccucaaccugaccggcugcuacagcugcaacgccggggcgcgggucugccuguccaucaccagcaccggcacggggacccucuccgcccacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacgcucaucgccaucgacccguucgacgaccggcgcgaggccgggggcgaguccaccguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccacgaagaaggccagcuga

SEQ ID NO: 12914 - RNA, 3204 nt, Artificial Sequence
  derived and/or modified CDS sequence (opt1) from RVFV(ZC-3349)__DQ380207.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaggccguguccagcaagaucguggcccacugcccgccccaggaccccugccugguccacggcugcaucgugugcgcgcacgggcugaucaacuaccagugccacaccgcccucuccgccuucguggucguguucguguucagcuccaucgccaucaucugccuggccauccuguaccggguccucaagugccugaagaucgcgccccgcaaggugcugaacccccucauguggaucaccgccuucauccgguggaucuacaagaagaugguggcccgcgucgccgacaacaucaaccacgugaaccgggagaucggcuggauggagggcgggcagcuggugcuggggaaccccgcccccaucccgcgccacgcgcccaucccccgguacagcaccuaccucaugcugcugcucaucgucuccuacgccagcgccugcagcgagcugauccaggccuccagccgcaucacgaccugcuccaccgagggcgugaacaccaagugccggcugagcggcacggcccucauccgcgcgggguccgugggcgccgaggccugccugaugcugaagggggucaaggaggaccagaccaaguuccucaagaucaagaccgugagcuccgagcugagcugccgggagggccaguccuacuggaccggcagcuucuccccgaagugccugagcucccgccggugccaccuggugggggagugccacgucaaccgcugccucagcuggcgcgacaacgagacguccgccgaguucagcuucgugggcgaguccaccaccaugcgggagaacaagugcuucgagcagugcgggggcugggggugcggcugcuucaacgugaaccccagcugccuguucguccacaccuaccugcagagcgugcgcaaggaggcgcuccggguguucaacugcaucgacuggguccacaagcugacgcuggagaucaccgacuucgacggcuccgugagcaccaucgaccucggggccuccagcucccgcuucaccaacuggggcagcgugucccugagccuggacgccgaggggaucuccggcagcaacuccuucagcuucaucgagucccccgggaagggcuacgccaucgucgacgagcccuucagcgagaucccgcggcagggcuuccucggggagauccgcugcaacuccgagagcuccgugcugagcgcccacgaguccugccugaaggcgcccaaccucaucagcuacaagcccaugaucgaccagcuggagugcaccacgaaccugaucgaccccuucguggucuucgagcggggcagccucccgcagacccgcaacgacaagaccuucgccgccuccaaggggaaccggggcgugcaggccuucagcaagggguccgugcaggccgaccugacccugauguucgacaacuucgaggucgacuucgugggcgcggccgugagcugcgacgccgccuuccucaaccugacgggcugcuacuccugcaacgccggggcgcgcgucugccugagcaucaccuccaccggcaccgggagccucuccgcccacaacaaggacggcagccugcacaucgugcugcccuccgagaacgggacgaaggaccagugccagauccuccacuucaccgugcccgaggucgaggaggaguucauguacagcugcgacggcgacgagcggccccugcuggugaagggcacccucaucgccaucgacccguucgacgaccgccgggaggccgggggcgaguccaccguggucaaccccaagagcggguccuggaacuucuucgacugguucagcggccugauguccugguucggcgggccccugaagacgauccuccugaucugccuguacguggcgcucagcaucggccuguucuuccugcucaucuaccuggggcgcaccggccuguccaagauguggcucgccgccaccaagaaggccagcuga

SEQ ID NO: 12915 - RNA, 3204 nt, Artificial Sequence
  derived and/or modified CDS sequence (opt1) from RVFV(Kenya 9800523)__DQ380196.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguucugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcccuccgggucuucaacugcaucgacugggugcacaagcugacgcuggagaucaccgacuucgacggcagcguguccaccaucgaccucggggcgagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcugaacgcccacgaguccugccugcgggcccccaaccucaucagcuacaagcccaugaucgaccagcuggagugcaccacgaaccugaucgaccccuucgucguguucgagcgcggcagccucccgcagacccggaacgacaagaccuucgcggccuccaaggggaaccgcggcgugcaggccuucagcaagggguccguccaggccgaccugacccugauguucgacaacuucgagguggacuucgugggcgccgcggucagcugcgacgccgccuuccucaaccugacgggcugcuacuccugcaacgccggggcccgggugugccugagcaucaccuccaccggcaccgggacgcucagcgcgcacaacaaggagggcucccugcacaucgugcugcccagcgagaacgggaccaaggaccagugccagauccuccacuucaccguccccgagguggaggaggaguucauguacuccugcgacggcgacgagcgcccccugcuggugaagggcacccucaucgccaucgacccguucgacgaccggcgcgaggccgggggcgagagcacggucgugaaccccaaguccgggagcuggaacuucuucgacugguucuccggccugaugagcugguucggcgggccccugaagaccauccuccugaucugccuguacguggcccucuccaucggccuguucuuccugcucaucuaccuggggcggaccggccugagcaagauguggcucgcggccaccaagaaggccuccuga

SEQ ID NO: 12916 - RNA, 3204 nt, Artificial Sequence
  derived and/or modified CDS sequence (opt1) from RVFV(Entebbe)__DQ380191.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaucaagcgcgagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacccucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacacggcgcucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcuggggaaccccgcccccaucccgcggcacgcccccaucccccgcuacuccaccuaccucaugcugcugcucaucgugagcuacgcgagcgccugcuccgagcugauccaggccagcucccggaucaccacgugcagcaccgagggcgucaacaccaagugccgccuguccggcaccgcccucauccgggccgggagcgugggcgcggaggccugccugaugcugaagggggugaaggaggaccagacgaaguuccucaagaucaagaccgucuccagcgagcuguccugccgcgagggccagagcuacuggaccggcuccuucagcccgaagugccuguccagccggcgcugccaccuggugggggagugccacgugaaccggugccucuccuggcgcgacaacgagaccagcgccgaguucuccuucgucggcgagagcacgaccaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucacggacuucgacggcagcgucuccaccguggaccucggggcgagcuccagccgguucaccaacuggggcuccgugagccugucccuggacgccgaggggaucagcggcuccaacagcuucuccuucaucgagagccccgggaagggcuacgccaucgucgacgagcccuucuccgagaucccgcgccagggcuuccucggggagauccggugcaacagcgaguccagcgugcuguccgcccacgagagcugccugcgcgcccccaaccucaucagcuacaagcccaugaucgaccagcuggagugcaccaccaaccugaucgaccccuucguggucuucgagcggggcucccucccgcagacgcgcaacgacaagaccuucgcggccagcaaggggaaccggggcgugcaggccuucuccaaggggagcgugcaggccgaccugacccugauguucgacaacuucgaggucgacuucgugggcgccgcgguguccugcgacgccgccuuccucaaccugaccggcugcuacagcugcaacgccggggcccgcgucugccuguccaucacgagcaccggcaccgggacccucuccgcgcacaacaaggacggcagccugcacaucgugcugcccuccgagaacgggacgaaggaccagugccagauccuccacuucaccgugcccgaggucgaggaggaguucauguacagcugcgacggcgacgagcggccccugcuggugaagggcacccucaucgccaucgacccguucgacgaccgccgggaggccgggggcgaguccaccguggucaaccccaagagcggguccuggaacuucuucgacugguucagcggccugauguccugguucggcgggccccugaagacgauccuccugaucugccuguacguggcccucagcaucggccuguucuuccugcucaucuaccuggggcgcaccggccuguccaagauguggcucgcggccaccaagaaggccagcuga

SEQ ID NO: 12917 - RNA, 3204 nt, Artificial Sequence
  derived and/or modified CDS sequence (opt1) from RVFV(25010-24)__KM210509.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccugaucguccgcuccaccggcuucaagaucagcuccgccguggccugcgcgagcggggucugcgugaccggcucccagagccccuccaccgagaucacgcucaaguacccggggaucagccaguccagcggcggggacaucggcgugcacauggcccacgacgaccaguccgucagcuccaagaucguggcccacugcccgccccaggaccccugccuggugcacggcugcaucgucugcgcccacgggcugaucaacuaccagugccacaccgcgcucagcgccuucgugguggucuucguguucuccagcguggccaucaucugccuggccauccuguacaagguccucaagugccugaagaucgcccccaagaaggugcugaacccccucauguggaucaccgcguucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccaccuaccucaugcugcugcucaucgucagcuacgccagcgccugcuccgagcugauccaggccagcucccgcaucacgaccugcagcaccgagggcgugaacaccaagugccggcuguccggcacggcccucauccgcgcggggagcgugggcgccgaggccugccugaugcugaagggggucaaggacgaccagaccaaguuccucaagaucaagaccguguccagcgagcuguccugccgggagggccagagcuacuggaccggcuccuucagcccgaagugccuguccagccgccggugccaccuggugggggagugccacgucaaccgcugccucuccuggcgggacaacgagacgagcgccgaguucuccuucgugggcgagagcaccaccaugcgcgagaacaagugcuucgagcagugcgggggcugggggugcggcugcuucaacgugaaccccagcugccuguucguccacaccuaccugcaguccgugcgcaaggaggcgcuccggguguucaacugcaucgacuggguccacaagcugacgcuggagaucaccgacuucgacggcagcguguccaccaucgaccucggggccagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcgcccaaccucaucagcuacaagcccaugaucgaccagcuggagugcaccacgaaccugaucgaccccuucguggucuucgagcgcggcucccucccgcagacccggaacgacaagaccuucgccgccagcaaggggaaccgcggcgugcaggccuucuccaaggggagcgugcaggccgaccugacccugauguucgacaacuucgaggucgacuucgugggcgcggccguguccugcgacgccgccuuccucaaccugacgggcugcuacagcugcaacgccggggcgcgggucugccuguccaucaccagcaccggcaccgggacgcucuccgcccacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacccucaucgccaucgacccguucgacgaccggcgcgaggccgggggcgaguccacgguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccaccaagaaggccagcuga

SEQ ID NO: 12918 - RNA, 3204 nt, Artificial Sequence
  derived and/or modified CDS sequence (opt1) from RVFV(763/70)__DQ380188.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgggcugaccgaggacugcaacuucugccggcagaugaccggcgccucccucaagaaggggagcuacccccugcaggaccuguucugccaguccagcgaggacgacggcuccaagcucaagaccaagaugaagggggugugcgaggucggcgugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaaggggcaguacaagggcaccauggacuccgggcagaccaagcgcgagcucaagagcuucgacaucucccagugccccaagaucggcggccacgggagcaagaagugcacgggcgacgcggccuucugcuccgccuacgagugcaccgcccaguacgccaacgcguacugcagccacgccaacgggagcggcaucgugcagauccagguguccggggucuggaagaagccccugugcgugggcuacgagcggguggucgugaagcgcgagcugagcgccaagccgauccagcggguggagcccugcacgaccugcaucaccaagugcgagccccacggccuggucgugcgcuccaccggguucaagaucagcuccgccgucgccugcgcgagcggcgugugcgugaccgggucccagagccccuccaccgagaucacgcucaaguacccgggcaucagccaguccagcgggggcgacaucggcguccacauggcccacgacgaccaguccgugagcuccaagaucguggcccacugcccgccccaggaccccugccugguccacgggugcaucgugugcgcccacggccugaucaacuaccagugccacaccgcgcucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggguggauggagggcgggcagcuggcccugggcaaccccgcccccaucccgcggcacgcgcccaucccccgcuacuccaccuaccucaugcugcugcucaucgugagcuacgccagcgccugcuccgagcugauccaggccagcucccggaucacgaccugcagcaccgagggcgugaacaccaagugccgccuguccgggacggcccucauccgggcgggcagcgucggggccgaggccugccugaugcugaagggcgugaaggaggaccagaccaaguuccucaagaucaagaccguguccagcgagcuguccugccgcgagggccagagcuacuggaccggguccuucagcccgaagugccuguccagccggcgcugccaccuggucggcgagugccacgugaaccggugccucuccuggcgcgacaacgagacgagcgccgaguucuccuucgugggggagagcaccaccaugcgcgagaacaagugcuucgagcagugcggcggguggggcugcggcugcuucaacgucaaccccagcugccuguucgugcacaccuaccugcaguccgugcggaaggaggcgcuccgcgucuucaacugcaucgacugggugcacaagcugacgcuggagaucaccgacuucgacgggagcguguccaccaucgaccucggcgccagcuccagccgguucaccaacuggggguccgucagccugucccuggacgccgagggcaucagcggguccaacagcuucuccuucaucgagagccccggcaagggcuacgccaucguggacgagcccuucuccgagaucccgcgccagggguuccucggcgagauccggugcaacagcgaguccagcgugcuguccgcccacgagagcugccugcgcgcgcccaaccucaucagcuacaagcccaugaucgaccagcuggagugcaccacgaaccugaucgaccccuucgucguguucgagcgggggucccucccgcagacccgcaacgacaagaccuucgccgccagcaagggcaaccgcggggugcaggccuucuccaagggcagcguccaggccgaccugacccugauguucgacaacuucgagguggacuucgugggcgcggccgucuccugcgacgccgccuuccucaaccugacggggugcuacagcugcaacgccggcgcgcgggugugccuguccaucaccagcaccgggaccggcacgcucuccgcccacaacaaggacgggagccugcacaucgugcugcccuccgagaacggcaccaaggaccagugccagauccuccacuucaccguccccgagguggaggaggaguucauguacagcugcgacggcgacgagcggccccugcuggugaaggggacccucaucgccaucgacccguucgacgaccgccgggaggccggcggggaguccacggucgugaaccccaagagcggcuccuggaacuucuucgacugguucagcggccugauguccugguucgggggcccccugaagaccauccuccugaucugccuguacguggcgcucagcaucgggcuguucuuccugcucaucuaccugggccgcaccgggcuguccaagauguggcucgccgccaccaagaaggccagcuga

SEQ ID NO: 12919 - RNA, 3204 nt, Artificial Sequence
  derived and/or modified CDS sequence (opt1) from RVFV(OS-1)__DQ380186.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccugaacccccucauguggaucaccgccuucauccgcuggguguacaagaagaugguggcccgggucgccgacaacaucaaccaggugaaccgcgagaucggcuggauggagggcgggcagcuggcccuggggaaccccgcccccaucccgcggcacgcgcccaucccccgcuacuccaccuaccucaugcugcugcucaucgugagcuacgccagcgccugcuccgagcugauccaggccagcucccggaucacgaccugcagcaccgagggcgucaacaccaagugccgccuguccggcacggcccucauccgggcggggagcgugggcgccgaggccugccugaugcugaagggggugaaggaggaccagaccaaguuccucaagaucaagaccgucuccagcgagcuguccugccgcgagggccagagcuacuggaccggcuccuucagcccgaagugccuguccagccggcgcugccaccuggugggggagugccacgugaaccggugccucuccuggcgcgacaacgagacgagcgccgaguucuccuucgucggcgagagcaccaccaugcgcgagaacaagugcuucgagcagugcgggggcugggggugcggcugcuucaacgugaaccccagcugccuguucgugcacaccuaccugcaguccguccggaaggaggcgcucaagguguucaacugcaucgacugggugcacaagcugacgcuggagaucaccgacuucgacggcagcgucuccaccaucgaccucggggccagcuccagccgcuucaccaacuggggcuccgugagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcguccuguccgcccacgagagcugccugcgggcgcccaaccucaucagcuacaagcccaugaucgaccagcuggagugcaccacgaaccugaucgaccccuucgugguguucgagcgcggcucccucccgcagacccggaacgacaagaccuucgccgccagcaaggggaaccgcggcguccaggccuucuccaaggggagcgugcaggccgaccugacccugauguucgacaacuucgagguggacuucgucggcgcggccguguccugcgacgccgccuuccucaaccugacgggcugcuacagcugcaacgccggggcgcgggugugccuguccaucaccagcaccggcaccgggacgcucuccgcccacaacaaggacggcagccugcacaucguccugcccuccgagaacgggaccaaggaccagugccagauccuccacuucaccgugcccgagguggaggaggaguucauguacagcugcgacggcgacgagcgcccccugcuggucaagggcacccucaucgccaucgacccguucgacgaccggcgcgaggccgggggcgaguccacgguggugaaccccaagagcggguccuggaacuucuucgacugguucagcggccugauguccugguucggcgggccccugaagaccauccuccugaucugccuguacgucgcgcucagcaucggccuguucuuccugcucaucuaccuggggcggaccggccuguccaagauguggcucgccgccaccaagaaggccagcuga

SEQ ID NO: 12920 - RNA, 3204 nt, Artificial Sequence
  derived and/or modified CDS sequence (opt1) from RVFV(BIME-01)__KX609032.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcuccggugccugaagaucgcccccaagaaggugcugaacccccucauguggaucaccgcguucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucaucagcuacgccagcgccugcuccgagcugauccaggccagcucccggaucacgaccugcagcaccgagggcgugaacaccaagugccgccuguccggcacggcccucauccgggcggggagcgugggcgccgaggccugccugaugcugaagggggucaaggaggaccagaccaaguuccucaagaucaagaccguguccagcgagcuguccugccgcgagggccagagcuacuggaccggcuccuucagcccgaagugccuguccagccggcgcugccaccuggugggggagugccacgucaaccggugccucuccuggcgcgacaacgagacgagcgccgaguucuccuucgugggcgagagcaccaccaugcgcgagaacaagugcuucgagcagugcgggggcugggggugcggcugcuucaacgugaaccccagcugccuguucguccacaccuaccugcaguccgugcggaaggaggcgcuccgcguguucaacugcaucgacuggguccacaagcugacgcuggagaucaccgacuucgacggcagcguguccaccaucgaccucggggccagcuccagccgguucaccaacuggggcuccgugagccugucccuggacgccgaggggaucagcggcuccaacagcuucuccuucaucgagagccccgggaagggcuacgccaucgucgacgagcccuucuccgagaucccgcgccagggcuuccucggggagauccggugcaacagcgaguccagcgugcuguccgcccacgagagcugccugcgcgcgcccaaccucaucagcuacaagcccaugaucgaccagcuggagugcaccacgaaccugaucgaccccuucguggucuucgagcggggcucccucccgcagacccgcaacgacaagaccuucgccgccagcaaggggaaccggggcgugcaggccuucuccaaggggagcgugcaggccgaccugacccugauguucgacaacuucgaggucgacuucgugggcgcggccguguccugcgacgccgccuuccucaaccugacgggcugcuacagcugcaacgccggggcgcgcgucugccuguccaucaccagcaccggcaccgggacgcucuccgcccacaacaaggacggcagccugcacaucgugcugcccuccgagaacgggaccaaggaccagugccagauccuccacuucaccgugcccgaggucgaggaggaguucauguacagcugcgacggcgacgagcggccccugcuggugaagggcacccucaucgccaucgacccguucgacgaccgccgggaggccgggggcgaguccacgguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcgcaccggccuguccaagauguggcucgccgccaccaagaaggccagcuga

SEQ ID NO: 12921 - RNA, 3204 nt, Artificial Sequence
  derived and/or modified CDS sequence (opt1) from RVFV(73HB1449)__DQ380211.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagaaccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacagcaccuaccucaugcugcugcucaucguguccuacgcgagcgccugcagcgagcugauccaggccuccagccgcaucacgaccugcuccaccgagggcgugaacaccaagugccggcugagcggcacggcccucauccgcgccggguccgucggcgcggaggccugccugaugcugaagggggugaaggacgaccagaccaaguuccucaagaucaagaccgugagcuccgagcugagcugccgggagggccaguccuacuggaccggcagcuucuccccgaagugccugagcucccgccggugccaccuggucggggagugccacgugaaccgcugccucagcuggcgcgacaacgagacguccgccgaguucagcuucgugggcgaguccaccaccaugcgggagaacaagugcuucgagcagugcgggggcugggggugcggcugcuucaacgucaaccccagcugccuguucgugcacaccuaccugcagagcgugcgcaaggaggcccuccgggucuucaacugcaucgacugggugcacaagcugacgcuggagaucaccgacuucgacggcuccgugagcaccaucgaccucggggcguccagcucccgcuucaccaacuggggcagcgucucccugagccuggacgccgaggggaucuccggcagcaacuccuucagcuucaucgagucccccgggaagggcuacgccaucguggacgagcccuucagcgagaucccgcggcagggcuuccucggggagauccgcugcaacuccgagagcuccgugcugagcgcccacgaguccugccugcgggcccccaaccucaucagcuacaagcccaugaucgaccagcuggagugcaccacgaaccugaucgaccccuucgucguguucgagcgcggcagccucccgcagacccggaacgagaagaccuucgcggccuccaaggggaaccgcggcgugcaggccuucagcaagggguccguccaggccgaccugacccugauguucgacaacuucgagguggacuucgugggcgccgcggucagcugcgacgccgccuuccucaaccugacgggcugcuacuccugcaacgccggggcccgggugugccugagcaucaccuccaccggcaccgggacgcucagcgcgcacaacaaggacggcucccugcacaucgugcugcccagcgagaacgggaccaaggaccagugccagauccuccacuucaccguccccgagguggaggaggaguucauguacuccugcgacggcgacgagcgcccccugcuggugaagggcacccucaucgccaucgacccguucgacgaccggcgcgaggccgggggcgagagcacggucgugaaccccaaguccgggagcuggaacuucuucgacugguucuccggccugaugagcugguucggcgggccccugaagaccauccuccugaucugccuguacguggcccucuccaucggccuguucuuccugcucaucuaccuggggcggaccggccugagcaagauguggcucgcggccaccaagaaggccuccuga

SEQ ID NO: 12922 - RNA, 3204 nt, Artificial Sequence
  derived and/or modified CDS sequence (opt1) from RVFV(SA01-1322)__KX096942.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguucugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccugggggaccccgcccccaucccgcgccacgcccccaucccccgguacuccaccuaccucaugcugcugcucaucaucagcuacgcgagcgccugcuccgagcugauccaggccagcucccgcaucacgaccugcagcaccgagggcgugaacaccaagugccggcuguccggcacggcccucauccgcgccgggagcgugggcgcggaggccugccugaugcugaagggggucaaggaggaccagaccaaguuccucaagaucaagaccguguccagcgagcuguccugccgggagggccagagcuacuggaccggcuccuucagcccgaagugccuguccagccgccggugccaccuggugggggagugccacgucaaccgcugccucuccuggcgcgacaacgagacgagcgccgaguucuccuucgugggcgagagcaccaccaugcgggagaacaagugcuucgagcagugcgggggcugggggugcggcugcuucaacgugaaccccagcugccuguucguccacaccuaccugcaguccgugcgcaaggaggcccuccggguguucaacugcaucgacuggguccacaagcugacgcuggagaucaccgacuucgacggcagcguguccaccaucgaccucggggcgagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccgcggcagggcuuccucggggagauccgcugcaacagcgaguccagcgugcuguccgcccacgagagcugccugcgggcccccaaccucaucagcuacaagcccaugaucgaccagcuggagugcaccacgaaccugaucgaccccuucguggucuucgagcgcggcucccucccgcagacccggaacgagaagaccuucgcggccagcaaggggaaccgcggcgugcaggccuucuccaaggggagcgugcaggccgaccugacccugauguucgacaacuucgaggucgacuucgugggcgccgcgguguccugcgacgccgccuuccucaaccugacgggcugcuacagcugcaacgccggggcccgggucugccuguccaucaccagcaccggcaccgggacgcucuccgcgcacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacccucaucgccaucgacccguucgacgaccggcgcgaggccgggggcgaguccacgguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggaccggccuguccaagauguggcucgcggccaccaagaaggccagcuga

SEQ ID NO: 12923 - RNA, 3204 nt, Artificial Sequence
  derived and/or modified CDS sequence (opt1) from RVFV(Sudan 2V-2007)__JQ820490.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugcagcguccacggcugcaucgugugcgcccacgggcugaucaacuaccagugccacaccgcgcuguccgccuucguggucguguucguguucagcuccaucgccaucaucugccucgccauccuguaccggguccugaagugccucaagaucgcgccccgcaaggugcugaacccccugauguggaucaccgccuucauccgguggguguacaagaagauggucgcccgcguggccgacaacaucaaccaggugaaccgggagaucggcuggauggagggcgggcagcucguccuggggaaccccgcccccaucccgcgccacgcccccaucccccgguacagcaccuaccugaugcuccugcugaucgugagccacgcguccgccugcagcgagcucauccaggccuccagccgcaucacgaccugcuccaccgagggcgugaacaccaagugccggcugagcggcacggcccugauccgcgccggguccgucggcgcggaggccugccucaugcugaagggggugaaggaggaccagaccaaguuccugaagaucaagaccgugagcuccgagcucagcugccgggagggccaguccuacuggaccggcagcuucuccccgaagugccugagcucccgccggugccaccuggucggggagugccacgugaaccgcugccugagcuggcgcgacaacgagacguccgccgaguucagcuucgugggcgagagcaccaccaugcgggagaacaagugcuucgagcagugcgggggcugggggugcggcugcuucaacgucaaccccuccugccucuucgugcacaccuaccugcagagcgugcgcaaggaggcccugcgggucuucaacugcaucgacugggugcacaagcucacgcuggagaucaccgacuucgacggcuccgugagcaccaucgaccugggggcguccagcucccgcuucaccaacuggggcagcgucucccucagccuggacgccgaggggaucuccggcagcaacuccuucagcuucaucgagucccccgggaagggcuacgccaucguggacgagcccuucagcgagaucccgcggcagggcuuccugggggagauccgcugcaacuccgagagcuccgugcucagcgcccacgagagcugccugcgggcccccaaccugaucuccuacaagcccaugaucgaccagcucgagugcaccacgaaccugaucgaccccuucgucguguucgagcgcggcagccugccgcagacccggaacgacaagaccuucgcggccuccaaggggaaccgcggcgugcaggccuucagcaagggguccguccaggccgaccucacccugauguucgacaacuucgagguggacuucgugggcgccgcggucagcugcgacgccgccuuccugaaccucacgggcugcuacuccugcaacgccggggcccgggugugccugagcaucaccuccaccggcaccgggacgcugagcgcgcacaacaaggacggcucccuccacaucgugcugcccagcgagaacgggaccaaggaccagugccagauccugcacuucaccguccccgagguggaggaggaguucauguacuccugcgacggcgacgagcgcccccuccuggugaagggcacccugauggccaucgacccguucgacgaccggcgcgaggccgggggcgagagcacggucgugaaccccaaguccgggagcuggaacuucuucgacugguucuccggccucaugagcugguucggcgggccccugaagaccauccugcucaucugccuguacguggcccuguccaucggccucuucuuccugcugaucuaccucgggcggaccggccugagcaagauguggcuggcggccaccaagaaggccagcuga

SEQ ID NO: 12924 - RNA, 3204 nt, Artificial Sequence
  derived and/or modified CDS sequence (opt1) from RVFV(35/74)__JF784387.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccuggacccccucauguggaucaccguguucauccgcuggguguacaagaagauggucgcccggguggccgacaacaucaaccaggugaaccgcgagaucggcuggauggagggcgggcagcuggcccuggggaaccccgcccccaucccgcggcacgcccccaucccccgcuacuccaccuaccucaugcugcugcucaucgucagcuacgcgagcgccugcuccgagcugauccaggccagcucccggaucacgaccugcagcaccgagggcgugaacaccaagugccgccuguccggcacggcccucauccgggccgggagcgugggcgcggaggccugccugaugcugaagggggucaaggaggaccagaccaaguuccucaagaucaagaccguguccagcgagcuguccugccgcgagggccagagcuacuggaccggcuccuucagcccgaagugccuguccagccggcgcugccaccuggugggggagugccacgucaaccggugccucuccuggcgcgacaacgagacgagcgccgaguucuccuucgugggcgagagcaccaccaugcgcgagaacaagugcuucgagcagugcgggggcugggggugcggcugcuucaacgugaaccccagcugccuguucguccacaccuaccugcaguccgugcggaaggaggcccuccgcguguucaacugcaucgacuggguccacaagcugacgcuggagaucaccgacuucgacggcagcguguccaccaucgaccucggggcgagcuccagccgguucaccaacuggggcuccgugagccugucccuggacgccgaggggaucagcggcuccaacagcuucuccuucaucgagagccccgggaagggcuacgccaucgucgacgagcccuucuccgagaucccgcgccagggcuuccucggggagauccggugcaacagcgaguccagcgugcuguccgcccacgagagcugccugcgcgcccccaaccucaucagcuacaagcccaugaucgaccagcuggagugcaccacgaaccugaucgaccccuucguggucuucgagcggggcucccucccgcagacccgcaacgacaagaccuucgcggccagcaaggggaaccggggcgugcaggccuucuccaaggggagcgugcaggccgaccugacccugauguucgacaacuucgaggucgacuucgugggcgccgcgguguccugcgacgccgccuuccucaaccugacgggcugcuacagcugcaacgccggggcccgcgucugccuguccaucaccagcaccggcaccgggacgcucuccgcgcacaacaaggacggcagccugcacaucgugcugcccuccgagaacgggaccaaggaccagugccagauccuccacuucaccgugcccgaggucgaggaggaguucauguacagcugcgacggcgacgagcggccccugcuggugaagggcacccucaucgccaucgacccguucgacgaccgccgggaggccgggggcgaguccacgguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcgcaccggccuguccaagauguggcucgcggccaccaagaaggccagcuga

SEQ ID NO: 12925 - RNA, 3204 nt, Artificial Sequence
  derived and/or modified CDS sequence (opt1) from RVFV(200803169)__JF311384.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccacguaccucaugcugcugcucaucgucagcuacgccagcgccugcuccgagcugauccaggccagcucccgcaucacgaccugcagcaccgagggcgugaacaccaagugccggcuguccggcaccgcccucauccgcgcggggagcgugggcgccgaggccugccugaugcugaagggggucaagguggaccagaccaaguuccucaagaucaagaccguguccagcgagcuguccugccgggagggccagagcuacuggacgggcuccuucagcccgaagugccuguccagccgccggugccaccuggucggggagugccacgugaaccgcugccucuccuggcgcgacaacgagaccagcgccgaguucuccuucgugggcgagagcaccaccaugcgggagaacaagugcuucgagcagugcgggggcugggggugcggcugcuucaacgucaaccccagcugccuguucgugcacacguaccugcaguccgugcgcaaggaggcgcuccgggucuucaacugcaucgacugggugcacaagcugacccuggagaucaccgacuucgacggcagcguguccaccaucgaccucggggccagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggaggugcgcugcaacagcgaguccagcguccuguccgcccacgagagcugccugcgggcgcccaaccucgugagcuacaagcccaugaucgaccagcuggagugcacgaccaaccugaucgaccccuucguggucuucgagcgcggcucccucccgcagacccggaacgacaagaccuucgccgccagcaaggggaaccgcggcgugcaggccuucuccaaggggagcgugcaggccgaccugacgcugauguucgacaacuucgaggucgacuucgugggcgcggccguguccugcgacgccgccuuccucaaccugaccggcugcuacagcugcaacgccggggcgcgggucugccuguccaucaccagcaccggcacggggacccucuccgcccacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacgcucaucgccaucgacccguucgacgaccggcgcgaggccgggggcgaguccaccguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccacgaagaaggccagcuga

SEQ ID NO: 12926 - RNA, 3204 nt, Artificial Sequence
  derived and/or modified CDS sequence (opt1) from RVFV(2269/74)__DQ380222.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccagcacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcucaagugccugaagaucgcccccaagaaggugcugaacccccucauguggaucaccgcguucauccggugggucuacaagaagaugguggcccgcguggccgacaacaucaaccaggucaaccgggagaucggcuggauggagggcgggcagcuggcccuggggaaccccgcccccaucccgcgccacgcgcccaucccccgguacuccaccuaccucaugcugcugcucaucgugagcuacgccagcgccugcuccgagcugauccaggccagcucccgcaucacgaccugcagcaccgagggcgugaacaccaagugccggcuguccggcacggcccucauccgcgcggggagcgucggcgccgaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgggacaacgagacgagcgccgaguucuccuucgugggcgagagcaccaccaugcgcgagaacaagugcuucgagcagugcgggggcugggggugcggcugcuucaacgucaaccccagcugccuguucgugcacaccuaccugcaguccgugcgcaaggaggcgcuccgggucuucaacugcaucgacugggugcacaagcugacgcuggagaucaccgacuucgacggcagcguguccaccaucgaccucggggccagcuccagccgcuucaccaacuggggcuccgucagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcgugcuguccgcccacgagagcugccugcgggcgcccaaccucaucagcuacaagcccaugaucgaccagcuggagugcaccacgaaccugaucgaccccuucgucguguucgagcgcggcucccucccgcagacccggaacgacaagaccuucgccgccagcaaggggaaccgcggcgugcaggccuucuccaaggggagcguccaggccgaccugacccugauguucgacaacuucgagguggacuucgugggcgcggccgucuccugcgacgccgccuuccucaaccugacgggcugcuacagcugcaacgccggggcgcgggugugccuguccaucaccagcaccggcaccgggacgcucuccgcccacaacaaggacggcagccugcacaucgugcugcccuccgagaacgggaccaaggaccagugccagauccuccacuucaccguccccgagguggaggaggaguucauguacagcugcgacggcgacgagcgcccccugcuggugaagggcacccucaucgccaucgacccguucgacgaccggcgcgaggccgggggcgaguccacggucgugaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccaccaagaaggccagcuga

SEQ ID NO: 12927 - RNA, 3204 nt, Artificial Sequence
  derived and/or modified CDS sequence (opt1) from RVFV(SA-51 (Van Wyck))__DQ380195.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccggggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcgcguggucgugaagcgggagcugagcgccaagccgauccagcgcguggagcccugcacgaccugcaucaccaagugcgagccccacggccuggucgugcgguccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcucaagugccugaagaucgcgccccgcaaggugcugaacccccucauguggaucaccgccuucauccggugggucuacaagaagaugguggcccgcguggccgacaacaucaaccaggucaaccgggagaucggcuggauggagggcgggcagcuggcccuggggaaccccgcccccaucccgcgccacgcgcccaucccccgguacuccaccuaccucaugcugcugcucaucgugagcuacgccagcgccugcuccgagcugauccaggccagcucccgcaucacgaccugcagcaccgagggcgugaacaccaagugccggcuguccggcacggcccucauccgcgcggggagcgucggcgccgaggccugccugaugcugaagggggugaaggaggaccagaccaaguuccucaagaucaagaccguguccagcgagcuguccugccgggagggccagagcuacuggaccggcuccuucagcccgaagugccuguccagccgccggugccaccuggucggggagugccacgugaaccgcugccucuccuggcgcgacaacgagacgagcgccgaguucuccuucgugggcgagagcaccaccaugcgggagaacaagugcuucgagcagugcgggggcugggggugcggcugcuucaacgucaaccccagcugccuguucgugcacaccuaccugcaguccgugcgcaaggaggcgcuccgggucuucaacugcaucgacugggugcacaagcugacgcuggaggugaccgacuucgacggcagcgucuccaccaucgaccucggggccagcuccagccgcuucaccaacuggggcuccgugagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcguccuguccgcccacgagagcugccugcgggcgcccaaccucaucagcuacaagcccaugaucgaccagcuggagugcaccacgaaccugaucgaccccuucgugguguucgagcgcggcucccucccgcagacccggaacgacaagaccuucgccgccagcaaggggaaccgcggcguccaggccuucuccaaggggagcgugcaggccgaccugacccugauguucgacaacuucgagguggacuucgucggcgcggccguguccugcgacgccgccuuccucaaccugacgggcugcuacagcugcaacgccggggcgcgggugugccuguccaucaccagcaccggcaccgggacgcucuccgcccacaacaaggacggcagccugcacaucguccugcccuccgagaacgggaccaaggaccagugccagauccuccacuucaccgugcccgagguggaggaggaguucauguacagcugcgacggcgacgagcgcccccugcuggucaagggcacccucaucgccaucgacccguucgacgaccggcgcgaggccgggggcgaguccacgguggugaaccccaagagcggguccuggaacuucuucgacugguucagcggccugauguccugguucggcgggccccugaagaccauccuccugaucugccuguacgucgcgcucagcaucggccuguucuuccugcucaucuaccuggggcggaccggccuguccaagauguggcucgccgccaccaagaaggccagcuga

SEQ ID NO: 12928 - RNA, 3204 nt, Artificial Sequence
  derived and/or modified CDS sequence (opt1) from RVFV(OS-8)__DQ380185.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccugaacccccucauguggaucaccgccuucauccgcuggguguacaagaagaugguggcccgggucgccgacaacaucaaccaggugaaccgcgagaucggcuggauggagggcgggcagcuggcccuggggaaccccgcccccaucccgcggcacgcgcccaucccccgcuacuccaccuaccucaugcugcugcucaucgugagcuacgccagcgccugcuccgagcugauccaggccagcucccggaucacgaccugcagcaccgagggcgucaacaccaagugccgccuguccggcacggcccucauccgggcggggagcgugggcgccgaggccugccugaugcugaagggggugaaggaggaccagaccaaguuccuccgcaucaagaccgucuccagcgagcuguccugccgggagggccagagcuacuggaccggcuccuucagcccgaagugccuguccagccgccggugccaccuggugggggagugccacgugaaccgcugccucuccuggcgcgacaacgagacgagcgccgaguucuccuucgucggcgagagcaccaccaugcgggagaacaagugcuucgagcagugcgggggcugggggugcggcugcuucaacgugaaccccagcugccuguucgugcacaccuaccugcaguccguccgcaaggaggcgcuccggguguucaacugcaucgacugggugcacaagcugacgcuggagaucaccgacuucgacggcagcgucuccaccaucgaccucggggccagcuccagccgcuucaccaacuggggcuccgugagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcguccuguccgcccacgagagcugccugcgggcgcccaaccucaucagcuacaagcccaugaucgaccagcuggagugcaccacgaaccugaucgaccccuucgugguguucgagcgcggcucccucccgcagacccggaacgacaagaccuucgccgccagcaaggggaaccgcggcguccaggccuucuccaaggggagcgugcaggccgaccugacccugauguucgacaacuucgagguggacuucgucggcgcggccguguccugcgacgccgccuuccucaaccugagcggcugcuacuccugcaacgccggggcgcgggugugccugagcaucacguccaccggcaccgggacccucagcgcccacaacaaggacggcucccugcacaucguccugcccagcgagaacgggacgaaggaccagugccagauccuccacuucaccgugcccgagguggaggaggaguucauguacuccugcgacggcgacgagcgcccccugcuggucaagggcacccucaucgccaucgacccguucgacgaccggcgcgaggccgggggcgagagcaccguggugaaccccaaguccgggagcuggaacuucuucgacugguucuccggccugaugagcugguucggcgggccccugaagacgauccuccugaucugccuguacgucgcgcucuccaucggccuguucuuccugcucaucuaccuggggcggaccggccugagcaagauguggcucgccgccaccaagaaggccagcuga

SEQ ID NO: 12929 - RNA, 3204 nt, Artificial Sequence
  derived and/or modified CDS sequence (opt1) from RVFV(KEN07-KUR340)__EF460404.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggaugcucaagugccugaagaucgcgccccgcaucguccugaacccccucauguggaucaccgccuucauccgguggguguacaagaagaugguggcccgcgucgccgacaacaucaaccaggugaaccgggagaucggcuggauggagggcgggcagcuggcccuggggaaccccgcccccaucccgcgccacgcgcccaucccccgguacuccacguaccucaugcugcugcucaucgugagcuacgccagcgccugcuccgagcugauccaggccagcucccgcaucacgaccugcagcaccgagggcgucaacaccaagugccggcuguccggcaccgcccucauccgcgcggggagcgugggcgccgaggccugccugaugcugaagggggugaaggaggaccagaccaaguuccucaagaucaagaccgucuccagcgagcuguccugccgggagggccagagcuacuggacgggcuccuucagcccgaagugccuguccagccgccggugccaccuggugggggagugccacgugaaccgcugccucuccuggcgcgacaacgagaccagcgccgaguucuccuucgucggcgagagcaccaccaugcgggagaacaagugcuucgagcagugcgggggcugggggugcggcugcuucaacgugaaccccagcugccuguucgugcacacguaccugcaguccguccgcaaggaggcgcuccggguguucaacugcaucgacugggugcacaagcugacccuggagaucaccgacuucgacggcagcgucuccaccaucgaccucggggccagcuccagccgcuucaccaacuggggcuccgugagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcguccuguccgcccacgagagcugccugcgggcgcccaaccucgugagcuacaagcccaugaucgaccagcuggagugcacgaccaaccugaucgaccccuucguggucuucgagcgcggcucccucccgcagacccggaacgacaagaccuucgccgccagcaaggggaaccgcggcgugcaggccuucuccaaggggagcgugcaggccgaccugacgcugauguucgacaacuucgaggucgacuucgugggcgcggccguguccugcgacgccgccuuccucaaccugaccggcugcuacagcugcaacgccggggcgcgggucugccuguccaucaccagcaccggcacggggacccucuccgcccacaacaaggacggcagccugcacaucgugcugcccuccgagaacgggaccaaggaccagugccagauccuccacuucaccgugcccgaggucgaggaggaguucauguacagcugcgacggcgacgagcgcccccugcuggugaagggcacgcucaucgccaucgacccguucgacgaccggcgcgaggccgggggcgaguccaccguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccacgaagaaggccagcuga

SEQ ID NO: 12930 - RNA, 3204 nt, Artificial Sequence
  derived and/or modified CDS sequence (opt1) from RVFV(ANK-3837)__DQ380215.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaagcuggacuccggccagaccaagcgcgagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacccugaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacacggcgcugagcgccuucguggucguguucguguucuccagcaucgccaucaucugccuggccauccucuaccggguccugaagugccugaagaucgcgccccgcaaggugcucaacccccugauguggaucaccgccuucauccgguggguguaccgcaagauggucgcccggguggccgacaacaucaaccaggugaaccgcgagaucggcuggauggagggcgggcagcugguccucgggaaccccgcccccaucccgcggcacgugcccaucccccgcuacuccaccuaccugaugcugcuccugaucgugagcuacgccagcgcgugcuccgagcugauccaggccagcucccggaucaccacgugcagcaccgagggcgucaacaccaagugccgccucuccggcaccgcccugauccgggccgggagcgugggcgccgaggcgugccugaugcucaagggggugaaggaggaccagacgaaguuccugaagaucaagaccgucuccagcgagcuguccugccgcgagggccagagcuacuggaccggcuccuucagcccgaagugccuguccagccggcgcugccaccucgugggggagugccacgugaaccgcugccuguccuggcgggacaacgagaccagcgccgaguucuccuucgucggcgagagcacgaccaugcgcgagaacaagugcuucgagcagugcgggggcugggggugcggcugcuucaacgugaaccccagcugccuguucgugcacaccuaccuccaguccguccggaaggaggcccugcgcguguucaacugcaucgacugggugcacaagcugacccucgagaucacggacuucgacggcagcgucuccaccaucgaccugggggccagcuccagccgguucaccaacuggggcuccgugagccugucccucgacgcggaggggaucagcggcuccaacagcuucuccuucaucgagagccccgggaagggcuacgccaucguggacgagcccuucuccgagaucccgcgccagggcuuccugggggagauccggugcaacagcgaguccagcguccuguccgcccacgagagcugccuccgcgcccccaaccugaucagcuacaagcccaugaucgaccagcuggagugcaccaccaaccucaucgaccccuucgugguguucgagcggggcucccugccgcagacgcgcaacgacaagaccuucgccgcgagcaaggggaaccggggcguccaggccuucuccaaggggagcgugcaggccgaccugacccucauguucgacaacuucgagguggacuucgucggcgccgccguguccugcgacgcggccuuccugaaccugaccggcugcuacagcugcaacgccggggcccgcgugugccucuccaucacgagcaccggcaccgggacccuguccgcccacaacaaggacggcagccugcacaucguccuccccuccgagaacgggacgaaggaccagugccagauccugcacuucaccgugcccgagguggaggaggaguucauguacagcugcgacggcgacgagcggccccugcucguccgcggcacccugaucgcgaucgacccguucgacgaccggcgcgaggccgggggcgaguccaccguggugaaccccaagagcggguccuggaacuucuucgacugguucagcggccugauguccugguucggcgggccccucaagacgauccugcugaucugccucuacgucgcccugagcaucggccuguucuuccuccugaucuaccuggggcggaccggccucuccaagauguggcuggccgcgaccaagaaggccagcuga

SEQ ID NO: 12931 - RNA, 3204 nt, Artificial Sequence
  derived and/or modified CDS sequence (opt1) from RVFV(Lunyo)__KU167026.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccaugguguccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccugaacccccucauguggaucaccgccuucauccgcuggguguacaagaagaugguggcccgggucgccgacaacaucaaccaggugaaccgcgagaucggcuggauggagggcgggcagcuggcccuggggaaccccgcccccaucccgcggcacgcgcccaucccccgcuacuccaccuaccucaugcugcugcucaucgugagcuacgccagcgccugcuccgagcugauccaggccagcucccggaucacgaccugcagcaccgagggcgucaacacccgcugccggcuguccggcacggcccucauccgcgcggggagcgugggcgccgaggccugccugaugcugaagggggugaaggaggaccagaccaaguuccucaagaucaagaccgucuccagcgagcuguccugccgggagggccagagcuacuggaccggcuccuucagcccgaagugccuguccagccgccggugccaccuggugggggagugccacgugaaccgcugccucuccuggcgcgacaacgagacgagcgccgaguucuccuucgucggcgagagcaccaccaugcgggagaacaagugcuucgagcagugcgggggcugggggugcggcugcuucaacgugaaccccagcugccuguucgugcacaccuaccugcaguccguccgcaaggaggcgcuccggguguucaacugcaucgacugggugcacaagcugacgcuggagaucaccgacuucgacggcagcgucuccaccaucgaccucggggccagcuccagccgcuucaccaacuggggcuccgugagccugucccuggacgccgaggggaucagcggcuccaacagcuucuccuucaucgagagccccgggaagggcuacgccaucguggacgagcccuucuccgagaucccgcggcagggcuuccucggggagauccgcugcaacagcgaguccagcguccuguccgcccacgagagcugccugcgggcgcccaaccucaucagcuacaagcccaugaucgaccagcuggagugcaccacgaaccugaucgaccccuucgugguguucgagcgcggcucccucccgcagacccggaacgacaagaccuucgccgccagcaaggggaaccgcggcguccaggccuucuccaaggggagcgugcaggccgaccugacccugauguucgacaacuucgagguggacuucgucggcgcggccguguccugcgacgccgccuuccucaaccugacgggcugcuacagcugcaacgccggggcgcgggugugccuguccaucaccagcaccggcaccgggacgcucuccgcccacaacaaggacggcagccugcacaucguccugcccuccgagaacgggaccaaggaccagugccagauccuccacuucaccgugcccgagguggaggaggaguucauguacagcugcgacggcgacgagcgcccccugcuggucaagggcacccucaucgccaucgacccguucgacgaccggcgcgaggccgggggcgaguccacgguggugaaccccaagagcggguccuggaacuucuucgacugguucagcggccugauguccugguucggcgggccccugaagaccauccuccugaucugccuguacgucgcgcucagcaucggccuguucuuccugcucaucuaccuggggcggaccggccuguccaagauguggcucgccgccaccaagaaggccagcuga

SEQ ID NO: 12932 - RNA, 3204 nt, Artificial Sequence
  derived and/or modified CDS sequence (opt1) from RVFV(200803167)__JF311382.1__Gn-Gc
auggccggcaucgccaugaccgugcugcccgcgcucgccgucuucgcccuggccccggugguguucgccgaggaccugcaccuccgcaaccggcccgggaagggccacaacuacaucgacgggaugacccaggaggacgcgacgugcaagcccgucaccuacgccggcgccugcagcuccuucgacgugcugcuggagaaggggaaguucccccucuuccagagcuacgcccaccaccgcacccugcuggaggcggugcacgacaccaucaucgccaaggccgacccgcccuccugcgaccuccagagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugccggacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagcccauccagcggguggagccgugcacgaccugcaucaccaagugcgagccccacggccucgucgugcgcuccaccggcuucaagaucagcuccgccgucgccugcgcgagcggggugugcgugaccggcucccagagccccuccaccgagaucgcccugaaguaccccgggaucagccaguccagcggcggggacaucggcguccacauggcccacgacgaccaguccgugagcuccaagaucguggcccacugcccgccccaggaccccugccugguccacggcugcaucgugugcgcgcacgggcucaucaacuaccagugccacacggcccugagcgccuucguggucguguucguguucuccagcaucgccaucaucugccuggccauccucuaccggguccugaagugccugaagaucgcgccccgcaaggugcucaacccgcugauguggaucaccgccuucauccgguggguguacaagaagauggucgcccgcguggccgacaacaucaaccaggugaaccgggagaucggcuggauggagggcgggcagcugguccucgggaaccccgcccccaucccccgccacgcgccgaucccccgguacuccaccuaccugaugcugcuccugaucgugagcuacgccagcgccugcuccgagcugauccaggccagcucccgcaucaccacgugcagcaccgagggcgugaacaccaagugccggcucuccggcaccgcccugauccgcgcggggagcgucggcgccgaggccugccugaugcucaagggggugaaggaggaccagacgaaguuccugaagaucaagaccguguccagcgagcuguccugccgggagggccagagcuacuggaccggcuccuucagccccaagugccuguccagccgccggugccaccucgucggggagugccacgugaaccgcugccuguccuggcgcgacaacgagaccagcgccgaguucuccuucgugggcgagagcacgaccaugcgggagaacaagugcuucgagcagugcgggggcugggggugcggcugcuucaacgucaacccgagcugccuguucgugcacaccuaccuccaguccgugcgcaaggaggcgcugcgggucuucaacugcaucgacugggugcacaagcugacccucgagaucacggacuucgacggcagcguguccaccaucgaccugggggccagcuccagccgcuucaccaacuggggcuccgucagccugucccucgacgccgaggggaucagcggcuccaacagcuucuccuucaucgagagccccgggaagggcuacgccaucguggacgagcccuucuccgagaucccccggcagggcuuccugggggagauccgcugcaacagcgaguccagcgugcuguccgcccacgagagcugccuccgggcgccgaaccugaucagcuacaagcccaugaucgaccagcuggagugcaccaccaaccucaucgaccccuucgucguguucgagcgcggcucccugccccagacgcggaacgacaagaccuucgccgccagcaaggggaaccgcggcgugcaggccuucuccaaggggagcguccaggccgaccugacccucauguucgacaacuucgagguggacuucgugggcgcggccgucuccugcgacgccgccuuccugaaccugaccggcugcuacagcugcaacgccggggcgcgggugugccucuccaucacgagcaccggcaccgggacccuguccgcccacaacaaggacggcagccugcacaucgugcucccguccgagaacgggacgaaggaccagugccagauccugcacuucaccguccccgagguggaggaggaguucauguacagcugcgacggcgacgagcgcccccugcucgugaagggcacccugaucgccaucgaccccuucgacgaccggcgcgaggccgggggcgaguccaccgucgugaaccccaagagcggguccuggaacuucuucgacugguucagcggccugauguccugguucggcgggccgcucaagacgaugcugcugaucugccucuacguggcgcugagcaucggccuguucuuccuccugaucuaccuggggcggaccggccucuccaagauguggcuggccgccaccaagaaggccagcuga

SEQ ID NO: 12933 - RNA, 3204 nt, Artificial Sequence
  derived and/or modified CDS sequence (opt1) from RVFV(2373/74)__DQ380194.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaugguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucgugagcuacgccagcgccugcuccgagcugauccaggccagcucccggaucacgaccugcagcaccgagggcgugaacaccaagugccgccuguccggcacggcccucauccgggcggggagcgucggcgccgaggccugccugaugcugaagggggugaaggaggaccagaccaaguuccucaagaucaagaccguguccagcgagcuguccugccgcgagggccagagcuacuggaccggcuccuucagcccgaagugccuguccagccggcgcugccaccuggucggggagugccacgugaaccggugccucuccuggcgcgacaacgagacgagcgccgaguucuccuucgugggcgagagcaccaccaugcgcgagaacaagugcuucgagcagugcgggggcugggggugcggcugcuucaacgucaaccccagcugccuguucgugcacaccuaccugcaguccgugcggaaggaggcgcuccgcgucuucaacugcaucgacugggugcacaagcugacgcuggagaucaccgacuucgacggcagcguguccacccucgaccugggggccagcuccagccgguucaccaacuggggcuccgucagccugucccucgacgccgaggggaucagcggcuccaacagcuucuccuucaucgagagccccgggaagggcuacgccaucguggacgagcccuucuccgagaucccgcgccagggcuuccugggggagauccggugcaacagcgaguccagcgugcuguccgcccacgagagcugccuccgcgcgcccaaccugaucagcuacaagcccaugaucgaccagcuggagugcaccacgaaccucaucgaccccuucgucguguucgagcggggcucccugccgcagacccgcaacgagaagaccuucgccgccagcaaggggaaccggggcgugcaggccuucuccaaggggagcguccaggccgaccugacccucauguucgacaacuucgagguggacuucgugggcgcggccgucuccugcgacgccgccuuccugaaccugacgggcugcuacagcugcaacgccggggcgcgcgugugccucuccaucaccagcaccggcaccgggacgcuguccgcccacaacaaggacggcagccugcacaucgugcuccccuccgagaacgggaccaaggaccagugccagauccugcacuucaccguccccgagguggaggaggaguucauguacagcugcgacggcgacgagcggccccugcucgugaagggcacccugaucgccaucgacccguucgacgaccgccgggaggccgggggcgaguccacggucgugaaccccaagagcggguccuggaacuucuucgacugguucagcggccugauguccugguucggcgggccccucaagaccauccugcugaucugccucuacguggcgcugagcaucggccuguucuuccuccugaucuaccuggggcgcaccggccucuccaagauguggcuggccgccaccaagaaggccagcuga

SEQ ID NO: 12934 - RNA, 3204 nt, Artificial Sequence
  derived and/or modified CDS sequence (opt1) from RVFV(Kenya 57 (Rintoul))__DQ380192.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaucaagcgcgagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacccucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacacggcgcucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcuggggaaccccgcccccaucccgcggcacgcccccaucccccgcuacuccaccuaccucaugcugcugcucaucgugagcuacgcgagcgccugcuccgagcugauccaggccagcucccggaucaccacgugcagcaccgagggcgucaacaccaagugccgccuguccggcaccgcccucauccgggccgggagcgugggcgcggaggccugccugaugcugaagggggugaaggaggaccagacgaaguuccucaagaucaagaccgucuccagcgagcuguccugccgcgagggccagagcuacuggaccggcuccuucagcccgaagugccuguccagccggcgcugccaccuggugggggagugccacgugaaccggugccucuccuggcgcgacaacgagaccagcgccgaguucuccuucgucggcgagagcacgaccaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucacggacuucgacggcagcgucuccaccguggaccucggggcgagcuccagccgguucaccaacuggggcuccgugagccugucccuggacgccgaggggaucagcggcuccaacagcuucuccuucaucgagagccccgggaagggcuacgccaucgucgacgagcccuucuccgagaucagccgccagggcuuccucggggagauccggugcaacuccgagagcuccgugcugagcgcccacgagagcugccugcgcgccccgaaccucaucuccuacaagcccaugaucgaccagcuggagugcaccaccaaccugaucgaccccuucguggucuucgagcggggcagccucccccagacgcgcaacgacaagaccuucgcggccuccaaggggaaccggggcgugcaggccuucagcaagggguccgugcaggccgaccugacccugauguucgacaacuucgaggucgacuucgugggcgccgcggugagcugcgacgccgccuuccucaaccugaccggcugcuacuccugcaacgccggggcccgcgucugccugagcaucacguccaccggcaccgggacccucagcgcgcacaacaaggacggcucccugcacaucgugcugccgagcgagaacgggacgaaggaccagugccagauccuccacuucaccgugcccgaggucgaggaggaguucauguacuccugcgacggcgacgagcggccccugcuggugaagggcacccucaucgccaucgaccccuucgacgaccgccgggaggccgggggcgagagcaccguggucaacccgaaguccgggagcuggaacuucuucgacugguucuccggccugaugagcugguucggcgggccccugaagacgauccuccugaucugccuguacguggcccucuccaucggccuguucuuccugcucaucuaccuggggcgcaccggccugagcaagauguggcucgcggccaccaagaaggccagcuga

SEQ ID NO: 12935 - RNA, 3204 nt, Artificial Sequence
  derived and/or modified CDS sequence (opt1) from RVFV(RVFBJ01/2016)__KX785331.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaagcacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcuccggugccugaagaucgcccccaagaaggugcugaacccccucauguggaucaccgcguucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucaucagcuacgccagcgccugcuccgagcugauccaggccagcucccggaucacgaccugcagcaccgagggcgugaacaccaagugccgccuguccggcacggcccucauccgggcggggagcgugggcgccgaggccugccugaugcugaagggggucaaggaggaccagaccaaguuccucaagaucaagaccguguccagcgagcuguccugccgcgagggccagagcuacuggaccggcuccuucagcccgaagugccuguccagccggcgcugccaccuggugggggagugccacgucaaccggugccucuccuggcgcgacaacgagacgagcgccgaguucuccuucgugggcgagagcaccaccaugcgcgagaacaagugcuucgagcagugcgggggcugggggugcggcugcuucaacgugaaccccagcugccuguucguccacaccuaccugcaguccgugcggaaggaggcgcuccgcguguucaacugcaucgacuggguccacaagcugacgcuggagaucaccgacuucgacggcagcguguccaccaucgaccucggggccagcuccagccgguucaccaacuggggcuccgugagccugucccuggacgccgaggggaucagcggcuccaacagcuucuccuucaucgagagccccgggaagggcuacgccaucgucgacgagcccuucuccgagaucccgcgccagggcuuccucggggagauccggugcaacagcgaguccagcgugcuguccgcccacgagagcugccugcgcgcgcccaaccucaucagcuacaagcccaugaucgaccagcuggagugcaccacgaaccugaucgaccccuucguggucuucgagcggggcucccucccgcagacccgcaacgacaagaccuucgccgccagcaaggggaaccggggcgugcaggccuucuccaaggggagcgugcaggccgaccugacccugauguucgacaacuucgaggucgacuucgugggcgcggccguguccugcgacgccgccuuccucaaccugacgggcugcuacagcugcaacgccggggcgcgcgucugccuguccaucaccagcaccggcaccgggacgcucuccgcccacaacaaggacggcagccugcacaucgugcugcccuccgagaacgggaccaaggaccagugccagauccuccacuucaccgugcccgaggucgaggaggaguucauguacagcugcgacggcgacgagcggccccugcuggugaagggcacccucaucgccaucgacccguucgacgaccgccgggaggccgggggcgaguccacgguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcgcaccggccuguccaagauguggcucgccgccaccaagaaggccagcuga

SEQ ID NO: 12936 - RNA, 3204 nt, Artificial Sequence
  derived and/or modified CDS sequence (opt1) from RVFV(clone 13)__DQ380213.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaagcacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagaaccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacagcaccuaccucaugcugcugcucaucguguccuacgcgagcgccugcagcgagcugauccaggccuccagccgcaucacgaccugcuccaccgagggcgugaacaccaagugccggcugagcggcacggcccucauccgcgccggguccgucggcgcggaggccugccugaugcugaagggggugaaggacgaccagaccaaguuccucaagaucaagaccgugagcuccgagcugagcugccgggagggccaguccuacuggaccggcagcuucuccccgaagugccugagcucccgccggugccaccuggucggggagugccacgugaaccgcugccucagcuggcgcgacaacgagacguccgccgaguucagcuucgugggcgaguccaccaccaugcgggagaacaagugcuucgagcagugcgggggcugggggugcggcugcuucaacgucaaccccagcugccuguucgugcacaccuaccugcagagcgugcgcaaggaggcccuccgggucuucaacugcaucgacugggugcacaagcugacgcuggagaucaccgacuucgacggcuccgugagcaccaucgaccucggggcguccagcucccgcuucaccaacuggggcagcgucucccugagccuggacgccgaggggaucuccggcagcaacuccuucagcuucaucgagucccccgggaagggcuacgccaucguggacgagcccuucagcgagaucccgcggcagggcuuccucggggagauccgcugcaacuccgagagcuccgugcugagcgcccacgaguccugccugcgggcccccaaccucaucagcuacaagcccaugaucgaccagcuggagugcaccacgaaccugaucgaccccuucgucguguucgagcgcggcagccucccgcagacccggaacgagaagaccuucgcggccuccaaggggaaccgcggcgugcaggccuucagcaagggguccguccaggccgaccugacccugauguucgacaacuucgagguggacuucgugggcgccgcggucagcugcgacgccgccuuccucaaccugacgggcugcuacuccugcaacgccggggcccgggugugccugagcaucaccuccaccggcaccgggacgcucagcgcgcacaacaaggacggcucccugcacaucgugcugcccagcgagaacgggaccaaggaccagugccagauccuccacuucaccguccccgagguggaggaggaguucauguacuccugcgacggcgacgagcgcccccugcuggugaagggcacccucaucgccaucgacccguucgacgaccggcgcgaggccgggggcgagagcacggucgugaaccccaaguccgggagcuggaacuucuucgacugguucuccggccugaugagcugguucggcgggccccugaagaccauccuccugaucugccuguacguggcccucuccaucggccuguucuuccugcucaucuaccuggggcggaccggccugagcaagauguggcucgcggccaccaagaaggccuccuga

SEQ ID NO: 12937 - RNA, 3204 nt, Artificial Sequence
  derived and/or modified CDS sequence (opt1) from RVFV__JQ068143.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccaucgacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcuccggugccugaagaucgcccccaagaaggugcugaacccccucauguggaucaccgcguucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucaucagcuacgccagcgccugcuccgagcugauccaggccagcucccggaucacgaccugcagcaccgagggcgugaacaccaagugccgccuguccggcacggcccucauccgggcggggagcgugggcgccgaggccugccugaugcugaagggggucaaggaggaccagaccaaguuccucaagaucaagaccguguccagcgagcuguccugccgcgagggccagagcuacuggaccggcuccuucagcccgaagugccuguccagccggcgcugccaccuggugggggagugccacgucaaccggugccucuccuggcgcgacaacgagacgagcgccgaguucuccuucgugggcgagagcaccaccaugcgcgagaacaagugcuucgagcagugcgggggcugggggugcggcugcuucaacgugaaccccagcugccuguucguccacaccuaccugcaguccgugcggaaggaggcgcuccgcguguucaacugcaucgacuggguccacaagcugacgcuggagaucaccgacuucgacggcagcguguccaccaucgaccucggggccagcuccagccgguucaccaacuggggcuccgugagccugucccuggacgccgaggggaucagcggcuccaacagcuucuccuucaucgagagccccgggaagggcuacgccaucgucgacgagcccuucuccgagaucccgcgccagggcuuccucggggagauccggugcaacagcgaguccagcgugcuguccgcccacgagagcugccugcgcgcgcccaaccucaucagcuacaagcccaugaucgaccagcuggagugcaccacgaaccugaucgaccccuucguggucuucgagcggggcucccucccgcagacccgcaacgacaagaccuucgccgccagcaaggggaaccggggcgugcaggccuucuccaaggggagcgugcaggccgaccugacccugauguucgacaacuucgaggucgacuucgugggcgcggccguguccugcgacgccgccuuccucaaccugacgggcugcuacagcugcaacgccggggcgcgcgucugccuguccaucaccagcaccggcaccgggacgcucuccgcccacaacaaggacggcagccugcacaucgugcugcccuccgagaacgggaccaaggaccagugccagauccuccacuucaccgugcccgaggucgaggaggaguucauguacagcugcgacggcgacgagcggccccugcuggugaagggcacccucaucgccaucgacccguucgacgaccgccgggaggccgggggcgaguccacgguggucaaccccaagagcggguccuggaacuucuucgacugguucagcggccugauguccugguucggcgggccccugaagaccauccuccugaucugccuguacguggcgcucagcaucggccuguucuuccugcucaucuaccuggggcgcaccggccuguccaagauguggcucgccgccaccaagaaggccagcuga

SEQ ID NO: 12938 - RNA, 3204 nt, Artificial Sequence
  derived and/or modified CDS sequence (opt1) from RVFV(SA-75)__DQ380189.1__Gn-Gc
auggcccgcaucgccaugaccgugcugcccgcgcucgccgucuucgcccuggccccggugguguucgccgaggacccccaccuccggaaccgccccggcaaggggcacaacuacaucgacggcaugacccaggaggacgcgacgugcaagcccgucaccuacgccggggccugcagcuccuucgacgugcugcuggagaagggcaaguucccgcuguuccagagcuacgcccaccaccggacccuccuggaggcggugcacgacaccaucaucgccaaggccgacccgcccuccugcgaccugcagagcgcccacgggaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccgccagaugaccggcgccucccucaagaaggggagcuacccccugcaggaccuguucugccaguccagcgaggacgacggcuccaagcucaagaccaagaugaagggggugugcgaggucggcgugcaggcccugaagaagugcgacgggcagcugagcacggcccacgaggugguccccuucgccguguucaagaacuccaagaagguguaccucgacaagcuggaccugaagaccgaggagaaccuccugcccgacagcuucgucugcuucgagcacaagggccaguacaagggcaccauggacuccgggcagaccaagcgggagcucaagagcuucgacaucucccagugccccaagaucggcgggcacggcagcaagaagugcacgggcgacgcggccuucugcuccgccuacgagugcaccgcccaguacgccaacgcguacugcagccacgccaacgggagcggcguggugcagauccaggucuccgggguguggaagaagccccugugcgugggcuacgagcgcgucguggugaagcgggagcugagcgccaagccgauccagcgcgucgagcccugcacgaccugcaucaccaagugcgagccccacgggcuggugguccgguccaccggcuucaagaucagcuccgccguggccugcgcgagcggcgugugcgucaccgggucccagagccccuccaccgagaucacgcucaaguacccgggcaucagccaguccagcgggggcgacaucggggugcacauggcccacgacgaccaguccgugagcuccaagaucgucgcccacugcccgccccaggaccccugccuggugcacggcugcaucgugugcgcccacggccugaucaacuaccagugccacaccgcgcucagcgccuucgucgugguguucgucuucuccagcguggccaucaucugccuggccauccuguacaaggugcucaagugccugaagaucgcgccccgcaagguccugaacccccucauguggaucaccguguucauccgguggguguacaagaagauggucgcccgcguggccgacaacaucaaccaggugaaccgggagaucggguggauggagggcgggcagcuggcccugggcaaccccgcccccaucccgcgccacgcccccaucccccgguacuccaccuaccucaugcugcugcucaucgucagcuacgcgagcgccugcuccgagcugauccaggccagcucccgcaucacgaccugcagcaccgagggggugaacaccaagugccggcuguccggcacggcccucauccgcgccggcagcgugggggcggaggccugccugaugcugaagggcgucaaggaggaccagaccaaguuccucaagaucaagaccguguccagcgagcuguccugccgggaggggcagagcuacuggaccggcuccuucagcccgaagugccuguccagccgccggugccaccuggugggcgagugccacgucaaccgcugccucuccuggcgcgacaacgagacgagcgccgaguucuccuucgugggggagagcaccaccaugcgggagaacaagugcuucgagcagugcggcggguggggcugcgggugcuucaacgugaaccccagcugccuguucguccacaccuaccugcaguccgugcgcaaggaggcccuccggguguucaacugcaucgacuggguccacaagcugacgcuggagaucaccgacuucgacggcagcguguccaccaucgaccucggcgcgagcuccagccgcuucaccaacuggggguccgugagccugucccuggacgccgagggcaucagcggguccaacagcuucuccuucaucgagagccccggcaagggguacgccaucgucgacgagcccuucuccgagaucccgcggcagggcuuccucggcgagauccgcugcaacagcgaguccagcgugcuguccgcccacgagagcugccugcgggcccccaaccucaucagcuacaagcccaugaucgaccagcuggagugcaccacgaaccugaucgaccccuucguggucuucgagcgcgggucccucccgcagacccggaacgacaagaccuucgcggccagcaagggcaaccgcggggugcaggccuucuccaagggcagcgugcaggccgaccugacccugauguucgacaacuucgaggucgacuucgugggggccgcgguguccugcgacgccgccuuccucaaccugacgggcugcuacagcugcaacgccggcgcccgggucugccuguccaucaccagcaccgggaccggcacgcucuccgcgcacaacaaggacgggagccugcacaucgugcugcccuccgagaacggcaccaaggaccagugccagauccuccacuucaccgugcccgaggucgaggaggaguucauguacagcugcgacggggacgagcgcccccugcuggugaagggcacccucaucgccaucgacccguucgacgaccggcgcgaggccggcggggaguccacgguggucaaccccaagagcggcuccuggaacuucuucgacugguucagcgggcugauguccugguucggcggcccccugaagaccauccuccugaucugccuguacguggcccucagcaucgggcuguucuuccugcucaucuaccugggccggaccgggcuguccaagauguggcucgcggccaccaagaaggccagcuga

SEQ ID NO: 12939 - RNA, 3204 nt, Artificial Sequence
  derived and/or modified CDS sequence (opt1) from RVFV(ANK-6087)__DQ380216.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaagcuggacuccggccagaccaagcgcgagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacccugaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacacggcgcugagcgccuucguggucguguucguguucuccagcaucgccaucaucugccuggccauccucuaccggguccugaagugccugaagaucgcgccccgcaaggugcucaacccccugauguggaucaccgccuucauccgguggguguaccgcaagauggucgcccggguggccgacaacaucaaccaggugaaccgcgagaucggcuggauggagggcgggcagcugguccucgggaaccccgcccccaucccgcggcacgugcccaucccccgcuacuccaccuaccugaugcugcuccugaucgugagcuacgccagcgcgugcuccgagcugauccaggccagcucccggaucaccacgugcagcaccgagggcgucaacaccaagugccgccucuccggcaccgcccugauccgggccgggagcgugggcgccgaggcgugccugaugcucaagggggugaaggaggaccagacgaaguuccugaagaucaagaccgucuccagcgagcuguccugccgcgagggccagagcuacuggaccggcuccuucagcccgaagugccuguccagccggcgcugccaccucgugggggagugccacgugaaccgcugccuguccuggcgggacaacgagaccagcgccgaguucuccuucgucggcgagagcacgaccaugcgcgagaacaagugcuucgagcagugcgggggcugggggugcggcugcuucaacgugaaccccagcugccuguucgugcacaccuaccuccaguccguccggaaggaggcccugcgcguguucaacugcaucgacugggugcacaagcugacccucgagaucacggacuucgacggcagcgucuccaccaucgaccugggggccagcuccagccgguucaccaacuggggcuccgugagccugucccucgacgcggaggggaucagcggcuccaacagcuucuccuucaucgagagccccgggaagggcuacgccaucguggacgagcccuucuccgagaucccgcgccagggcuuccugggggagauccggugcaacagcgaguccagcguccuguccgcccacgagagcugccuccgcgcccccaaccugaucagcuacaagcccaugaucgaccagcuggagugcuccaccaaccucaucgaccccuucgugguguucaagcggggcagccugccgcagacccgcaacgacaagacguucgccgcguccaaggggaaccggggcguccaggccuucagcaagggguccgugcaggccgaccugacccucauguucgacaacuucgagguggacuucgucggcgccgccgugagcugcgacgcggccuuccugaaccugaccggcugcuacuccugcaacgccggggcccgcgugugccucagcaucaccuccacgggcaccgggacccugagcgcccacaacaaggacggcucccugcacaucguccuccccagcgagaacgggaccaaggaccagugccagauccugcacuucacggugcccgagguggaggaggaguucauguacuccugcgacggcgacgagcggccccugcucguccgcggcacccugaucgcgaucgacccguucgacgaccggcgcgaggccgggggcgagagcaccguggugaaccccaaguccgggagcuggaacuucuucgacugguucuccggccugaugagcugguucggcgggccccucaagaccauccugcugaucugccucuacgucgcccuguccaucggccuguucuuccuccugaucuaccuggggcggacgggccucagcaagauguggcuggccgcgaccaagaaggccagcuga

SEQ ID NO: 12940 - RNA, 3204 nt, Artificial Sequence
  derived and/or modified CDS sequence (opt1) from RVFV(KEN/Kil-006/07)__HM586966.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgccgacggcaacaagugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugccggacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagcccauccagcggguggagccgugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguaccccgggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccgcucauguggaucaccgccuucauccgguggguguacaagaagauggucgcccgcguggccgacaacaucaaccaggugaaccgggagaucggcuggauggagggcgggcagcuggcccuggggaaccccgcccccaucccccgccacgcgccgaucccccgguacuccacguaccucaugcugcugcucaucgucagcuacgccagcgccugcuccgagcugauccaggccagcucccgcaucacgaccugcagcaccgagggcgugaacaccaagugccggcuguccggcaccgcccucauccgcgcggggagcgugggcgccgaggccugccugaugcugaagggggucaaggaggaccagaccaaguuccucaagaucaagaccguguccagcgagcuguccugccgggagggccagagcuacuggacgggcuccuucagccccaagugccuguccagccgccggugccaccuggugggggagugccacgucaaccgcugccucuccuggcgcgacaacgagaccagcgccgaguucuccuucgugggcgagagcaccaccaugcgggagaacaagugcuucgagcagugcgggggcugggggugcggcugcuucaacgugaacccgagcugccuguucguccacacguaccugcaguccgugcgcaaggaggcgcuccggguguucaacugcaucgacuggguccacaagcugacccuggagaucaccgacuucgacggcagcguguccaccaucgaccucggggccagcuccagccgcuucaccaacuggggcuccgugagccugucccuggacgccgaggggaucagcggcuccaacagcuucuccuucaucgagagccccgggaagggcuacgccaucgucgacgagcccuucuccgagaucccccggcagggcuuccucggggagauccgcugcaacagcgaguccagcgugcuguccgcccacgagagcugccugcgggcgccgaaccucgugagcuacaagcccaugaucgaccagcuggagugcacgaccaaccugaucgaccccuucgucguguucgagcgcggcucccucccccagacccggaacgacaagaccuucgccgccagcaaggggaaccgcggcgugcaggccuucuccaaggggagcguccaggccgaccugacgcugauguucgacaacuucgagguggacuucgugggcgcggccgucuccugcgacgccgccuuccucaaccugaccggcugcuacagcugcaacgccggggcgcgggugugccuguccaucaccagcaccggcacggggacccucuccgcccacaacaaggacggcagccugcacaucgugcugccguccgagaacgggaccaaggaccagugccagauccuccacuucaccguccccgagguggaggaggaguucauguacagcugcgacggcgacgagcgcccccugcuggugaagggcacgcucaucgccaucgaccccuucgacgaccggcgcgaggccgggggcgaguccaccgucgugaaccccaagagcggguccuggaacuucuucgacugguucagcggccugauguccugguucggcgggccccugaagaccauccuccugaucugccuguacguggcgcucagcaucggccuguucuuccugcucaucuaccuggggcggaccggccuguccaagauguggcucgccgccacgaagaaggccagcuga

SEQ ID NO: 12941 - RNA, 3204 nt, Artificial Sequence
  derived and/or modified CDS sequence (opt1) from RVFV(MgH824)__DQ380210.1__Gn-Gc
auggccggcaucgccaugaccgugcugcccgcgcucgccgucuucgcccuggccccggugguguucgccgaggacccccaccuccgcaaccggcccgggaagggcuacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcgcaagggccaguacaaggggaccauggacuccggccagaccaagcgggagcucaagagcuucgacaucucccagugccccaagaucgggggccacggcagcaagaagugcacgggggacgcggccuucugcuccgccuacgagugcaccacccaguacgccaacgccuacugcagccacgcgaacggcagcgggguggugcagauccaggucuccggcguguggaagaagccccugugcgugggguacgagcgcgucguggugaagcgggagcugagcgccaagccgauccagcgcgucgagcccugcaccacgugcaucaccaagugcgagccccacggccuggugguccgguccaccggcuucaagaucagcuccgccguggccugcgccagcggggugugcgucaccggcucccagagccccuccacggagaucacccucaaguacccggggaucagccaguccagcggcggggacaucggcgugcacauggcgcacgacgaccaguccgugagcuccaagaucgucgcccacugcccgccccaggaccccugccuggugcacggcugcaucgugugcgcccacgggcugaucaacuaccagugccacaccgcccucagcgcguucgucgugguguucgucuucuccagcaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaaccccgcccccaucccgcggcacgcccccaucccccgcuacuccacguaccucaugcugcugcucaucgugagcuacgccagcgcgugcuccgagcugauccaggccagcucccggaucacgaccugcagcaccgagggcguggacaccaagugccgccuguccggcaccgcccucauccgggccgggagcgucggcgccgaggcgugccugaugcugaagggggugaaggaggaccagaccaaguuccucaagaucaagaccguguccagcgagcuguccugccgcgagggccagagcuacuggacgggcuccuucagcccgaagugccuguccagccggcgcugccaccuggucggggagugccacgugaaccgcugccucuccuggcgggacaacgagaccagcgccgaguucuccuucgugggcgagagcaccaccaugcgcgagaacaagugcuucgagcagugcgggggcugggggugcggcugcuucaacgucaaccccagcugccuguucgugcacacguaccugcaguccgugcggaaggaggcccuccgcgucuucaacugcaucgacugggugcacaagcugacccuggagaucaccgacuucgacggcagcguguccaccaucgaccucggggccagcuccagccgguucaccaacuggggcuccgucagccugucccuggacgcggaggggaucagcggcuccaacagcuucuccuucaucgagagccccgggaagggcuacgccaucguggacgagcccuucccggagaucccccgccagggcuuccucggggagauccggugcaacuccgagagcuccgugcugagcgcccacgaguccugccugcgcgcccccaaccucaucagcuacaagcccaugaucgaccagcuggagugcacgaccaaccugaucgacccguucgucguguucgagcggggcagccucccccagacccgcaacgacaagaccuucgccgcguccaaggggaaccggggcgugcaggccuucagcaagggguccguccaggccgaccugacgcugauguucgacaacuucgagguggacuucgugggcgccgccgucagcugcgacgcggccuuccucaaccugaccggcugcuacuccugcaacgccggggcccgcgugugccugagcaucaccuccaccggcacggggagccucuccgcccacaacaaggacggcagccugcacaucgugcugcccuccgagaacgggaccaaggaccagugccagauccuccacuucaccguccccgagguggaggaggaguucauguacagcugcgacggcgacgagcggccgcugcuggugaagggcacccucaucgcgaucgaccccuucgacgaccgccgggaggccgggggcgaguccacggucgugaaccccaagagcggguccuggaacuucuucgacugguucagcggccugauguccugguucggcgggccccugaagaccauccuccugaucugccuguacguggcccucagcaucggccuguucuuccugcucaucuaccuggggcgcaccggccuguccaagauguggcucgccgcgaccaagaaggccagcuga

SEQ ID NO: 12942 - RNA, 3204 nt, Artificial Sequence
  derived and/or modified CDS sequence (opt1) from RVFV(KEN/Mal-032/07)__HM586967.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggcgccugcaggaggacgcgaccugcaagcccgucacguacgccggcgccugcagcuccuucgacgugcugcuggagaaggggaaguucccccucuuccagagcuacgcccaccaccggacccugcuggaggcggugcacgacaccaucaucgccaaggccgacccgcccuccugcgaccuccagagcgccgacggcaacaagugcaugaaggagaagcuggucaugaagacccacugccccaacgacuaccaguccgcccacuaccugaacaacgacggcaagauggcgagcgugaagugcccgcccaaguacgagcucacggaggacugcaacuucugccgccagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcaccgcccacgaggugguccccuucgccguguucaagaacuccaagaagguguaccuggacaagcuggaccucaagacggaggagaaccugcugccggacagcuucgucugcuucgagcacaagggccaguacaaggggaccauggacuccggccagaccaagcgggagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcgcguggucgugaagcgggagcugagcgccaagcccauccagcgcguggagccgugcacgaccugcaucaccaagugcgagccccacggccucgucgugcgguccaccggcuucaagaucagcuccgccgucgccugcgcgagcggggugugcgugaccggcucccagagccccuccaccgagaucacccugaaguaccccgggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacacggcgcugagcgccuucguggucaucuucguguucuccagcaccgccaucaucugccuggccgugcucuaccgcguccugaagugccugaagaucgccccgcggaaggugcucaacccgcugauguggaucaccgcguucauccgcuggguguacaagaagauggucgcccggguggccgacaacaucaaccaggugaaccgcgagaucggcuggauggagggcgggcagcuggcccucgggaaccccgcccccaucccccggcacgcgccgaucccccgcuacuccaccuaccugaugcugcuccugaucgucagcuacgccagcgccugcuccgagcugauccaggccagcucccggaucacgaccugcagcaccgagggcgugaacaccaagugccgccucuccggcacggcccugauccgggcggggagcgugggcgccgaggccugccugaugcucaagggggucaaggaggaccagaccaaguuccugaagaucaagaccguguccagcgagcuguccugccgcgagggccagagcuacuggaccggcuccuucagccccaagugccuguccagccggcgcugccaccucgugggggagugccacgucaaccgcugccuguccuggcgggacaacgagacgagcgccgaguucuccuucgugggcgagagcaccaccaugcgcgagaacaagugcuucgagcagugcgggggcugggggugcggcugcuucaacgugaacccgagcugccuguucguccacaccuaccuccaguccgugcggaaggaggcgcugcgcguguucaacugcaucgacuggguccacaagcugacgcucgagaucaccgacuucgacggcagcguguccaccaucgaccugggggccagcuccagccgguucaccaacuggggcuccgugagccugucccucgacgccgaggggaucagcggcuccaacagcuucuccuucaucgagagccccgggaagggcuacgccaucgucgacgagcccuucuccgagaucccccgccagggcuuccugggggagauccggugcaacagcgaguccagcgugcuguccgcccacgagagcugccuccgcgcgccgaaccuggugagcuacaagcccaugaucgaccagcuggagugcaccacgaaccucaucgaccccuucgucguguucgagcggggcucccugccccagacccgcaacgacaagaccuucgccgccagcaaggggaaccggggcgugcaggccuucuccaaggggagcguccaggccgaccugacccucauguucgacaacuucgagguggacuucgugggcgcggccgucuccugcgacgccgccuuccugaaccugacgggcugcuacagcugcaacgccggggcgcgcgugugccucuccaucaccagcaccggcaccgggacgcuguccgcccacaacaaggacggcagccugcacaucgugcucccguccgagaacgggaccaaggaccagugccagauccugcacuucaccguccccgagguggaggaggaguucauguacagcugcgacggcgacgagcggccccugcucgugaagggcacccugaucgccaucgaccccuucgacgaccgccgggaggccgggggcgaguccacggucgugaaccccaagagcggguccuggaacuucuucgacugguucagcggccugauguccugguucggcgggccccucaagaccauccugcugaucugccucuacguggcgcugagcaucggccuguucuuccuccugaucuaccuggggcgcaccggccucuccaagauguggcuggccgccaccaagaaggccagcuga

SEQ ID NO: 12943 - RNA, 3204 nt, Artificial Sequence
  derived and/or modified CDS sequence (opt1) from RVFV(Kenya 56 (IB8))__DQ380190.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccagggcgacgcgacgugcaagcccgucaccuacgccggggccugcagcuccuucgacgugcugcuggagaagggcaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaaggacuaccaguccgcccacuaccugaacaacgacgggaagauggcgagcgugaagugcccgcccaaguacgagcugaccgaggacugcaacuucugccggcagaugaccggcgccucccucaagaaggggagcuacccccugcaggaccuguucugccaguccagcgaggacgacggcuccaagcucaagaccaagaugaagggggugugcgaggucggcgugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaaggggcaguacaagggcaccauggacuccgggcagaccaagcgcgagcucaagagcuucgacaucucccagugccccaagaucggcggccacgggagcaagaagugcacgggcgacgcggccuucugcuccgccuacgagugcaccgcccaguacgccaacgcguacugcagccacgccaacgggagcggcaucgugcagauccagguguccggggucuggaagcggccccugugcgugggcuacgagcgcguggucgugaagcgggagcugagcgccaagccgauccagcgcguggagcccugcacgaccugcaucaccaagugcgagccccacggccuggucgugcgguccaccggguucaagaucagcuccgccgucgccugcgcgagcggcgugugcgugaccgggucccagagccccuccaccgagaucacgcucaaguacccgggcaugagccaguccagcgggggcgacaucggcguccacauggcccacgacgaccaguccgugagcuccaagaucguggcccacugcccgccccaggaccccugccugguccacgggugcaucgugugcgcccacggccugaucaacuaccagugccacaccgcgcucagcgccuucguggucguguucguguucuccagcgucgccaucaucugccuggccauccuguacaaggugcucaagugccugaagaucgcgccccgcaaggugcugaacccccucauguggaucaccgccuucauccggugggucuacaagaagaugguggcccgcguggccgacaacaucaaccaggucaaccgggagaucggguggauggagggcgggcagcccgcccugggcaaccccgccccgaucccccgccacgcgcccaucccgcgguacuccaccuaccugaugcuccugcugaucgugagcuacgccagcgccugcuccgagcucauccaggccagcucccgcaucacgaccugcagcaccgagggcgugaacaccaagugccggcuguccgggacggcccugauccgcgcgggcagcgucggggccgaggccugccucaugcugaagggcgugaaggaggaccagaccaaguuccugaagaucaagaccguguccagcgagcucuccugccgggagggccagagcuacuggaccggguccuucagccccaagugccuguccagccgccggugccaccuggucggcgagugccacgugaaccgcugccuguccuggcgcgacaacgagacgagcgccgaguucuccuucgugggggagagcaccaccaugcgggagaacaagugcuucgagcagugcggcggguggggcugcggcugcuucaacgucaaccccagcugccucuucgugcacaccuaccugcaguccgugcgcaaggaggcgcugcgggucuucaacugcaucgacugggugcacaagcucacgcuggagaucaccgacuucgacgggagcguguccaccaucgaccugggcgccagcuccagccgcuucaccaacuggggguccgucagccucucccuggacgccgagggcaucagcggguccaacagcuucuccuucaucgagagccccggcaagggcuacgccaucguggacgagccguucuccgagaucccccggcagggguuccugggcgagauccgcugcaacagcgaguccagcgugcucuccgcccacgagagcugccugcgggcgcccaaccugaucagcuacaagcccaugaucgaccagcucgagugcaccacgaaccugaucgacccguucgucgccuucgagcgcgggucccugccccagacccggaacgacaagaccuucgccgccagcaagggcaaccgcggggugcaggccuucuccaagggcagcgugcaggcggaccucacccugauguucgacaacuucgaggucgacuucgugggcgccgccguguccugcgacgccgccuuccugaaccucacggggugcuacagcugcaacgcgggcgcccgggucugccuguccaucaccagcaccgggaccggcacgcuguccgcccacaacaaggacgggagccuccacaucgugcugcccuccgagaacggcaccaaggaccagugccagauccugcacuucaccgugcccgaggucgaggaggaguucauguacagcugcgacggcgacgagcgcccgcuccuggugaaggggacccugaucgccaucgaccccuucgacgaccggcgcgaggcgggcggggaguccacgguggucaaccccaagagcggcuccuggaacuucuucgacugguucagcggccucauguccugguucgggggcccccugaagaccauccugcucaucugccuguacguggcccugagcaucggccucuucuuccugcugaucuaccucgggcggaccgggcuguccaagauguggcuggccgccaccaagaaggccagcuga

SEQ ID NO: 12944 - RNA, 3204 nt, Artificial Sequence
  derived and/or modified CDS sequence (opt1) from RVFV(KEN/Gar-008/06)__HM586965.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugcccgaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccaggugucccgggucuggaagaagccccugugcgugggcuacgagcgcguggucgugaagcgggagcugagcgccaagccgauccagcgcguggagcccugcacgaccugcaucaccaagugcgagccccacgggcuggucgugcgguccaccggcuucaagaucagcuccgccgucgccugcgcgagcggcgugugcgugaccgggucccagagccccuccaccgagaucacgcucaaguacccgggcaucagccaguccagcgggggcgacaucgggguccacauggcccacgacgaccaguccgugagcuccaagaucguggcccacugcccgccccaggaccccugccugguccacggcugcaucgugugcgcccacggccugaucaacuaccagugccacaccgcgcucagcgccuucguggucaucuucguguucuccagcaccgccaucaucugccuggccgugcuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggguggauggagggcgggcagcuggcccugggcaaccccgcccccaucccgcggcacgcgcccaucccccgcuacuccacguaccucaugcugcugcucaucgucagcuacgccagcgccugcuccgagcugauccaggccagcucccggaucacgaccugcagcaccgagggggugaacaccaagugccgccuguccggcaccgcccucauccgggcgggcagcgugggggccgaggccugccugaugcugaagggcgucaaggaggaccagaccaaguuccucaagaucaagaccguguccagcgagcuguccugccgcgaggggcagagcuacuggacgggcuccuucagcccgaagugccuguccagccggcgcugccaccuggugggcgagugccacgucaaccgcugccucuccuggcgggacaacgagaccagcgccgaguucuccuucgugggggagagcaccaccaugcgcgagaacaagugcuucgagcagugcggcggguggggcugcgggugcuucaacgugaaccccagcugccuguucguccacacguaccugcaguccgugcggaaggaggcgcuccgcguguucaacugcaucgacuggguccacaagcugacccuggagaucaccgacuucgacggcagcguguccaccaucgaccucggcgccagcuccagccgguucaccaacuggggguccgugagccugucccuggacgccgagggcaucagcggguccaacagcuucuccuucaucgagagccccggcaagggguacgccaucgucgacgagcccuucuccgagaucccgcgccagggcuuccucggcgagauccggugcaacagcgaguccagcgugcuguccgcccacgagagcugccugcgcgcgcccaaccucgugagcuacaagcccaugaucgaccagcuggagugcacgaccaaccugaucgaccccuucgucguguucgagcgggggucccucccgcagacccgcaacgacaagaccuucgccgccagcaagggcaaccgcggggugcaggccuucuccaagggcagcguccaggccgaccugacgcugauguucgacaaccucaagguggacuucgugggggcggccgucuccugcgacgccgccuuccugaaccugaccggcugcuacagcugcaacgccggcgcgcgggugugccucuccaucaccagcaccgggacgggcacccuguccgcccacaacaaggacgggagccugcacaucgugcuccccuccgagaacggcaccaaggaccagugccagauccugcacuucaccguccccgaggugaaggaggaguucauguacagcugcgacggggacgagcgggcccugcucaugaagggcacgcugaucgccaucgaccccuucgacgaccgccgggaggcgggcggggaguccaccguggucaaccccaagagcggcuccuggaacuucuucgacugguucagcgggcugauguccugguucggcggcccccucaagaccauccugcugaucugccucuacguggcccugagcaucgggcuguucuuccuccugaucuaccugggccgcaccgggcucuccaagauguggcuggccgccacgaagaaggccagcuga

SEQ ID NO: 12945 - RNA, 3204 nt, Artificial Sequence
  derived and/or modified CDS sequence (opt1) from RVFV(KEN/Bar-035/07)__HM586969.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggcgccugcaggaggacgcgaccugcaagcccgucacguacgccggcgccugcagcuccuucgacgugcugcuggagaaggggaaguucccccucuuccagagcuacgcccaccaccggacccugcuggaggcggugcacgacaccaucaucgccaaggccgacccgcccuccugcgaccuccagagcgccgacggcaacaagugcaugaaggagaagcuggucaugaagacccacugccccaacgacuaccaguccgcccacuaccugaacaacgacggcaagauggcgagcgugaagugcccgcccaaguacgagcucacggaggacugcaacuucugccgccagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcaccgcccacgaggugguccccuucgccguguucaagaacuccaagaagguguaccuggacaagcuggaccucaagacggaggagaaccugcugccggacagcuucgucugcuucgagcacaagggccaguacaaggggaccauggacuccggccagaccaagcgggagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcgcguggucgugaagcgggagcugagcgccaagcccauccagcgcguggagccgugcacgaccugcaucaccaagugcgagccccacggccucgucgugcgguccaccggcuucaagaucagcuccgccgucgccugcgcgagcggggugugcgugaccggcucccagagccccuccaccgagaucacccugaaguaccccgggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacacggcgcugagcgccuucguggucaucuucguguucuccagcaccgccaucaucugccuggccgugcucuaccgcguccugaagugccugaagaucgccccgcggaaggugcucaacccgcugauguggaucaccgcguucauccgcuggguguacaagaagauggucgcccggguggccgacaacaucaaccaggugaaccgcgagaucggcuggauggagggcgggcagcuggcccucgggaaccccgcccccaucccccggcacgcgccgaucccccgcuacuccaccuaccugaugcugcuccugaucgucagcuacgccagcgccugcuccgagcugauccaggccagcucccggaucacgaccugcagcaccgagggcgugaacaccaagugccgccucuccggcacggcccugauccgggcgcgcagcgugggggccgaggccugccugaugcucaagggcgucaaggaggaccagaccaaguuccugaagaucaagaccguguccagcgagcuguccugccgggaggggcagagcuacuggaccggcuccuucagccccaagugccuguccagccgccgcugccaccucgugggcgagugccacgucaaccggugccuguccuggcgcgacaacgagacgagcgccgaguucuccuucgugggggagagcaccaccaugcgggagaacaagugcuucgagcagugcggcggguggggcugcgggugcuucaacgugaacccgagcugccuguucguccacaccuaccuccaguccgugcgcaaggaggcgcugcggguguucaacugcaucgacuggguccacaagcugacgcucgagaucaccgacuucgacggcagcguguccaccaucgaccugggcgccagcuccagccgcuucaccaacuggggguccgugagccugucccucgacgccgagggcaucagcggguccaacagcuucuccuucaucgagagccccggcaagggguacgccaucgucgacgagcccuucuccgagaucccccggcagggcuuccugggcgagauccgcugcaacagcgaguccagcgugcuguccgcccacgagagcugccuccgggcgccgaaccuggugagcuacaagcccaugaucgaccagcuggagugcaccacgaaccucaucgaccccuucgucguguucgagcgcgggucccugccccagacccggaacgacaagaccuucgccgccagcaagggcaaccgcggggugcaggccuucuccaagggcagcguccaggccgaccugacccucauguucgacaacuucgagguggacuucgugggggcggccgucuccugcgacgccgccuuccugaaccugacgggcugcuacagcugcaacgccggcgcgcgggugugccucuccaucaccagcaccgggaccggcacgcuguccgcccacaacaaggacgggagccugcacaucgugcucccguccgagaacggcaccaaggaccagugccagauccugcacuucaccguccccgagguggaggaggaguucauguacagcugcgacggggacgagcgcccccugcucgugaagggcacccugaucgccaucgaccccuucgacgaccggcgcgaggccggcggggaguccacggucgugaaccccaagagcggcuccuggaacuucuucgacugguucagcgggcugauguccugguucggcggcccccucaagaccauccugcugaucugccucuacguggcgcugagcaucgggcuguucuuccuccugaucuaccugggccggaccgggcucuccaagauguggcuggccgccaccaagaaggccagcuga

SEQ ID NO: 12946 - RNA, 3204 nt, Artificial Sequence
  derived and/or modified CDS sequence (opt1) from RVFV(Smithburn)__DQ380193.1__Gn-Gc
auggccggcaucgccaugaccguguuccccgcgcuggucguguucgcccucgccccgguggucuucgccgaggacccccaccuccgcaaccggcccgggaagggccacaacuacaucgacgggaugacccaggaggacgccacgugcaagcccgugaccuacgcgggcgccugcagcuccuucgacgugcugcuggagaaggggaaguucccgcuguuccagagcuacgcccaccaccgcacccugcucgaggccguccacgacaucaucaucgcgaaggccgacccgcccuccugcaaccugcagagcgcccacggcaaccccugcaugaaggagaagcuggugaugaagaccuacugccccaacgacuaccaguccgcccacuaccucaacaacgacggcaagauggccagcgugaagugcccgcccaagcacgagcugacggaggacugcaacuucugccggcagaugaccggggcgucccugaaggagggcagcuacccccuccaggaccuguucugccaguccagcgaggacgacggguccaagcugaagaccaagaugaagggcgucugcgaggugggggugcagguccucaagaagugcgacggccagcugagcaccgcccacgagguggugcccuucgccgucuucaagaacuccaagaagguguaccuggacaagcucgaccugaagacggaggagaaccugcuccccgacagcuucgugugcuucgagcacaagggccaguacaaggggaccauggacuccggccagaucaagcgcgagcucaagagcuucgacaucucccagugccccaagaucgggggccacggcagcaagaagugcaccggggacgccgccuucugcuccgcguacgagugcaccgcccaguacgccaacgccuacugcagccacgccaacggcagcgggaucguccagauccagguguccggcguguggaagaagccccugugcgucggguacgagcgggugguggucaagcgcgagcugagcgcgaagccgauccagcggguggagcccugcacgaccugcaucaccaagugcgagccccacggccuggucgugcgcuccaccggcuucaagaucagcuccgccguggccugcgccagcggggucugcgugacgggcucccagagccccuccaccgagaucacccugaaguacccggggaucagccaguccagcggcggggacaucggcgugcacauggcccacgacgaccaguccgucagcuccaagaucguggcgcacugcccgccccaggaccccugccucgugcacggcugcaucgucugcgcccacgggcugaucaacuaccagugccacaccgccuucagcgccuucgugguggucuucguguucuccagcguggucaucaucugccuggcgauccucuacaaggugcugaagugccugaagaucgcgccccggaaggugcucaacccccugauguggaucacggccuucauccgcugggucuacaagaagaugguggcccggguggccgacaacaucaaccaggucaaccgcgagaucggcuggauggagggcgggcagcuggugcucgggaaccccgcccccaucccgcggcacgcccccaucccccgcuacuccaccuaccugaugcugcuccugaucgugagcuacgccagcgccugcuccgagcugauccaggccagcucccggaucacgaccugcagcaccgagggcgucaacaccaagugccgccucuccggcaccgcgcugauccgggccgggagcgugggcgccgaggccugccugaugcucaagggggugaaggaggaccagaccaaguuccugaagaucaagacggucuccagcgagcuguccugccgcgagggccagagcuacuggaccggcuccuucagcccgaagugccucuccagccggcgcugccaccuggugggggagugccacgugaaccggugccuguccuggcgcgacaacgagaccagcgccgaguucuccuucgucggcgagagcaccacgaugcgcgagaacaagugcuucgagcagugcgggggcugggggugcggcugcuucaacgugaaccccagcugccuguucgugcacaccuaccuccaguccguccggaaggaggcgcugcgcguguucaacugcaucgacugggugcacaagcugacccucgagaucaccgacuucgacggcagcgucuccacgguggaccugggggccagcuccagccgguucaccaacuggggcuccgugagccugucccucgacgccgaggggaucagcggcuccaacagcuucuccuucaucgagagccccgggaagggcuacgccaucgucgacgagcccuucuccgagaucccgcgccagggcuuccugggggagauccggugcaacagcgaguccagcgugcuguccgcgcacgagagcugccuccgcgcccccaaccugaucagcuacaagcccaugaucgaccagcuggagugcaccaccaaccucaucgaccccuucguggucuucgagcggggcucccugccgcagacccgcaacgacaagacguucgccgccagcaaggggaaccggggcgugcaggccuucuccaaggggagcgugcaggcggaccugacccucauguucgacaacuucgaggucgacuucgugggcgccgccguguccugcgacgccgccuuccugaaccugaccggcugcuacagcugcaacgcgggggcccgcgucugccucuccaucaccagcacgggcaccgggacccuguccgcccacaacaaggacggcagccugcacaucgugcuccccuccgagaacgggaccaaggaccagugccagauccugcacuucacggugcccgaggucgaggaggaguucauguacagcugcgacggcgacgagcggccccugcucgugaagggcacccugaucgccaucgacccguucgacgaccgccgggaggccgggggcgaguccaccgucgugaaccccaagagcggguccuggaacuucuucgacugguucagcggccugauguccugguucggcgggccccucaagaccauccugcugaucugccucuacguggcgcugagcaucggccuguucuucuuccucaucuaccuggggcgcacgggccuguccaagauguggcucgccgccaccaagaaggccagcuga

SEQ ID NO: 12947 - RNA, 3204 nt, Artificial Sequence
  derived and/or modified CDS sequence (opt1) from RVFV(Beijing-01)__KX611606.1__Gn-Gc
auggccggcaucgccaugaccgugcugcccgcgcucgccgucuucgcccuggccccggugguguucgccgaggacccccaccuccgcaaccggcccgggaagggccacaacuacaucgacggggucacccaggaggacgcgacgugcaagcccgugaccuacgccggcgccugcagcuccuucgacgugcugcuggagaaggggaaguucccgcuguuccagagcuacgcccaccaccgcacccuccuggaggcgguccacgacaccaucaucgccaaggccgacccgcccuccugcgaccugcagagcgcccacggcaaccccugcaugaaggagaagcucgugaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgucugcgaggugggggugcaggcccugaagaagugcgacggccgccugagcacggcccacgaggucgugcccuucgccguguucaagaacuccaagaaggucuaccucgacaagcuggaccugaagaccgaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccaggucuccggcguguggaagaagccccugugcgugggguacgagcgcgucguggugaagcgggagcugagcgccaagccgauccagcgcgucgagcccugcacgaccugcaucaccaagugcgagccccacggccuggugguccgguccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucuucgacugcccgccccaggaccccugccuggugcacggcugcaucgugugcgcccacgggcugaucaacuaccagugccacaccgcccucagcgcguucgucgugguguucgucuucuccagcguggccaucaucugccuggccauccuguacaaggugcuccgcugccugaagaucgcccccaagaagguccugaacccccucauguggaucaccgccuucauccgguggguguacaagaagaugguggcgcgcgucgccgacaacaucaaccaggugaaccgggagaucggcuggauggagggcgggcagcuggcccuggggaaccccgcccccaucccgcgccacgcccccaucccccgguacuccaccuaccucaugcugcugcucaucaucagcuacgcgagcgccugcuccgagcugauccaggccagcucccgcaucacgaccugcagcaccgagggcgugaacaccaagugccggcuguccggcacggcccucauccgcgccgggagcgucggcgcggaggccugccugauguucgagggggugaaggaggaccagaccaaguuccugaagaucaagaccguguccagcgagcucuccugccgggagggccagagcuacuggaccggcuccuucagcccgaagugccuguccagccgccggugccaccuggucggggagugccacgugaaccgcugccuguccuggcgcgacaacgagacgagcgccgaguucuccuucgugggcgagagcaccaccaugcgggagaacaagugcuucgagcagugcgggggcugggggugcggcugcuucaacgucaaccccagcugccucuucgugcacaccuaccugcaguccgugcgcaaggaggcccugcgggucuucaacugcaucgacugggugcacaagcucacgcuggagaucaccgacuucgacggcagcguguccaccaucgaccugggggcgagcuccagccgcuucaccaacuggggcuccgucagccucucccuggacgccgaggggaucagcggcuccaacagcuucuccuucaucgagagccccgggaagggcuacgccaucguggacgagcccuucuccgagaucccgcggcagggcuuccugggggagauccgcugcaacagcgaguccagcgugcucuccgcccacgagagcugccugcgggcccccaaccugaucagcuacaagcccaugaucgaccagcucgagugcaccacgaaccugaucgaccccuucgucguguucgagcgcggcucccugccgcagacccggaacgacaagaccuucgcggccagcaaggggaaccgcggcgugcaggccuucuccaaggggagcguccaggccgaccucacccugauguucgacaacuucgagguggacuucgugggcgccgcggucuccugcgacgccgccuuccugaaccucacgggcugcuacagcugcaacgccggggcccgggugugccuguccaucaccagcaccggcaccgggacgcuguccgcgcacaacaaggacggcagccuccacaucgugcugcccuccgagaacgggaccaaggaccagugccagauccugcacuucaccguccccgagguggaggaggaguucauguacagcugcgacggcgacgagcgcccccuccuggugaagggcacccugaucgccaucgacccguucgacgaccggcgcgaggccgggggcgaguccacggucgugaaccccaagagcggguccuggaacuucuucgacugguucagcggccucauguccugguucggcgggccccugaagaccauccugcucaucugccuguacguggcccugagcaucggccucuucuuccugcugaucuaccucgggcggaccggccuguccaagauguggcuggcggccaccaagaaggccagcuga

SEQ ID NO: 12948 - RNA, 3204 nt, Artificial Sequence
  derived and/or modified CDS sequence (opt1) from RVFV(KEN/Bar-032/07)__HM586968.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggcgccugcaggaggacgcgaccugcaagcccgucacguacgccggcgccugcagcuccuucgacgugcugcuggagaaggggaaguucccccucuuccagagcuacgcccaccaccggacccugcuggaggcggugcacgacaccaucaucgccaaggccgacccgcccuccugcgaccuccagagcgccgacggcaacaagugcaugaaggagaagcuggucaugaagacccacugccccaacgacuaccaguccgcccacuaccugaacaacgacggcaagauggcgagcgugaagugcccgcccaaguacgagcucacggaggacugcaacuucugccgccagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcaccgcccacgaggugguccccuucgccguguucaagaacuccaagaagguguaccuggacaagcuggaccucaagacggaggagaaccugcugccggacagcuucgucugcuucgagcacaagggccaguacaaggggaccauggacuccggccagaccaagcgggagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcgcguggucgugaagcgggagcugagcgccaagcccauccagcgcguggagccgugcacgaccugcaucaccaagugcgagccccacggccucgucgugcgguccaccggcuucaagaucagcuccgccgucgccugcgcgagcggggugugcgugaccggcucccagagccccuccaccgagaucacccugaaguaccccgggaucagccaguccagcgucggcgacaucggggugcacauggcccacgacgaccaguccgugagcuccaagaucgucgcccacugcccgccccaggaccccugccuggugcacggcugcaucgugugcgcccacggccucaucaacuaccagugccacacggcgcugagcgccuucgucgugaucuucguguucuccagcaccgccaucaucugccuggccguccucuaccgcgugcugaagugccugaagaucgccccgcggaaggugcucaacccgcugauguggaucaccgcguucauccgcugggucuacaagaagaugguggcccggguggccgacaacaucaaccaggucaaccgcgagaucggguggauggagggcgggcagcuggcccucggcaaccccgcccccaucccccggcacgcgccgaucccccgcuacuccaccuaccugaugcugcuccugaucgugagcuacgccagcgccugcuccgagcugauccaggccagcucccggaucacgaccugcagcaccgagggggugaacaccaagugccgccucucccacacggcccugauccgggcgggcagcgucggcgccgaggccugccugaugcucaagggggugaaggaggaccagaccaaguuccugaagaucaagaccguguccagcgagcuguccugccgcgagggccagagcuacuggaccggguccuucagccccaagugccuguccagccggcgcugccaccucgucggcgagugccacgugaaccgcugccuguccuggcgggacaacgagacgagcgccgaguucuccuucgugggcgagagcaccaccaugcgcgagaacaagugcuucgagcagugcgggggcugggggugcggcugcuucaacgucaacccgagcugccuguucgugcacaccuaccuccaguccgugcggaaggaggcgcugcgcgucuucaacugcaucgacugggugcacaagcugacgcucgagaucaccgacuucgacgggagcguguccaccaucgaccugggcgccagcuccagccgguucaccaacuggggcuccgucagccugucccucgacgccgaggggaucagcggcuccaacagcuucuccuucaucgagagccccgggaagggcuacgccaucguggacgagcccuucuccgagaucccccgccagggguuccugggcgagauccggugcaacagcgaguccagcgugcuguccgcccacgagagcugccuccgcgcgccgaaccuggucagcuacaagcccaugaucgaccagcuggagugcaccacgaaccucaucgaccccuucgugguguucgagcggggcucccugccccagacccgcaacgacaagaccuucgccgccagcaaggggaaccggggcguccaggccuucuccaaggggagcgugcaggccgaccugacccuccgcuucgacaacuucgagguggacuucgucggcgcggccguguccugcgacgccgccuuccugaaccugacggggugcuacagcugcaacgccggcgcgcgggugugccucuccaucaccagcaccggcaccgggacgcuguccgcccacaacaaggacggcagccugcacaucguccucccguccgagaacgggaccaaggaccagugccagauccugcacuucaccgugcccgagguggaggaggaguucauguacagcugcgacggcgacgagcgcccccugcucgucaaggggacccugaucgccaucgaccccuucgacgaccggcgcgaggccggcggcgaguccacgguggugaaccccaagagcggguccuggaacuucuucgacugguucagcggccugauguccugguucgggggcccccucaagaccauccugcugaucugccucuacgucgcgcugagcaucggccuguucuuccuccugaucuaccuggggcggaccggccucuccaagauguggcuggccgccaccaagaaggccagcuga

SEQ ID NO: 12949 - RNA, 3204 nt, Artificial Sequence
  derived and/or modified CDS sequence (opt1) from RVFV(TAN/Dod-002/07)__HM586971.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcuccuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggccggaagaagugcacgggggacgcggccuucugcagcgccuacgagugcaccgcccaguacgccaacgcguacugcucccacgccaacggcagcgggaucgugcagauccaggugagcggcgucuggaagaagccccugugcgugggguacgagcgcguggucgugaagcgggagcuguccgccaagccgauccagcgcguggagcccugcacgaccugcaucaccaagugcgagccccacggccuggucgugcggagcaccggcuucaagaucuccagcgccgucgccugcgcguccggggugugcgugaccggcagccagucccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccaggcguggaucaucucccaguggcacaccgcccugagcgccuucguggucaucuucguguucuccagcaccgccaucaucugccucgccgugcuguaccgcguccugaagugccucaagaucgcgccccggaaggugcugaacccccugauguggaucaccgccuucauccgcuggguguacaagaagauggucgcccggguggccgacaacaucaaccaggugaaccgcgagaucggguggauggagggcgggcagcucgcccugggcaaccccgcgcccaucccgcggcacgcccccaucccccgcuacuccacguaccugaugcuccugcugaucgucagcuacgccagcgccugcuccgagcucauccaggccagcucccggaucacgaccugcagcaccgagggggugaacaccaagugccgccuguccggcaccgcgcugauccgggccggcagcgugggggccgaggccugccucaugcugaagggcgucaaggaggaccagaccaaguuccugaagaucaagaccguguccagcgagcucuccugccgcgaggggcagagcuacuggacgggcuccuucagcccgaagugccuguccagccggcgcugccaccuggugggcgagugccacgucaaccgcugccuguccuggcgggacaacgagaccagcgcggaguucuccuucgugggggagagcaccaccaugcgcgagaacaagugcuucgagcagugcggcggguggggcugcgggugcuucaacgugaaccccagcugccucuucguccacacguaccugcaguccgugcggaaggaggcccugcgcguguucaacugcaucgacuggguccacaagcucacccuggagaucaccgacuucgacggcagcguguccaccaucgaccugggcgccagcuccagccgguucaccaacuggggguccgugagccucucccuggacgccgagggcaucagcggguccaacagcuucuccuucaucgagagccccggcaagggguacgccaucgucgacgagcccuucuccgagaucccgcgccagggcuuccugggcgagauccggugcaacagcgaguccagcgugcucuccgcgcacgagagcugccugcgcgcccccaaccuggugagcuacaagcccaugaucgaccagcucgagugcacgaccaaccugaucgaccccuucgucguguucgagcgggggucccugccgcagacccgcaacgacaagaccuucgccgccagcaagggcaaccgcggggugcaggccuucuccaagggcagcguccaggcggaccucacgcugauguucgacaacuucgagguggacuucgugggggccgccgucuccugcgacgccgccuuccugaaccucaccggcugcuacagcugcaacgcgggcgcccgggugugccuguccaucaccagcaccgggacgggcacccuguccgcccacaacaaggacgggagccuccacaucgugcugcccuccgagaacggcaccaaggaccagugccagauccugcacuucaccguccccgagguggaggaggaguucauguacagcugcgacggggacgagcggccccuccuggugaagggcacgcugaucgccaucgacccguucgacgaccgccgggaggcgggcggggaguccaccgucgugaaccccaagagcggcuccuggaacuucuucgacugguucagcgggcucauguccugguucggcggcccccugaagaccauccugcucaucugccuguacguggcccugagcaucgggcuguucuuccugcugaucuaccucggccgcaccgggcuguccaagauguggcuggccgccacgaagaaggccagcuga

SEQ ID NO: 12950 - RNA, 3204 nt, Artificial Sequence
  derived and/or modified CDS sequence (opt1) from RVFV(KEN/Gar-004/06)__HM586964.1__Gn-Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacucccagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggccggaagaagcgcacgggggacgcggccuucugcagcgccuacgagugcaccgcccaguacgccaacgcguacugcucccgggccaacggcagcgggaucgugcagauccaggugagccgcgucuggaagaagccccugugcgugggcuacgagcggguggucgugaagcgcgagcuguccgccaagccgauccagcggguggagcccugcacgaccugcaucaccaagugcgagccccacgggcuggucgugcgcagcaccggcuucaagaucuccagcgccgucgccugcgcguccggcgugugcgugaccgggagccagucccccagcaccgagaucacgcucaaguacccgggcaucucccagagcuccgggggcgacaucgggguccacauggcccacgacgaccagagcguguccagcaagaucguggcccacugcccgccccaggaccccugccugguccacggcugcaucgugugcgcccacggccugaucaacaaccagucccacagcgcgcucuccgccuucguggucaucuucguguucagcuccaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggguggauggagggcgggcagcuggcccugggcaaccccgcccccaucccgcgccacgcgcccaucccccgguacagcaccuaccucaugcugcugcucaucgucagcuacgccuccgccugcagcgagcugauccaggccuccagccgcaucacgaccugcuccaccgagggggugaacaccaagugccggcugagcggcacggcccucauccgcgcgggcuccgugggggccgaggccugccugaugcugaagggcgucaaggaggaccagaccaaguuccucaagaucaagaccgugagcuccgagcugagcugccgcgaggggcaguccuacuggaccggcagcuucuccccgaagugccugagcucccggcgcugccaccuggugggcgagugccacgucaaccggugccucagcuggcgcgacaacgagacguccgccgaguucagcuucgugggggagagcaccaccaugcgggagaacaagugcuucgagcagugcggcggguggggcugcgggugcuucaacgugaaccccuccugccuguucguccacaccuaccugcagagcgugcgcaaggaggcgcuccggguguucaacugcaucgacuggguccacaagcugacgcuggagaucaccgacuucgacggcuccgugagcaccaucgaccucggcgccuccagcucccgcuucaccaacugggggagcgugucccugagccuggacgccgagggcaucuccgggagcaacuccuucagcuucaucgagucccccggcaagggguacgccaucgucgacgagcccuucagcgagaucccgcggcagggcuuccucggcgagauccgcugcaacuccgagagcuccgugcugagcgcccacgagagcugccugcgggcgcccaaccucguguccuacaagcccaugaucgaccagcuggagugcaccacgaaccugaucgaccccuucgucguguucgagcgcgggagccucccgcagacccggaacgacaagaccuucgccgccuccaagggcaaccgcggggugcaggccuucagcaagggcuccguccaggccgaccugacccugcgguucgacaacuucgagguggacuucgugggggcggccgucagcugcgacgccgccuuccucaaccugacgggcugcuacuccugcaacgccggcgcgcgcgugugccugagcaucaccuccaccgggaccggcacgcucagcgcccacaacaaggacgggucccugcacaucgugcugcccagcgagaacggcaccaaggaccagugccagauccuccacuucaccguccccgagguggaggaggaguucauguacuccugcgacggggacgagcggccccugcuggugaagggcacccucaucgccaucgacccguucgacgaccgccgggaggccggcggggagagcacggucgugaaccccaaguccggcagcuggaacuucuucgacugguucuccgggcugaugagcugguucggcggcccccugaagaccauccuccugaucugccuguacguggcgcucuccaucgggcuguucuuccugcucaucuaccugggccgcaccgggcugagcaagauguggcucgccgccaccaagaaggccagcuga

SEQ ID NO: 12951 - RNA, 1680 nt, Artificial Sequence
  derived and/or modified CDS sequence (opt1) from RVFV(ZH-548)__DQ380206.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgccgacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgcc

SEQ ID NO: 12952 - RNA, 1680 nt, Artificial Sequence
  derived and/or modified CDS sequence (opt1) from RVFV(MP-12)__DQ380208.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccaccaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgccgacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgcc

SEQ ID NO: 12953 - RNA, 1680 nt, Artificial Sequence
  derived and/or modified CDS sequence (opt1) from RVFV(MP12)__Z30318.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccaccaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgcccacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgcc

SEQ ID NO: 12954 - RNA, 1680 nt, Artificial Sequence
  derived and/or modified CDS sequence (opt1) from RVFV(2007001811)__EU574040.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgcc

SEQ ID NO: 12955 - RNA, 1680 nt, Artificial Sequence
  derived and/or modified CDS sequence (opt1) from RVFV(2250/74)__DQ380209.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggaucuacaagaagaugguggcccgcgucgccgacaacaucaaccaggugaaccgggagaucggcuggauggagggcgggcagcuggugcuggggaaccccgcccccaucccgcgccacgcccccaucccccgguacuccaccuaccucaugcugcugcucaucgucagcuacgcgagcgcc

SEQ ID NO: 12956 - RNA, 1680 nt, Artificial Sequence
  derived and/or modified CDS sequence (opt1) from RVFV(T1)__DQ380201.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccguccuguaccgggugcucaagugccugaagaucgcgccccgcaaggugcugaacccccucauguggaucaccgccuucauccgguggaucuacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgcc

SEQ ID NO: 12957 - RNA, 1680 nt, Artificial Sequence
  derived and/or modified CDS sequence (opt1) from RVFV(Ken 199800523)__KU978777.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguucugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgcc

SEQ ID NO: 12958 - RNA, 1680 nt, Artificial Sequence
  derived and/or modified CDS sequence (opt1) from RVFV(1853/78)__DQ380220.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcaucgccaucaucugccuggccauccuguaccgggugcucaagugccugaagaucgcgccccgcaaggugcugaacccccucauguggaucaccgccuucauccggugggucuacaagaagaugguggcccgcguggccgacaacaucaaccaggucaaccgggagaucggcuggauggagggcgggcagcuggugcuggggaaccccgcccccaucccgcgccacgcccccaucccccgguacuccaccuaccucaugcugcugcucaucgugagcuacgcgagcgcc

SEQ ID NO: 12959 - RNA, 1680 nt, Artificial Sequence
  derived and/or modified CDS sequence (opt1) from RVFV(73HB1449)__DQ380211.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagaaccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacagcaccuaccucaugcugcugcucaucguguccuacgcgagcgcc

SEQ ID NO: 12960 - RNA, 1680 nt, Artificial Sequence
  derived and/or modified CDS sequence (opt1) from RVFV(2007000234)__JF326191.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccacguaccucaugcugcugcucaucgucagcuacgccagcgcc

SEQ ID NO: 12961 - RNA, 1680 nt, Artificial Sequence
  derived and/or modified CDS sequence (opt1) from RVFV(73HB1230)__DQ380221.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagaaggagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcgcguggucgugaagcgggagcugagcgccaagccgauccagcgcguggagcccugcacgaccugcaucaccaagugcgagccccacggccuggucgugcgguccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggcuggauggagggcgggcagcugguccuggggaaccccgcccccaucccgcggcacgcccccaucccccgcuacuccaccuaccucaugcugcugcucaucgugagcuacgcgagcgcc

SEQ ID NO: 12962 - RNA, 1680 nt, Artificial Sequence
  derived and/or modified CDS sequence (opt1) from RVFV(ZM-657)__DQ380204.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaaggcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggaucuacaagaagaugguggcccgcgucgccgacaacaucaaccaggugaaccgggagaucggcuggauggagggcgggcagcuggugcuggggaaccccgcccccaucccgcgccacgcccccaucccccgguacuccaccuaccucaugcugcugcucaucgucagcuacgcgagcgcc

SEQ ID NO: 12963 - RNA, 1680 nt, Artificial Sequence
  derived and/or modified CDS sequence (opt1) from RVFV(Kenya 83 (21445))__DQ380198.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccaccuaccucaugcugcugcucaucgucagcuacgccagcgcc

SEQ ID NO: 12964 - RNA, 1680 nt, Artificial Sequence
  derived and/or modified CDS sequence (opt1) from RVFV(SAUDI 200010901)__KU978778.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguucugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucaucagcuacgcgagcgcc

SEQ ID NO: 12965 - RNA, 1680 nt, Artificial Sequence
  derived and/or modified CDS sequence (opt1) from RVFV(2007004194)__EU574031.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugagcaacgacggcaagauggcguccgugaagugcccgcccaaguacgagcugaccgaggacugcaacuucugccggcagaugaccggggccagccucaagaagggcuccuacccccugcaggaccuguucugccagagcuccgaggacgacgggagcaagcucaagaccaagaugaagggcgugugcgaggucggggugcaggcccugaagaagugcgacggccagcuguccacggcccacgaggugguccccuucgccguguucaagaacagcaagaagguguaccucgacaagcuggaccugaagaccgaggagaaccuccugcccgacuccuucgucugcuucgagcacaagggccaguacaaggggaccauggacagcggccagaccaagcgcgagcugaaguccuucgacaucagccagugccccaagaucgggggccacggcuccaagaagugcacgggggacgcggccuucugcagcgccuacgagugcaccgcccaguacgccaacgcguacugcagccacgccaacggcuccgggaucgugcagauccaggugagcggcgucuggaagaagccccucugcgugggguacgagcggguggucgugaagcgcgagcuguccgccaagccgauccagcggguggagcccugcacgaccugcaucaccaagugcgagccccacggccuggucgugcgcagcaccggcuucaagaucuccagcgccgucgccugcgcguccggggugugcgugaccggcagccagucccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacagcaccuaccucaugcugcugcucaucgugagcuacgcguccgcc

SEQ ID NO: 12966 - RNA, 1680 nt, Artificial Sequence
  derived and/or modified CDS sequence (opt1) from RVFV(ZH-501-777)__DQ380202.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggaccccggccagaccaagcgcgagcugaaguccuucgacaucagccagugccccaagaucgggggccacggcuccaagaagugcacgggggacgcggccuucugcagcgccuacgagugcaccgcccaguacgccaacgcguacugcucccacgccaacggcagcgggaucgugcagauccaggugagcggcgucuggaagaagccgcucugcgugggguacgagcggguggucgugaagcgcgagcuguccgccaagcccauccagcggguggagcccugcacgaccugcaucaccaagugcgagccccacggccuggucgugcgcagcaccggcuucaagaucuccagcgccgucgccugcgcguccggggugugcgugaccggcagccaguccccgagcaccgagaucacgcucaaguaccccgggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccguccuguaccgggugcucaagugccugaagaucgcgccccgcaaggugcugaacccccucauguggaucaccgccuucauccgguggaucuacaagaagauggucgcccgcguggccgacaacaucaaccaggugaaccgggagaucggcuggauggagggcgggcagcugguccuggggaaccccgccccgaucccccgccacgcccccaucccgcgguacagcaccuaccucaugcugcugcucaucguguccuacgcgagcgcc

SEQ ID NO: 12967 - RNA, 1680 nt, Artificial Sequence
  derived and/or modified CDS sequence (opt1) from RVFV(ZC-3349)__DQ380207.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaggccguguccagcaagaucguggcccacugcccgccccaggaccccugccugguccacggcugcaucgugugcgcgcacgggcugaucaacuaccagugccacaccgcccucuccgccuucguggucguguucguguucagcuccaucgccaucaucugccuggccauccuguaccggguccucaagugccugaagaucgcgccccgcaaggugcugaacccccucauguggaucaccgccuucauccgguggaucuacaagaagaugguggcccgcgucgccgacaacaucaaccacgugaaccgggagaucggcuggauggagggcgggcagcuggugcuggggaaccccgcccccaucccgcgccacgcgcccaucccccgguacagcaccuaccucaugcugcugcucaucgucuccuacgccagcgcc

SEQ ID NO: 12968 - RNA, 1680 nt, Artificial Sequence
  derived and/or modified CDS sequence (opt1) from RVFV(200803166)__JF311381.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcugaagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgacggcc

SEQ ID NO: 12969 - RNA, 1680 nt, Artificial Sequence
  derived and/or modified CDS sequence (opt1) from RVFV(1260/78)__DQ380214.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccugcaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgcc

SEQ ID NO: 12970 - RNA, 1680 nt, Artificial Sequence
  derived and/or modified CDS sequence (opt1) from RVFV(T-46 (228113))__DQ380199.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccaaggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccguccuguaccgggugcucaagugccugaagaucgcgccccgcaaggugcugaacccccucauguggaucaccgccuucauccgguggaucuacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgcc

SEQ ID NO: 12971 - RNA, 1680 nt, Artificial Sequence
  derived and/or modified CDS sequence (opt1) from RVFV(ZINGA J83 R1)__KU978776.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcucaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggguguaccgcaagauggucgcccggguggccgacaacaucaaccaggugaaccgcgagaucggcuggauggagggcgggcagcugguccucgggaaccccgcccccaucccgcggcacgugcccaucccccgcuacuccaccuaccugaugcugcuccugaucgugagcuacgccagcgcg

SEQ ID NO: 12972 - RNA, 1680 nt, Artificial Sequence
  derived and/or modified CDS sequence (opt1) from RVFV(clone 13)__DQ380213.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaagcacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagaaccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccacgggcugaucaacuaccagugccacaccgcgcucuccgccuucguggucguguucguguucagcuccaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacagcaccuaccucaugcugcugcucaucguguccuacgcgagcgcc

SEQ ID NO: 12973 - RNA, 1680 nt, Artificial Sequence
  derived and/or modified CDS sequence (opt1) from RVFV(SA01-1322)__KX096942.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguucugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccugggggaccccgcccccaucccgcgccacgcccccaucccccgguacuccaccuaccucaugcugcugcucaucaucagcuacgcgagcgcc

SEQ ID NO: 12974 - RNA, 1680 nt, Artificial Sequence
  derived and/or modified CDS sequence (opt1) from RVFV(25010-24)__KM210509.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccugaucguccgcuccaccggcuucaagaucagcuccgccguggccugcgcgagcggggucugcgugaccggcucccagagccccuccaccgagaucacgcucaaguacccggggaucagccaguccagcggcggggacaucggcgugcacauggcccacgacgaccaguccgucagcuccaagaucguggcccacugcccgccccaggaccccugccuggugcacggcugcaucgucugcgcccacgggcugaucaacuaccagugccacaccgcgcucagcgccuucgugguggucuucguguucuccagcguggccaucaucugccuggccauccuguacaagguccucaagugccugaagaucgcccccaagaaggugcugaacccccucauguggaucaccgcguucauccgguggguguacaagaagauggucgcccgcguggccgacaacaucaaccaggugaaccgggagaucggcuggauggagggcgggcagcuggcccuggggaaccccgcccccaucccgcgccacgcgcccaucccccgguacuccaccuaccucaugcugcugcucaucgucagcuacgccagcgcc

SEQ ID NO: 12975 - RNA, 1680 nt, Artificial Sequence
  derived and/or modified CDS sequence (opt1) from RVFV(200803162)__JF311377.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucgccaagugcgagccccacggccuggucgugcgcuccaccggcuucaagaucagcuccgccgucgcgugcgccagcggggugugcgugaccggcucccagagccccuccaccgagaucacccucaaguacccggggaucagccaguccagcggcggggacaucggcguccacauggcccacgacgaccaguccgugagcuccaagaucguggcccacugcccgccccaggaccccugccugguccacgacugcaucgugugcgcgcacggccugaucaacuaccagugccacacggcccucagcgccuucguggucaucuucguguucuccagcaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggguggauggagggcgggcagcuggcccugcgcaaccccgcgcccaucccgcggcacgcccccaucccccgcuacuccaccuaccucaugcugcugcucaucgucagcuacgccagcgcc

SEQ ID NO: 12976 - RNA, 1680 nt, Artificial Sequence
  derived and/or modified CDS sequence (opt1) from RVFV(2007002476)__EU574036.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccccucauguggaucaccgccuucaucaaguggguguacaagaagauggucgcccggguggccgacaacaucaaccaggugaaccgcgagaucggcuggauggagggcgggcagcuggcccuggggaaccccgcccccaucccgcggcacgcgcccaucccccgcuacuccacguaccucaugcugcugcucaucgucagcuacgccagcgcc

SEQ ID NO: 12977 - RNA, 1680 nt, Artificial Sequence
  derived and/or modified CDS sequence (opt1) from RVFV(Hv-B375)__DQ380218.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaagaacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcaucgccaucaucugccuggccauccuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggcuggauggagggcgggcagcugguccuggggaaccccgcccccaucccgcgccacgcccccaucccccgguacuccaccuaccucaugcugcugcucaucgugagcuacgcgagcgcc

SEQ ID NO: 12978 - RNA, 1680 nt, Artificial Sequence
  derived and/or modified CDS sequence (opt1) from RVFV(OS-1)__DQ380186.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccugaacccccucauguggaucaccgccuucauccgcuggguguacaagaagaugguggcccgggucgccgacaacaucaaccaggugaaccgcgagaucggcuggauggagggcgggcagcuggcccuggggaaccccgcccccaucccgcggcacgcgcccaucccccgcuacuccaccuaccucaugcugcugcucaucgugagcuacgccagcgcc

SEQ ID NO: 12979 - RNA, 1680 nt, Artificial Sequence
  derived and/or modified CDS sequence (opt1) from RVFV(2373/74)__DQ380194.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaugguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucgugagcuacgccagcgcc

SEQ ID NO: 12980 - RNA, 1680 nt, Artificial Sequence
  derived and/or modified CDS sequence (opt1) from RVFV(Kenya 57 (Rintoul))__DQ380192.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaucaagcgcgagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacccucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacacggcgcucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggcuggauggagggcgggcagcuggugcuggggaaccccgcccccaucccgcggcacgcccccaucccccgcuacuccaccuaccucaugcugcugcucaucgugagcuacgcgagcgcc

SEQ ID NO: 12981 - RNA, 1680 nt, Artificial Sequence
  derived and/or modified CDS sequence (opt1) from RVFV(Sudan 2V-2007)__JQ820490.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugcagcguccacggcugcaucgugugcgcccacgggcugaucaacuaccagugccacaccgcgcuguccgccuucguggucguguucguguucagcuccaucgccaucaucugccucgccauccuguaccggguccugaagugccucaagaucgcgccccgcaaggugcugaacccccugauguggaucaccgccuucauccgguggguguacaagaagauggucgcccgcguggccgacaacaucaaccaggugaaccgggagaucggcuggauggagggcgggcagcucguccuggggaaccccgcccccaucccgcgccacgcccccaucccccgguacagcaccuaccugaugcuccugcugaucgugagccacgcguccgcc

SEQ ID NO: 12982 - RNA, 1680 nt, Artificial Sequence
  derived and/or modified CDS sequence (opt1) from RVFV(200803167)__JF311382.1__Gn
auggccggcaucgccaugaccgugcugcccgcgcucgccgucuucgcccuggccccggugguguucgccgaggaccugcaccuccgcaaccggcccgggaagggccacaacuacaucgacgggaugacccaggaggacgcgacgugcaagcccgucaccuacgccggcgccugcagcuccuucgacgugcugcuggagaaggggaaguucccccucuuccagagcuacgcccaccaccgcacccugcuggaggcggugcacgacaccaucaucgccaaggccgacccgcccuccugcgaccuccagagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugccggacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagcccauccagcggguggagccgugcacgaccugcaucaccaagugcgagccccacggccucgucgugcgcuccaccggcuucaagaucagcuccgccgucgccugcgcgagcggggugugcgugaccggcucccagagccccuccaccgagaucgcccugaaguaccccgggaucagccaguccagcggcggggacaucggcguccacauggcccacgacgaccaguccgugagcuccaagaucguggcccacugcccgccccaggaccccugccugguccacggcugcaucgugugcgcgcacgggcucaucaacuaccagugccacacggcccugagcgccuucguggucguguucguguucuccagcaucgccaucaucugccuggccauccucuaccggguccugaagugccugaagaucgcgccccgcaaggugcucaacccgcugauguggaucaccgccuucauccgguggguguacaagaagauggucgcccgcguggccgacaacaucaaccaggugaaccgggagaucggcuggauggagggcgggcagcugguccucgggaaccccgcccccaucccccgccacgcgccgaucccccgguacuccaccuaccugaugcugcuccugaucgugagcuacgccagcgcc

SEQ ID NO: 12983 - RNA, 1680 nt, Artificial Sequence
  derived and/or modified CDS sequence (opt1) from RVFV(KEN/Gar-008/06)__HM586965.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccaggugucccgggucuggaagaagccccugugcgugggcuacgagcgcguggucgugaagcgggagcugagcgccaagccgauccagcgcguggagcccugcacgaccugcaucaccaagugcgagccccacgggcuggucgugcgguccaccggcuucaagaucagcuccgccgucgccugcgcgagcggcgugugcgugaccgggucccagagccccuccaccgagaucacgcucaaguacccgggcaucagccaguccagcgggggcgacaucgggguccacauggcccacgacgaccaguccgugagcuccaagaucguggcccacugcccgccccaggaccccugccugguccacggcugcaucgugugcgcccacggccugaucaacuaccagugccacaccgcgcucagcgccuucguggucaucuucguguucuccagcaccgccaucaucugccuggccgugcuguaccgcguccucaagugccugaagaucgcgccccggaaggugcugaacccccucauguggaucaccgccuucauccgcuggguguacaagaagauggucgcccggguggccgacaacaucaaccaggugaaccgcgagaucggguggauggagggcgggcagcuggcccugggcaaccccgcccccaucccgcggcacgcgcccaucccccgcuacuccacguaccucaugcugcugcucaucgucagcuacgccagcgcc

SEQ ID NO: 12984 - RNA, 1680 nt, Artificial Sequence
  derived and/or modified CDS sequence (opt1) from RVFV(ANK-6087)__DQ380216.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaagcuggacuccggccagaccaagcgcgagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacccugaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacacggcgcugagcgccuucguggucguguucguguucuccagcaucgccaucaucugccuggccauccucuaccggguccugaagugccugaagaucgcgccccgcaaggugcucaacccccugauguggaucaccgccuucauccgguggguguaccgcaagauggucgcccggguggccgacaacaucaaccaggugaaccgcgagaucggcuggauggagggcgggcagcugguccucgggaaccccgcccccaucccgcggcacgugcccaucccccgcuacuccaccuaccugaugcugcuccugaucgugagcuacgccagcgcg

SEQ ID NO: 12985 - RNA, 1680 nt, Artificial Sequence
  derived and/or modified CDS sequence (opt1) from RVFV(763/70)__DQ380188.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgggcugaccgaggacugcaacuucugccggcagaugaccggcgccucccucaagaaggggagcuacccccugcaggaccuguucugccaguccagcgaggacgacggcuccaagcucaagaccaagaugaagggggugugcgaggucggcgugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaaggggcaguacaagggcaccauggacuccgggcagaccaagcgcgagcucaagagcuucgacaucucccagugccccaagaucggcggccacgggagcaagaagugcacgggcgacgcggccuucugcuccgccuacgagugcaccgcccaguacgccaacgcguacugcagccacgccaacgggagcggcaucgugcagauccagguguccggggucuggaagaagccccugugcgugggcuacgagcggguggucgugaagcgcgagcugagcgccaagccgauccagcggguggagcccugcacgaccugcaucaccaagugcgagccccacggccuggucgugcgcuccaccggguucaagaucagcuccgccgucgccugcgcgagcggcgugugcgugaccgggucccagagccccuccaccgagaucacgcucaaguacccgggcaucagccaguccagcgggggcgacaucggcguccacauggcccacgacgaccaguccgugagcuccaagaucguggcccacugcccgccccaggaccccugccugguccacgggugcaucgugugcgcccacggccugaucaacuaccagugccacaccgcgcucagcgccuucguggucguguucguguucuccagcgucgccaucaucugccuggccauccuguacaaggugcucaagugccugaagaucgcgccccggaaggugcugaacccccucauguggaucaccgccuucauccgcugggucuacaagaagaugguggcccggguggccgacaacaucaaccaggucaaccgcgagaucggguggauggagggcgggcagcuggcccugggcaaccccgcccccaucccgcggcacgcgcccaucccccgcuacuccaccuaccucaugcugcugcucaucgugagcuacgccagcgcc

SEQ ID NO: 12986 - RNA, 1680 nt, Artificial Sequence
  derived and/or modified CDS sequence (opt1) from RVFV(BIME-01)__KX609032.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcuccggugccugaagaucgcccccaagaaggugcugaacccccucauguggaucaccgcguucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucaucagcuacgccagcgcc

SEQ ID NO: 12987 - RNA, 1680 nt, Artificial Sequence
  derived and/or modified CDS sequence (opt1) from RVFV(KEN07-KUR340)__EF460404.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggaugcucaagugccugaagaucgcgccccgcaucguccugaacccccucauguggaucaccgccuucauccgguggguguacaagaagaugguggcccgcgucgccgacaacaucaaccaggugaaccgggagaucggcuggauggagggcgggcagcuggcccuggggaaccccgcccccaucccgcgccacgcgcccaucccccgguacuccacguaccucaugcugcugcucaucgugagcuacgccagcgcc

SEQ ID NO: 12988 - RNA, 1680 nt, Artificial Sequence
  derived and/or modified CDS sequence (opt1) from RVFV(SA-51 (Van Wyck))__DQ380195.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccggggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcgcguggucgugaagcgggagcugagcgccaagccgauccagcgcguggagcccugcacgaccugcaucaccaagugcgagccccacggccuggucgugcgguccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcucaagugccugaagaucgcgccccgcaaggugcugaacccccucauguggaucaccgccuucauccggugggucuacaagaagaugguggcccgcguggccgacaacaucaaccaggucaaccgggagaucggcuggauggagggcgggcagcuggcccuggggaaccccgcccccaucccgcgccacgcgcccaucccccgguacuccaccuaccucaugcugcugcucaucgugagcuacgccagcgcc

SEQ ID NO: 12989 - RNA, 1680 nt, Artificial Sequence
  derived and/or modified CDS sequence (opt1) from RVFV(Lunyo)__KU167026.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccaugguguccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccugaacccccucauguggaucaccgccuucauccgcuggguguacaagaagaugguggcccgggucgccgacaacaucaaccaggugaaccgcgagaucggcuggauggagggcgggcagcuggcccuggggaaccccgcccccaucccgcggcacgcgcccaucccccgcuacuccaccuaccucaugcugcugcucaucgugagcuacgccagcgcc

SEQ ID NO: 12990 - RNA, 1680 nt, Artificial Sequence
  derived and/or modified CDS sequence (opt1) from RVFV(2269/74)__DQ380222.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccagcacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcucaagugccugaagaucgcccccaagaaggugcugaacccccucauguggaucaccgcguucauccggugggucuacaagaagaugguggcccgcguggccgacaacaucaaccaggucaaccgggagaucggcuggauggagggcgggcagcuggcccuggggaaccccgcccccaucccgcgccacgcgcccaucccccgguacuccaccuaccucaugcugcugcucaucgugagcuacgccagcgcc

SEQ ID NO: 12991 - RNA, 1680 nt, Artificial Sequence
  derived and/or modified CDS sequence (opt1) from RVFV(MgH824)__DQ380210.1__Gn
auggccggcaucgccaugaccgugcugcccgcgcucgccgucuucgcccuggccccggugguguucgccgaggacccccaccuccgcaaccggcccgggaagggcuacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcgcaagggccaguacaaggggaccauggacuccggccagaccaagcgggagcucaagagcuucgacaucucccagugccccaagaucgggggccacggcagcaagaagugcacgggggacgcggccuucugcuccgccuacgagugcaccacccaguacgccaacgccuacugcagccacgcgaacggcagcgggguggugcagauccaggucuccggcguguggaagaagccccugugcgugggguacgagcgcgucguggugaagcgggagcugagcgccaagccgauccagcgcgucgagcccugcaccacgugcaucaccaagugcgagccccacggccuggugguccgguccaccggcuucaagaucagcuccgccguggccugcgccagcggggugugcgucaccggcucccagagccccuccacggagaucacccucaaguacccggggaucagccaguccagcggcggggacaucggcgugcacauggcgcacgacgaccaguccgugagcuccaagaucgucgcccacugcccgccccaggaccccugccuggugcacggcugcaucgugugcgcccacgggcugaucaacuaccagugccacaccgcccucagcgcguucgucgugguguucgucuucuccagcaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaaccccgcccccaucccgcggcacgcccccaucccccgcuacuccacguaccucaugcugcugcucaucgugagcuacgccagcgcg

SEQ ID NO: 12992 - RNA, 1680 nt, Artificial Sequence
  derived and/or modified CDS sequence (opt1) from RVFV__JQ068143.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccaucgacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcuccggugccugaagaucgcccccaagaaggugcugaacccccucauguggaucaccgcguucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucaucagcuacgccagcgcc

SEQ ID NO: 12993 - RNA, 1680 nt, Artificial Sequence
  derived and/or modified CDS sequence (opt1) from RVFV(RVFBJ01/2016)__KX785331.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaagcacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguacccggggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucguguucguguucuccagcgucgccaucaucugccuggccauccuguacaaggugcuccggugccugaagaucgcccccaagaaggugcugaacccccucauguggaucaccgcguucauccgcugggucuacaagaagaugguggcccggguggccgacaacaucaaccaggucaaccgcgagaucggcuggauggagggcgggcagcuggcccuggggaaccccgcccccaucccgcggcacgcgcccaucccccgcuacuccaccuaccucaugcugcugcucaucaucagcuacgccagcgcc

SEQ ID NO: 12994 - RNA, 1680 nt, Artificial Sequence
  derived and/or modified CDS sequence (opt1) from RVFV(KEN/Kil-006/07)__HM586966.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgccgacggcaacaagugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagcccauccagcggguggagccgugcacgaccugcaucaccaagugcgagccccacggccuggucgugcgcuccaccggcuucaagaucagcuccgccgucgccugcgcgagcggggugugcgugaccggcucccagagccccuccaccgagaucacgcucaaguaccccgggaucagccaguccagcggcggggacaucggcguccacauggcccacgacgaccaguccgugagcuccaagaucguggcccacugcccgccccaggaccccugccugguccacggcugcaucgugugcgcccacgggcugaucaacuaccagugccacaccgcgcucagcgccuucguggucaucuucguguucuccagcaccgccaucaucugccuggccgugcuguaccggguccucaagugccugaagaucgcgccccgcaaggugcugaacccgcucauguggaucaccgccuucauccgguggguguacaagaagauggucgcccgcguggccgacaacaucaaccaggugaaccgggagaucggcuggauggagggcgggcagcuggcccuggggaaccccgcccccaucccccgccacgcgccgaucccccgguacuccacguaccucaugcugcugcucaucgucagcuacgccagcgcc

SEQ ID NO: 12995 - RNA, 1680 nt, Artificial Sequence
  derived and/or modified CDS sequence (opt1) from RVFV(SA-75)__DQ380189.1__Gn
auggcccgcaucgccaugaccgugcugcccgcgcucgccgucuucgcccuggccccggugguguucgccgaggacccccaccuccggaaccgccccggcaaggggcacaacuacaucgacggcaugacccaggaggacgcgacgugcaagcccgucaccuacgccggggccugcagcuccuucgacgugcugcuggagaagggcaaguucccgcuguuccagagcuacgcccaccaccggacccuccuggaggcggugcacgacaccaucaucgccaaggccgacccgcccuccugcgaccugcagagcgcccacgggaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccgccagaugaccggcgccucccucaagaaggggagcuacccccugcaggaccuguucugccaguccagcgaggacgacggcuccaagcucaagaccaagaugaagggggugugcgaggucggcgugcaggcccugaagaagugcgacgggcagcugagcacggcccacgaggugguccccuucgccguguucaagaacuccaagaagguguaccucgacaagcuggaccugaagaccgaggagaaccuccugcccgacagcuucgucugcuucgagcacaagggccaguacaagggcaccauggacuccgggcagaccaagcgggagcucaagagcuucgacaucucccagugccccaagaucggcgggcacggcagcaagaagugcacgggcgacgcggccuucugcuccgccuacgagugcaccgcccaguacgccaacgcguacugcagccacgccaacgggagcggcguggugcagauccaggucuccgggguguggaagaagccccugugcgugggcuacgagcgcgucguggugaagcgggagcugagcgccaagccgauccagcgcgucgagcccugcacgaccugcaucaccaagugcgagccccacgggcuggugguccgguccaccggcuucaagaucagcuccgccguggccugcgcgagcggcgugugcgucaccgggucccagagccccuccaccgagaucacgcucaaguacccgggcaucagccaguccagcgggggcgacaucggggugcacauggcccacgacgaccaguccgugagcuccaagaucgucgcccacugcccgccccaggaccccugccuggugcacggcugcaucgugugcgcccacggccugaucaacuaccagugccacaccgcgcucagcgccuucgucgugguguucgucuucuccagcguggccaucaucugccuggccauccuguacaaggugcucaagugccugaagaucgcgccccgcaagguccugaacccccucauguggaucaccguguucauccgguggguguacaagaagauggucgcccgcguggccgacaacaucaaccaggugaaccgggagaucggguggauggagggcgggcagcuggcccugggcaaccccgcccccaucccgcgccacgcccccaucccccgguacuccaccuaccucaugcugcugcucaucgucagcuacgcgagcgcc

SEQ ID NO: 12996 - RNA, 1680 nt, Artificial Sequence
  derived and/or modified CDS sequence (opt1) from RVFV(35/74)__JF784387.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggguggugcagauccaggucuccggcguguggaagaagccccugugcgugggguacgagcgggucguggugaagcgcgagcugagcgccaagccgauccagcgggucgagcccugcacgaccugcaucaccaagugcgagccccacggccuggugguccgcuccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucgcccacugcccgccccaggaccccugccuggugcacggcugcaucgugugcgcccacgggcugaucaacuaccagugccacaccgcgcucagcgccuucgucgugguguucgucuucuccagcguggccaucaucugccuggccauccuguacaaggugcucaagugccugaagaucgcgccccggaagguccuggacccccucauguggaucaccguguucauccgcuggguguacaagaagauggucgcccggguggccgacaacaucaaccaggugaaccgcgagaucggcuggauggagggcgggcagcuggcccuggggaaccccgcccccaucccgcggcacgcccccaucccccgcuacuccaccuaccucaugcugcugcucaucgucagcuacgcgagcgcc

SEQ ID NO: 12997 - RNA, 1680 nt, Artificial Sequence
  derived and/or modified CDS sequence (opt1) from RVFV__M11157.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgggcugaccgaggacugcaacuucugccggcagaugaccggcgccucccucaagaaggggagcuacccccugcaggaccuguucugccaguccagcgaggacgacggcuccaagcucaagaccaagaugaagggggugugcgaggucggcgugcaggcccacaagaagugcgacggccagcugagcacggcccacgaggugguccccuucgccguguucaagaacuccaagaagguguaccuggacaagcucgaccugaagaccgaggagaaccugcuccccgacagcuucgucugcuucgagcacaaggggcaguacaagggcaccauggacuccgggcagaccaagcgcgagcucaagagcuucgacaucucccagugccccaagaucggcggccacgggagcaagaagugcacgggcgacgcggccuucugcuccgccuacgagugcaccgcccaguacgccaacgcguacugcagccacgccaacgggagcggcaucgugcagauccagguguccggggucuggaagaagccccugugcgugggcuacgagcggguggucgugaagcgcgagcugagcgccaagccgauccagcggguggagcccugcacgaccugcaucaccaagugcgagccccacggccuggucgugcgcuccaccggguucaagaucagcuccgccgucgccugcgcgagcggcgugugcgugaccgggucccagagccccuccaccgagaucacgcugaaguacccgggcaucagccaguccagcgggggcgacaucggcguccacauggcccacgacgaccaguccgugagcuccaagaucguggcccacugcccgccccaggaccccugccucguccacgggugcaucgugugcgcccacggccugaucaacuaccagugccacaccgcgcugagcgccuucguggucguguucguguucuccagcaucgccaucaucugccucgccguccuguaccgggugcugaagugccucaagaucgcgccccgcaaggugcugaacccccugauguggaucaccgccuucauccgguggaucuacaagaagauggucgcccgcguggcccacaacaucaaccaggugaaccgggagaucggguggauggagggcgggcagcucguccugggcaaccccgcccccaucccgcgccacgcccccaucccccgguacuccaccuaccugaugcuccugcugaucgugagcuacgcgagcgcc

SEQ ID NO: 12998 - RNA, 1680 nt, Artificial Sequence
  derived and/or modified CDS sequence (opt1) from RVFV(KEN/Bar-035/07)__HM586969.1__Gn
auggccggcaucgccaugaccgugcugcccgcgcucgccgucuucgcccuggccccggugguguucgccgaggacccccaccuccgcaaccggcccgggaagggccacaacuacaucgacgggcgccugcaggaggacgcgaccugcaagcccgucacguacgccggcgccugcagcuccuucgacgugcugcuggagaaggggaaguucccccucuuccagagcuacgcccaccaccggacccugcuggaggcggugcacgacaccaucaucgccaaggccgacccgcccuccugcgaccuccagagcgccgacggcaacaagugcaugaaggagaagcuggucaugaagacccacugccccaacgacuaccaguccgcccacuaccugaacaacgacggcaagauggcgagcgugaagugcccgcccaaguacgagcucacggaggacugcaacuucugccgccagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcaccgcccacgaggugguccccuucgccguguucaagaacuccaagaagguguaccuggacaagcuggaccucaagacggaggagaaccugcugccggacagcuucgucugcuucgagcacaagggccaguacaaggggaccauggacuccggccagaccaagcgggagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcgcguggucgugaagcgggagcugagcgccaagcccauccagcgcguggagccgugcacgaccugcaucaccaagugcgagccccacggccucgucgugcgguccaccggcuucaagaucagcuccgccgucgccugcgcgagcggggugugcgugaccggcucccagagccccuccaccgagaucacccugaaguaccccgggaucagccaguccagcggcggggacaucggcguccacauggcccacgacgaccaguccgugagcuccaagaucguggcccacugcccgccccaggaccccugccugguccacggcugcaucgugugcgcccacgggcucaucaacuaccagugccacacggcgcugagcgccuucguggucaucuucguguucuccagcaccgccaucaucugccuggccgugcucuaccgcguccugaagugccugaagaucgcgccccggaaggugcucaacccgcugauguggaucaccgccuucauccgcuggguguacaagaagauggucgcccggguggccgacaacaucaaccaggugaaccgcgagaucggcuggauggagggcgggcagcuggcccucgggaaccccgcccccaucccccggcacgcgccgaucccccgcuacuccaccuaccugaugcugcuccugaucgucagcuacgccagcgcc

SEQ ID NO: 12999 - RNA, 1680 nt, Artificial Sequence
  derived and/or modified CDS sequence (opt1) from RVFV(Kenya 56 (IB8))__DQ380190.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccagggcgacgcgacgugcaagcccgucaccuacgccggggccugcagcuccuucgacgugcugcuggagaagggcaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaaggacuaccaguccgcccacuaccugaacaacgacgggaagauggcgagcgugaagugcccgcccaaguacgagcugaccgaggacugcaacuucugccggcagaugaccggcgccucccucaagaaggggagcuacccccugcaggaccuguucugccaguccagcgaggacgacggcuccaagcucaagaccaagaugaagggggugugcgaggucggcgugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaaggggcaguacaagggcaccauggacuccgggcagaccaagcgcgagcucaagagcuucgacaucucccagugccccaagaucggcggccacgggagcaagaagugcacgggcgacgcggccuucugcuccgccuacgagugcaccgcccaguacgccaacgcguacugcagccacgccaacgggagcggcaucgugcagauccagguguccggggucuggaagcggccccugugcgugggcuacgagcgcguggucgugaagcgggagcugagcgccaagccgauccagcgcguggagcccugcacgaccugcaucaccaagugcgagccccacggccuggucgugcgguccaccggguucaagaucagcuccgccgucgccugcgcgagcggcgugugcgugaccgggucccagagccccuccaccgagaucacgcucaaguacccgggcaugagccaguccagcgggggcgacaucggcguccacauggcccacgacgaccaguccgugagcuccaagaucguggcccacugcccgccccaggaccccugccugguccacgggugcaucgugugcgcccacggccugaucaacuaccagugccacaccgcgcucagcgccuucguggucguguucguguucuccagcgucgccaucaucugccuggccauccuguacaaggugcucaagugccugaagaucgcgccccgcaaggugcugaacccccucauguggaucaccgccuucauccggugggucuacaagaagaugguggcccgcguggccgacaacaucaaccaggucaaccgggagaucggguggauggagggcgggcagcccgcccugggcaaccccgccccgaucccccgccacgcgcccaucccgcgguacuccaccuaccugaugcuccugcugaucgugagcuacgccagcgcc

SEQ ID NO: 13000 - RNA, 1680 nt, Artificial Sequence
  derived and/or modified CDS sequence (opt1) from RVFV(KEN/Bar-032/07)__HM586968.1__Gn
auggccggcaucgccaugaccgugcugcccgcgcucgccgucuucgcccuggccccggugguguucgccgaggacccccaccuccgcaaccggcccgggaagggccacaacuacaucgacgggcgccugcaggaggacgcgaccugcaagcccgucacguacgccggcgccugcagcuccuucgacgugcugcuggagaaggggaaguucccccucuuccagagcuacgcccaccaccggacccugcuggaggcggugcacgacaccaucaucgccaaggccgacccgcccuccugcgaccuccagagcgccgacggcaacaagugcaugaaggagaagcuggucaugaagacccacugccccaacgacuaccaguccgcccacuaccugaacaacgacggcaagauggcgagcgugaagugcccgcccaaguacgagcucacggaggacugcaacuucugccgccagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcaccgcccacgaggugguccccuucgccguguucaagaacuccaagaagguguaccuggacaagcuggaccucaagacggaggagaaccugcugccggacagcuucgucugcuucgagcacaagggccaguacaaggggaccauggacuccggccagaccaagcgggagcucaagagcuucgacaucucccagugccccaagaucgggggccacggcagcaagaagugcaccggggacgcggccuucugcuccgccuacgagugcacggcccaguacgccaacgcguacugcagccacgccaacggcagcgggaucgugcagauccagguguccggcgucuggaagaagccccugugcgugggguacgagcgcguggucgugaagcgggagcugagcgccaagcccauccagcgcguggagccgugcacgaccugcaucaccaagugcgagccccacggccucgucgugcgguccaccggcuucaagaucagcuccgccgucgccugcgcgagcggggugugcgugaccggcucccagagccccuccaccgagaucacccugaaguaccccgggaucagccaguccagcgucggcgacaucggggugcacauggcccacgacgaccaguccgugagcuccaagaucgucgcccacugcccgccccaggaccccugccuggugcacggcugcaucgugugcgcccacggccucaucaacuaccagugccacacggcgcugagcgccuucgucgugaucuucguguucuccagcaccgccaucaucugccuggccguccucuaccgcgugcugaagugccugaagaucgcgccccggaaggugcucaacccgcugauguggaucaccgccuucauccgcugggucuacaagaagaugguggcccggguggccgacaacaucaaccaggucaaccgcgagaucggguggauggagggcgggcagcuggcccucggcaaccccgcccccaucccccggcacgcgccgaucccccgcuacuccaccuaccugaugcugcuccugaucgugagcuacgccagcgcc

SEQ ID NO: 13001 - RNA, 1680 nt, Artificial Sequence
  derived and/or modified CDS sequence (opt1) from RVFV(Beijing-01)__KX611606.1__Gn
auggccggcaucgccaugaccgugcugcccgcgcucgccgucuucgcccuggccccggugguguucgccgaggacccccaccuccgcaaccggcccgggaagggccacaacuacaucgacggggucacccaggaggacgcgacgugcaagcccgugaccuacgccggcgccugcagcuccuucgacgugcugcuggagaaggggaaguucccgcuguuccagagcuacgcccaccaccgcacccuccuggaggcgguccacgacaccaucaucgccaaggccgacccgcccuccugcgaccugcagagcgcccacggcaaccccugcaugaaggagaagcucgugaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgucugcgaggugggggugcaggcccugaagaagugcgacggccgccugagcacggcccacgaggucgugcccuucgccguguucaagaacuccaagaaggucuaccucgacaagcuggaccugaagaccgaggagaaccuccugcccgacagcuucgugugcuucgagcacaagggccaguacaaggggaccauggacuccggccagaccaagcgggagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccaggucuccggcguguggaagaagccccugugcgugggguacgagcgcgucguggugaagcgggagcugagcgccaagccgauccagcgcgucgagcccugcacgaccugcaucaccaagugcgagccccacggccuggugguccgguccaccggcuucaagaucagcuccgccguggccugcgcgagcggggugugcgucaccggcucccagagccccuccaccgagaucacgcucaaguacccggggaucagccaguccagcggcggggacaucggcgugcacauggcccacgacgaccaguccgugagcuccaagaucgucuucgacugcccgccccaggaccccugccuggugcacggcugcaucgugugcgcccacgggcugaucaacuaccagugccacaccgcccucagcgcguucgucgugguguucgucuucuccagcguggccaucaucugccuggccauccuguacaaggugcuccgcugccugaagaucgcccccaagaagguccugaacccccucauguggaucaccgccuucauccgguggguguacaagaagaugguggcgcgcgucgccgacaacaucaaccaggugaaccgggagaucggcuggauggagggcgggcagcuggcccuggggaaccccgcccccaucccgcgccacgcccccaucccccgguacuccaccuaccucaugcugcugcucaucaucagcuacgcgagcgcc

SEQ ID NO: 13002 - RNA, 1680 nt, Artificial Sequence
  derived and/or modified CDS sequence (opt1) from RVFV(Smithburn)__DQ380193.1__Gn
auggccggcaucgccaugaccguguuccccgcgcuggucguguucgcccucgccccgguggucuucgccgaggacccccaccuccgcaaccggcccgggaagggccacaacuacaucgacgggaugacccaggaggacgccacgugcaagcccgugaccuacgcgggcgccugcagcuccuucgacgugcugcuggagaaggggaaguucccgcuguuccagagcuacgcccaccaccgcacccugcucgaggccguccacgacaucaucaucgcgaaggccgacccgcccuccugcaaccugcagagcgcccacggcaaccccugcaugaaggagaagcuggugaugaagaccuacugccccaacgacuaccaguccgcccacuaccucaacaacgacggcaagauggccagcgugaagugcccgcccaagcacgagcugacggaggacugcaacuucugccggcagaugaccggggcgucccugaaggagggcagcuacccccuccaggaccuguucugccaguccagcgaggacgacggguccaagcugaagaccaagaugaagggcgucugcgaggugggggugcagguccucaagaagugcgacggccagcugagcaccgcccacgagguggugcccuucgccgucuucaagaacuccaagaagguguaccuggacaagcucgaccugaagacggaggagaaccugcuccccgacagcuucgugugcuucgagcacaagggccaguacaaggggaccauggacuccggccagaucaagcgcgagcucaagagcuucgacaucucccagugccccaagaucgggggccacggcagcaagaagugcaccggggacgccgccuucugcuccgcguacgagugcaccgcccaguacgccaacgccuacugcagccacgccaacggcagcgggaucguccagauccagguguccggcguguggaagaagccccugugcgucggguacgagcgggugguggucaagcgcgagcugagcgcgaagccgauccagcggguggagcccugcacgaccugcaucaccaagugcgagccccacggccuggucgugcgcuccaccggcuucaagaucagcuccgccguggccugcgccagcggggucugcgugacgggcucccagagccccuccaccgagaucacccugaaguacccggggaucagccaguccagcggcggggacaucggcgugcacauggcccacgacgaccaguccgucagcuccaagaucguggcgcacugcccgccccaggaccccugccucgugcacggcugcaucgucugcgcccacgggcugaucaacuaccagugccacaccgccuucagcgccuucgugguggucuucguguucuccagcguggucaucaucugccuggcgauccucuacaaggugcugaagugccugaagaucgcgccccggaaggugcucaacccccugauguggaucacggccuucauccgcugggucuacaagaagaugguggcccggguggccgacaacaucaaccaggucaaccgcgagaucggcuggauggagggcgggcagcuggugcucgggaaccccgcccccaucccgcggcacgcccccaucccccgcuacuccaccuaccugaugcugcuccugaucgugagcuacgccagcgcc

SEQ ID NO: 13003 - RNA, 1680 nt, Artificial Sequence
  derived and/or modified CDS sequence (opt1) from RVFV(TAN/Dod-002/07)__HM586971.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacuccaagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggccggaagaagugcacgggggacgcggccuucugcagcgccuacgagugcaccgcccaguacgccaacgcguacugcucccacgccaacggcagcgggaucgugcagauccaggugagcggcgucuggaagaagccccugugcgugggguacgagcgcguggucgugaagcgggagcuguccgccaagccgauccagcgcguggagcccugcacgaccugcaucaccaagugcgagccccacggccuggucgugcggagcaccggcuucaagaucuccagcgccgucgccugcgcguccggggugugcgugaccggcagccagucccccagcaccgagaucacgcucaaguacccggggaucucccagagcuccggcggggacaucggcguccacauggcccacgacgaccagagcguguccagcaagaucguggcccacugcccgccccaggaccccugccugguccacggcugcaucgugugcgcccaggcguggaucaucucccaguggcacaccgcccugagcgccuucguggucaucuucguguucuccagcaccgccaucaucugccucgccgugcuguaccgcguccugaagugccucaagaucgcgccccggaaggugcugaacccccugauguggaucaccgccuucauccgcuggguguacaagaagauggucgcccggguggccgacaacaucaaccaggugaaccgcgagaucggguggauggagggcgggcagcucgcccugggcaaccccgcgcccaucccgcggcacgcccccaucccccgcuacuccacguaccugaugcuccugcugaucgucagcuacgccagcgcc

SEQ ID NO: 13004 - RNA, 1680 nt, Artificial Sequence
  derived and/or modified CDS sequence (opt1) from RVFV(KEN/Gar-004/06)__HM586964.1__Gn
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcagagcgcccacggcaaccccugcaugaaggagaagcucgucaugaagacgcacugccccaacgacuaccaguccgcccacuaccugaacaacgacggcaagauggcgagcgugaagugcccgcccaaguacgagcugaccgaggacugcaacuucugccggcagaugaccggggccucccucaagaagggcagcuacccccugcaggaccuguucugccaguccagcgaggacgacggguccaagcucaagaccaagaugaagggcgugugcgaggucggggugcaggcccugaagaagugcgacggccagcugagcacggcccacgaggugguccccuucgccguguucaagaacucccagaagguguaccucgacaagcuggaccugaagaccgaggagaaccuccugcccgacagcuucgucugcuucgagcacaagggccaguacaaggggaccauggacuccggccagaccaagcgcgagcucaagagcuucgacaucucccagugccccaagaucgggggccacggccggaagaagcgcacgggggacgcggccuucugcagcgccuacgagugcaccgcccaguacgccaacgcguacugcucccgggccaacggcagcgggaucgugcagauccaggugagccgcgucuggaagaagccccugugcgugggcuacgagcggguggucgugaagcgcgagcuguccgccaagccgauccagcggguggagcccugcacgaccugcaucaccaagugcgagccccacgggcuggucgugcgcagcaccggcuucaagaucuccagcgccgucgccugcgcguccggcgugugcgugaccgggagccagucccccagcaccgagaucacgcucaaguacccgggcaucucccagagcuccgggggcgacaucgggguccacauggcccacgacgaccagagcguguccagcaagaucguggcccacugcccgccccaggaccccugccugguccacggcugcaucgugugcgcccacggccugaucaacaaccagucccacagcgcgcucuccgccuucguggucaucuucguguucagcuccaccgccaucaucugccuggccgugcuguaccggguccucaagugccugaagaucgcgccccgcaaggugcugaacccccucauguggaucaccgccuucauccgguggguguacaagaagauggucgcccgcguggccgacaacaucaaccaggugaaccgggagaucggguggauggagggcgggcagcuggcccugggcaaccccgcccccaucccgcgccacgcgcccaucccccgguacagcaccuaccucaugcugcugcucaucgucagcuacgccuccgcc

SEQ ID NO: 13005 - RNA, 1521 nt, Artificial Sequence
  derived and/or modified CDS sequence (opt1) from RVFV(ZH-548)__DQ380206.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcagccuguccgcccacaacaaggacgggagccuccacaucgugcugccguccgagaacggcaccaaggaccagugccagauccugcacuucacgguccccgagguggaggaggaguucauguacagcugcgacggcgacgagcggccccuccuggucaaggggacccugaucgccaucgaccccuucgacgaccgccgggaggccggcggggaguccaccguggugaaccccaagagcggcuccuggaacuucuucgacugguucagcgggcucauguccugguucggcggcccgcugaagaccauccugcucaucugccuguacgucgcccugagcaucggccucuucuuccugcugaucuaccucgggcgcacggggcuguccaagauguggcuggcggccaccaagaaggccagc

SEQ ID NO: 13006 - RNA, 1521 nt, Artificial Sequence
  derived and/or modified CDS sequence (opt1) from RVFV(35/74)__JF784387.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13007 - RNA, 1521 nt, Artificial Sequence
  derived and/or modified CDS sequence (opt1) from RVFV(200803162)__JF311377.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccuggucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugauguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccguggucaacccgaaguccggcagcuggaacuucuucgacugguucuccgggcucaugagcugguucggcggcccccugaagacgauccugcucaucugccuguacguggcccuguccaucggccucuucuuccugcugaucuaccucgggcgcaccgggcugagcaagauguggcuggcggccaccaagaaggccucc

SEQ ID NO: 13008 - RNA, 1521 nt, Artificial Sequence
  derived and/or modified CDS sequence (opt1) from RVFV(200803166)__JF311381.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacgugguccugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccguggucaacccgaaguccggcagcuggaacuucuucgacugguucuccgggcucaugagcugguucggcggcccccugaagacgauccugcucaucugccuguacguggcccuguccaucggccucuucuuccugcugaucuaccucgggcgcaccgggcugagcaagauguggcuggcggccaccaagaaggccucc

SEQ ID NO: 13009 - RNA, 1521 nt, Artificial Sequence
  derived and/or modified CDS sequence (opt1) from RVFV(SA-51 (Van Wyck))__DQ380195.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggaggugaccgacuucgacggcagcgucagcacgaucgaccugggcgcguccagcucccgguucaccaacugggggagcgugucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccguccucagcgcccacgaguccugccugcgcgcgccgaaccugaucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugauguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccguggucaacccgaaguccggcagcuggaacuucuucgacugguucuccgggcucaugagcugguucggcggcccccugaagacgauccugcucaucugccuguacguggcccuguccaucggccucuucuuccugcugaucuaccucgggcgcaccgggcugagcaagauguggcuggcggccaccaagaaggccucc

SEQ ID NO: 13010 - RNA, 1521 nt, Artificial Sequence
  derived and/or modified CDS sequence (opt1) from RVFV(ZINGA J83 R1)__KU978776.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccugguccgcgggacccugaucgccaucgaccccuucgacgaccggcgcgaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13011 - RNA, 1521 nt, Artificial Sequence
  derived and/or modified CDS sequence (opt1) from RVFV(Entebbe)__DQ380191.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacggucgaccugggcgcguccagcucccgguucaccaacugggggagcgugucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccguccucagcgcccacgaguccugccugcgcgcgccgaaccugaucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugauguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccguggucaacccgaaguccggcagcuggaacuucuucgacugguucuccgggcucaugagcugguucggcggcccccugaagacgauccugcucaucugccuguacguggcccuguccaucggccucuucuuccugcugaucuaccucgggcgcaccgggcugagcaagauguggcuggcggccaccaagaaggccucc

SEQ ID NO: 13012 - RNA, 1521 nt, Artificial Sequence
  derived and/or modified CDS sequence (opt1) from RVFV(Sudan 2V-2007)__JQ820490.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugauggccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13013 - RNA, 1521 nt, Artificial Sequence
  derived and/or modified CDS sequence (opt1) from RVFV(Sudan 86-2010)__JQ820489.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucaucuucgagcgggggucccugccccagacgcgcaacgacaagaccuucgccgccagcaagggcaaccgcggggugcaggccuucagcaagggcuccgugcaggccgaccucacccugauguucgacaacuucgaggucgacuucgugggcgcggccgugagcugcgacgccgccuuccugaaccucaccgggugcuacuccugcaacgccggcgcgcgggucugccugagcaucacguccaccgggaccggcacccugagcgcccacaacaaggacgggucccuccacaucgugcugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccgucgugaacccgaaguccggcagcuggaacuucuucgacugguucuccgggcucaugagcugguucggcggcccccugaagacgauccugcucaucugccuguacguggcccuguccaucggccucuucuuccugcugaucuaccucgggcgcaccgggcugagcaagauguggcuggcggccaccaagaaggccucc

SEQ ID NO: 13014 - RNA, 1521 nt, Artificial Sequence
  derived and/or modified CDS sequence (opt1) from RVFV(Kenya 56 (IB8))__DQ380190.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucgccuucgagcgggggucccugccccagacgcgcaacgacaagaccuucgccgccagcaagggcaaccgcggggugcaggccuucagcaagggcuccgugcaggcggaccucacccugauguucgacaacuucgaggucgacuucgugggcgccgccgugagcugcgacgccgccuuccugaaccucaccgggugcuacuccugcaacgcgggcgcccgggucugccugagcaucacguccaccgggaccggcacccugagcgcccacaacaaggacgggucccuccacaucgugcugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccgucgugaacccgaaguccggcagcuggaacuucuucgacugguucuccgggcucaugagcugguucggcggcccccugaagacgauccugcucaucugccuguacguggcgcuguccaucggccucuucuuccugcugaucuaccucgggcgcaccgggcugagcaagauguggcuggccgccaccaagaaggccucc

SEQ ID NO: 13015 - RNA, 1521 nt, Artificial Sequence
  derived and/or modified CDS sequence (opt1) from RVFV(ARD-38388)__DQ380187.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucaucggggaguccaccacgaugcgcgagaacaagugcuucgagcagugcggcggguggggcugcgggugcuucaacgugaacccgagcugccucuucguccacaccuaccugcaguccgugcggaaggaggcccugcgcguguucaacugcaucgacuggguccacaagcucacccuggagaucaccgacuucgacggcagcgugagcacgaucgaccugggcgcguccagcucccgguucaccaacugggggagcgugucccucagccuggacgccgagggcaucuccgggagcaacuccuucagcuucaucgagucccccggcaagggcuacgccaucgucgacgagcccuucagcgagaucccccgccagggguuccugggcgagauccggugcaacuccgagagcuccauccucagcgcccacgaguccugccugcgcgcgccgaaccugaucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugauguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgagguggaggaggaguucauguacuccugcgacggcgacgagcggccccuccuggucaaggggacccugaucgccaucgaccccuucgacgaccgccgggaggccggcggggagagcaccguggucaacccgaaguccggcagcuggaacuucuucgacugguucuccgggcucaugagcugguucggcggcccccugaagacgauccugcucaucugccuguacguggcccuguccaucggccucuucuuccugcugaucuaccucgggcgcaccgggcugagcaagauguggcuggcggccaccaagaaggccucc

SEQ ID NO: 13016 - RNA, 1521 nt, Artificial Sequence
  derived and/or modified CDS sequence (opt1) from RVFV(Sudan 28-2010)__JQ820491.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgugcuguccaucggccucuucuuccugcugaucuaccucgggcgcaccgggcugagcaagauguggcuggccgcgaccaagaaggccucc

SEQ ID NO: 13017 - RNA, 1521 nt, Artificial Sequence
  derived and/or modified CDS sequence (opt1) from RVFV(200803167)__JF311382.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgaugcugcucaucugccuguacgucgcccuguccaucggccucuucuuccugcugaucuaccucgggcgcaccgggcugagcaagauguggcuggcggccaccaagaaggccucc

SEQ ID NO: 13018 - RNA, 1521 nt, Artificial Sequence
  derived and/or modified CDS sequence (opt1) from RVFV(73HB1230)__DQ380221.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccaucaugcgcgagaacaagugcuucgagcagugcggcggguggggcugcgggugcuucaacgucaacccgagcugccucuucgugcacacguaccugcaguccgugcggaaggaggcccugcgcgucuucaacugcaucgacugggugcacaagcucacccuggagaucaccgacuucgacggcagcgugagcaccaucgaccugggcgcguccagcucccgguucacgaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacccgcaacgacaagacguucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucaccuccacggggaccggcacccugagcgcccacaacaaggacgggucccuccacaucgugcugccgagcgagaacggcaccaaggaccagugccagauccugcacuucacgguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagaccauccugcucaucugccuguacgucgcccuguccaucggccucuucuuccugcugaucuaccucgggcgcacggggcugagcaagauguggcuggcggccaccaagaaggccucc

SEQ ID NO: 13019 - RNA, 1521 nt, Artificial Sequence
  derived and/or modified CDS sequence (opt1) from RVFV(2250/74)__DQ380209.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgaaggugugccugagcaucacguccaccgggaccggcagccuguccgcccacaacaaggacgggagccuccacaucgugcugccguccgagaacggcaccaaggaccagugccagauccugcacuucacgguccccgagguggaggaggaguucauguacagcugcgacggcgacgagcggccccuccuggucaaggggacccugaucgccaucgaccccuucgacgaccggcgcgaggccggcggggaguccaccguggugaaccccaagagcggcuccuggaacuucuucgacugguucagcgggcucauguccugguucggcggcccgcugaagaccauccugcucaucugccuguacgucgcccugagcaucggccucuucuuccugcugaucuaccucgggcggacggggcuguccaagauguggcuggcggccaccaagaaggccagc

SEQ ID NO: 13020 - RNA, 1521 nt, Artificial Sequence
  derived and/or modified CDS sequence (opt1) from RVFV(SAUDI 200010901)__KU978778.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgagaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13021 - RNA, 1521 nt, Artificial Sequence
  derived and/or modified CDS sequence (opt1) from RVFV(Lunyo)__KU167026.1__Gc
ugcagcgagcugauccaggccuccagccgcaucacgaccugcuccaccgagggcgugaacacccggugccgccucagcgggaccgcccugauccgggcgggcuccgucggggccgaggccugccugaugcucaagggcgugaaggaggaccagaccaaguuccugaagaucaagacggugagcuccgagcugagcugccgcgaggggcaguccuacuggaccggcagcuucucccccaagugccucagcucccggcgcugccaccuggucggcgagugccacgugaaccggugccugagcuggcgcgacaacgagaccuccgccgaguucagcuucgugggggaguccaccacgaugcgggagaacaagugcuucgagcagugcggcggguggggcugcgggugcuucaacgucaacccgagcugccucuucgugcacaccuaccugcaguccgugcgcaaggaggcccugcgggucuucaacugcaucgacugggugcacaagcucacccuggagaucaccgacuucgacggcagcgugagcacgaucgaccugggcgcguccagcucccgcuucaccaacugggggagcgucucccucagccuggacgccgagggcaucuccgggagcaacuccuucagcuucaucgagucccccggcaagggcuacgccaucguggacgagcccuucagcgagaucccccggcagggguuccugggcgagauccgcugcaacuccgagagcuccgugcucagcgcccacgaguccugccugcgggcgccgaaccugaucagcuacaagcccaugaucgaccagcucgagugcaccaccaaccugaucgaccccuucgucguguucgagcgcgggucccugccccagacgcggaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcgcccccuccuggucaaggggacccugaucgccaucgaccccuucgacgaccggcgcgaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13022 - RNA, 1521 nt, Artificial Sequence
  derived and/or modified CDS sequence (opt1) from RVFV(25010-24)__KM210509.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggacgaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13023 - RNA, 1521 nt, Artificial Sequence
  derived and/or modified CDS sequence (opt1) from RVFV(2007000253)__JF326192.1__Gc
ugcagcgagcugauccaggccuccagccgcaucacgaccugcuccaccgagggcgugaacaccaagugccggcucagcgggaccgcccugauccgcgcgggcuccgccggggccgaggccugccugaugcucaagggcgucaaggaggaccagaccaaguuccugaagaucaagacggugagcuccgagcugagcugccgggaggggcaguccuacuggaccggcagcuucucccccaagugccucagcucccgccggugccaccuggugggcgagugccacgucaaccgcugccugagcuggcgggacaacgagaccuccgccgaguucagcuucgugggggaguccaccacgaugcgcgagaacaagugcuucgagcagugcggcggguggggcugcgggugcuucaacgugaacccgagcugccucuucguccacaccuaccugcaguccgugcggaaggaggcgcugcgcguguucaacugcaucgacuggguccacaagcucacccuggagaucaccgacuucgacggcagcgugagcacgaucgaccugggcgccuccagcucccgguucaccaacugggggagcgugucccucagccuggacgccgagggcaucuccgggagcaacuccuucagcuucaucgagucccccggcaagggcuacgccaucgucgacgagcccuucagcgagaucccccgccagggguuccugggcgagauccggugcaacuccgagagcuccgugcucagcgcgcacgaguccugccugcgcgccccgaaccuggugagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggcggaccucacccugauguucgacaacuucgagguggacuucgugggcgccgccgucagcugcgacgccgccuuccugaaccucaccgggugcuacuccugcaacgcgggcgcccgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcgcuguccaucggccucuucuuccugcugaucuaccucgggcgcaccgggcugagcaagauguggcuggccgccaccaagaaggccucc

SEQ ID NO: 13024 - RNA, 1521 nt, Artificial Sequence
  derived and/or modified CDS sequence (opt1) from RVFV(ZC-3349)__DQ380207.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugaaggcgccgaaccugaucagcuacaagcccaugaucgaccagcucgagugcaccaccaaccugaucgaccccuucgucguguucgagcgcgggucccugccccagacgcggaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcagccuguccgcccacaacaaggacgggagccuccacaucgugcugccguccgagaacggcaccaaggaccagugccagauccugcacuucacgguccccgagguggaggaggaguucauguacagcugcgacggcgacgagcgcccccuccuggucaaggggacccugaucgccaucgaccccuucgacgaccggcgcgaggccggcggggaguccaccguggugaaccccaagagcggcuccuggaacuucuucgacugguucagcgggcucauguccugguucggcggcccgcugaagaccauccugcucaucugccuguacgucgcccugagcaucggccucuucuuccugcugaucuaccucgggcggacggggcuguccaagauguggcuggcggccaccaagaaggccagc

SEQ ID NO: 13025 - RNA, 1521 nt, Artificial Sequence
  derived and/or modified CDS sequence (opt1) from RVFV(OS-1)__DQ380186.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugaaggucuucaacugcaucgacugggugcacaagcucacccuggagaucaccgacuucgacggcagcgugagcacgaucgaccugggcgcguccagcucccgcuucaccaacugggggagcgucucccucagccuggacgccgagggcaucuccgggagcaacuccuucagcuucaucgagucccccggcaagggcuacgccaucguggacgagcccuucagcgagaucccccggcagggguuccugggcgagauccgcugcaacuccgagagcuccgugcucagcgcccacgaguccugccugcgggcgccgaaccugaucagcuacaagcccaugaucgaccagcucgagugcaccaccaaccugaucgaccccuucgucguguucgagcgcgggucccugccccagacgcggaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcgcccccuccuggucaaggggacccugaucgccaucgaccccuucgacgaccggcgcgaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcggaccgggcugagcaagauguggcuggcggccaccaagaaggccucc

SEQ ID NO: 13026 - RNA, 1521 nt, Artificial Sequence
  derived and/or modified CDS sequence (opt1) from RVFV(KEN/Gar-004/06)__HM586964.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccuggucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugcgguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgaggucgaggaggaguucauguacuccugcgacggcgacgagcgcccccuccuggugaaggggacccugaucgccaucgaccccuucgacgaccggcgcgaggccggcggggagagcaccguggucaacccgaaguccggcagcuggaacuucuucgacugguucuccgggcucaugagcugguucggcggcccccugaagacgauccugcucaucugccuguacguggcccuguccaucggccucuucuuccugcugaucuaccucgggcgcaccgggcugagcaagauguggcuggcggccaccaagaaggccucc

SEQ ID NO: 13027 - RNA, 1521 nt, Artificial Sequence
  derived and/or modified CDS sequence (opt1) from RVFV(Smithburn)__DQ380193.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacggucgaccugggcgcguccagcucccgguucaccaacugggggagcgugucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccguccucagcgcccacgaguccugccugcgcgcgccgaaccugaucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugauguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccguggucaacccgaaguccggcagcuggaacuucuucgacugguucuccgggcucaugagcugguucggcggcccccugaagacgauccugcucaucugccuguacguggcccuguccaucggccucuucuucuuccugaucuaccuggggcgcaccgggcucagcaagauguggcuggcggccaccaagaaggccucc

SEQ ID NO: 13028 - RNA, 1521 nt, Artificial Sequence
  derived and/or modified CDS sequence (opt1) from RVFV(2008/00101)__HE687306.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccuggucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugauguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccguggucaacccgaaguccggcagcuggaacuucuucgacugguucuccgggcucaugagcugguucggcggcccccugaagacgacccugcucaucugccuguacguggcccuguccaucggccucuucuuccugcugaucuaccucgggcgcaccgggcugagcaagauguggcuggcggccaccaagaaggccucc

SEQ ID NO: 13029 - RNA, 1521 nt, Artificial Sequence
  derived and/or modified CDS sequence (opt1) from RVFV(2007001292)__EU574046.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccuggucagcuacaagcccaugaucgaccagcucgagugcaccaccaaccugaucgaccccuucgugguguucgagcgggggucccugccccagacgcgcaacgacaagaccuucgccgccagcaagggcaaccgcgggguccaggccuucagcaagggcuccgugcaggccgaccucacccugauguucgacaacuucgagguggacuucgucggcgcggccgugagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgaggucgaggaggaguucauguacuccugcgacggcgacgagcggccccuccuggugaaggggacccugaucgccaucgaccccuucgacgaccgccgggaggccggcggggagagcaccguggucaacccgaaguccggcagcuggaaccucuucgacugguucuccgggcugaugagcugguucggcggcccccugaagacgauccuccugaucugccuguacguggcccucuccaucgggcuguucuuccugcucaucuaccugggccgcaccgggcugagcaagauguggcucgcggccaccaagaaggccucc

SEQ ID NO: 13030 - RNA, 1521 nt, Artificial Sequence
  derived and/or modified CDS sequence (opt1) from RVFV(2007002445)__EU574037.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccuggucagcuacaagcccaugaucgaccagcucgagugcaccaccaaccugaucgaccccuucgugguguucgagcgggggucccugccccagacgcgcaacgagaagaccuucgccgccagcaagggcaaccgcgggguccaggccuucagcaagggcuccauccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13031 - RNA, 1521 nt, Artificial Sequence
  derived and/or modified CDS sequence (opt1) from RVFV(Ken 199800523)__KU978777.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucaacgcccacgagagcugccugcgcgcgccgaaccugaucuccuacaagcccaugaucgaccagcucgagugcaccaccaaccugaucgaccccuucgucguguucgagcgggggagccugccccagacgcgcaacgacaagaccuucgccgccuccaagggcaaccgcggggugcaggccuucagcaagggcagcguccaggccgaccucacccugauguucgacaacuucgagguggacuucgugggcgcggccgucuccugcgacgccgccuuccugaaccucaccgggugcuacagcugcaacgccggcgcgcgggugugccuguccaucacgagcaccgggaccggcacccuguccgcccacaacaaggaggggagccuccacaucgugcugccguccgagaacggcacgaaggaccagugccagauccugcacuucaccguccccgagguggaggaggaguucauguacagcugcgacggcgacgagcggccccuccuggucaaggggacccugaucgccaucgaccccuucgacgaccgccgggaggccggcggggaguccaccguggugaaccccaagagcggcuccuggaacuucuucgacugguucagcgggcucauguccugguucggcggcccgcugaagacgauccugcucaucugccuguacgucgcccugagcaucggccucuucuuccugcugaucuaccucgggcgcaccgggcuguccaagauguggcuggcggccaccaagaaggccagc

SEQ ID NO: 13032 - RNA, 1521 nt, Artificial Sequence
  derived and/or modified CDS sequence (opt1) from RVFV(clone 13)__DQ380213.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggacgaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgagaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13033 - RNA, 1521 nt, Artificial Sequence
  derived and/or modified CDS sequence (opt1) from RVFV(2373/74)__DQ380194.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgcuggaccucggcgcguccagcucccgguucaccaacugggggagcgucucccugagccuggacgccgagggcaucuccgggagcaacuccuucagcuucaucgagucccccggcaagggcuacgccaucguggacgagcccuucagcgagaucccccgccagggguuccucggcgagauccggugcaacuccgagagcuccgugcugagcgcccacgaguccugccugcgcgcgccgaaccucaucagcuacaagcccaugaucgaccagcuggagugcaccaccaaccugaucgaccccuucgucguguucgagcgggggucccucccccagacgcgcaacgagaagaccuucgccgccagcaagggcaaccgcggggugcaggccuucagcaagggcuccguccaggccgaccugacccugauguucgacaacuucgagguggacuucgugggcgcggccgucagcugcgacgccgccuuccucaaccugaccgggugcuacuccugcaacgccggcgcgcgggugugccugagcaucacguccaccgggaccggcacccucagcgcccacaacaaggacgggucccugcacaucgugcugccgagcgagaacggcacgaaggaccagugccagauccuccacuucaccguccccgagguggaggaggaguucauguacuccugcgacggcgacgagcggccccugcuggucaaggggacccucaucgccaucgaccccuucgacgaccgccgggaggccggcggggagagcaccguggugaacccgaaguccggcagcuggaacuucuucgacugguucuccgggcugaugagcugguucggcggcccccugaagacgauccuccugaucugccuguacgucgcccucuccaucgggcuguucuuccugcucaucuaccugggccgcaccgggcugagcaagauguggcucgcggccaccaagaaggccucc

SEQ ID NO: 13034 - RNA, 1521 nt, Artificial Sequence
  derived and/or modified CDS sequence (opt1) from RVFV(OS-8)__DQ380185.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugcggaucaagacggugagcuccgagcugagcugccgcgaggggcaguccuacuggaccggcagcuucucccccaagugccucagcucccggcgcugccaccuggucggcgagugccacgugaaccggugccugagcuggcgcgacaacgagaccuccgccgaguucagcuucgugggggaguccaccacgaugcgggagaacaagugcuucgagcagugcggcggguggggcugcgggugcuucaacgucaacccgagcugccucuucgugcacaccuaccugcaguccgugcgcaaggaggcccugcgggucuucaacugcaucgacugggugcacaagcucacccuggagaucaccgacuucgacggcagcgugagcacgaucgaccugggcgcguccagcucccgcuucaccaacugggggagcgucucccucagccuggacgccgagggcaucuccgggagcaacuccuucagcuucaucgagucccccggcaagggcuacgccaucguggacgagcccuucagcgagaucccccggcagggguuccugggcgagauccgcugcaacuccgagagcuccgugcucagcgcccacgaguccugccugcgggcgccgaaccugaucagcuacaagcccaugaucgaccagcucgagugcaccaccaaccugaucgaccccuucgucguguucgagcgcgggucccugccccagacgcggaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucuccgggugcuacagcugcaacgccggcgcgcgggugugccuguccaucaccagcacggggaccggcacccuguccgcccacaacaaggacgggagccuccacaucgugcugccguccgagaacggcaccaaggaccagugccagauccugcacuucacgguccccgagguggaggaggaguucauguacagcugcgacggcgacgagcgcccccuccuggucaaggggacccugaucgccaucgaccccuucgacgaccggcgcgaggccggcggggaguccaccguggugaaccccaagagcggcuccuggaacuucuucgacugguucagcgggcucauguccugguucggcggcccgcugaagaccauccugcucaucugccuguacgucgcccugagcaucggccucuucuuccugcugaucuaccucgggcgcacggggcuguccaagauguggcuggcggccaccaagaaggccagc

SEQ ID NO: 13035 - RNA, 1521 nt, Artificial Sequence
  derived and/or modified CDS sequence (opt1) from RVFV(KEN/Bar-035/07)__HM586969.1__Gc
ugcagcgagcugauccaggccuccagccgcaucacgaccugcuccaccgagggcgugaacaccaagugccggcucagcgggaccgcccugauccgcgcgcgguccgucggcgccgaggccugccugaugcucaagggggugaaggaggaccagaccaaguuccugaagaucaagacggugagcuccgagcugagcugccgcgagggccaguccuacuggaccgggagcuucucccccaagugccucagcucccggcgcugccaccuggucggcgagugccacgugaaccggugccugagcuggcgcgacaacgagaccuccgccgaguucagcuucgugggcgaguccaccacgaugcgggagaacaagugcuucgagcagugcgggggcugggggugcggcugcuucaacgucaacccgagcugccucuucgugcacaccuaccugcaguccgugcgcaaggaggcccugcgggucuucaacugcaucgacugggugcacaagcucacccuggagaucaccgacuucgacgggagcgugagcacgaucgaccugggcgcguccagcucccgcuucaccaacuggggcagcgucucccucagccuggacgccgaggggaucuccggcagcaacuccuucagcuucaucgagucccccgggaagggcuacgccaucguggacgagcccuucagcgagaucccccggcagggcuuccugggggagauccgcugcaacuccgagagcuccgugcucagcgcccacgaguccugccugcgggcgccgaaccuggucagcuacaagcccaugaucgaccagcucgagugcaccaccaaccugaucgaccccuucgugguguucgagcgcggcucccugccccagacgcggaacgacaagaccuucgccgccagcaaggggaaccgcggcguccaggccuucagcaagggguccgugcaggccgaccucacccugauguucgacaacuucgagguggacuucgucggcgcggccgugagcugcgacgccgccuuccugaaccucaccggcugcuacuccugcaacgccggggcgcgggugugccugagcaucacguccaccggcaccgggacccugagcgcccacaacaaggacggcucccuccacaucguccugccgagcgagaacgggacgaaggaccagugccagauccugcacuucaccgugcccgaggucgaggaggaguucauguacuccugcgacggcgacgagcgcccccuccuggugaagggcacccugaucgccaucgaccccuucgacgaccggcgcgaggccgggggcgagagcaccguggucaacccgaaguccgggagcuggaacuucuucgacugguucuccggccucaugagcugguucgggggcccccugaagacgauccugcucaucugccuguacguggcccuguccaucggccucuucuuccugcugaucuaccucgggcgcaccggccugagcaagauguggcuggcggccaccaagaaggccucc

SEQ ID NO: 13036 - RNA, 1521 nt, Artificial Sequence
  derived and/or modified CDS sequence (opt1) from RVFV(MgH824)__DQ380210.1__Gc
ugcagcgagcugauccaggccuccagccgcaucacgaccugcuccaccgagggcguggacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuuccccgagaucccgcgccagggguuccugggcgagauccggugcaacagcgaguccagcgugcucuccgcccacgagagcugccugcgcgcgcccaaccugaucuccuacaagcccaugaucgaccagcucgagugcaccaccaaccugaucgaccccuucgucguguucgagcgggggagccugccgcagacgcgcaacgacaagaccuucgccgccuccaagggcaaccgcggggugcaggccuucagcaagggcagcguccaggccgaccucacccugauguucgacaacuucgagguggacuucgugggcgcggccgucuccugcgacgccgccuuccugaaccucaccgggugcuacagcugcaacgccggcgcgcgggugugccuguccaucacgagcaccgggaccggcucccugagcgcccacaacaaggacgggucccuccacaucgugcugcccagcgagaacggcaccaaggaccagugccagauccugcacuucacgguccccgagguggaggaggaguucauguacuccugcgacggcgacgagcggccccuccuggucaaggggacccugaucgccaucgacccguucgacgaccgccgggaggccggcggggagagcaccguggugaaccccaaguccggcagcuggaacuucuucgacugguucuccgggcucaugagcugguucggcggcccccugaagaccauccugcucaucugccuguacgucgcccuguccaucggccucuucuuccugcugaucuaccucgggcgcacggggcugagcaagauguggcuggcggccaccaagaaggccucc

SEQ ID NO: 13037 - RNA, 1521 nt, Artificial Sequence
  derived and/or modified CDS sequence (opt1) from RVFV(200803169)__JF311384.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaagguggaccagaccaaguuccugaagaucaagacggucagcuccgagcugagcugccgggaggggcaguccuacuggaccggcagcuucucccccaagugccucagcucccgccggugccaccuggugggcgagugccacgugaaccgcugccugagcuggcgggacaacgagaccuccgccgaguucagcuucgucggggaguccaccacgaugcgcgagaacaagugcuucgagcagugcggcggguggggcugcgggugcuucaacgugaacccgagcugccucuucgugcacaccuaccugcaguccguccggaaggaggcccugcgcguguucaacugcaucgacugggugcacaagcucacccuggagaucaccgacuucgacggcagcgucagcacgaucgaccugggcgcguccagcucccgguucaccaacugggggagcgugucccucagccuggacgccgagggcaucuccgggagcaacuccuucagcuucaucgagucccccggcaagggcuacgccaucguggacgagcccuucagcgagaucccccgccagggguuccugggcgagguccggugcaacuccgagagcuccgugcucagcgcccacgaguccugccugcgcgcgccgaaccuggugagcuacaagcccaugaucgaccagcucgagugcaccaccaaccugaucgaccccuucgucguguucgagcgggggucccugccccagacgcgcaacgacaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucguccugccgagcgagaacggcacgaaggaccagugccagauccugcacuucaccgugcccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13038 - RNA, 1521 nt, Artificial Sequence
  derived and/or modified CDS sequence (opt1) from RVFV(2007001811)__EU574040.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaugaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcaccaccaaccugaucgaccccuucgucguguucgagcgggggucccugccccagacgcgcaacgagaagaccuucgccgccagcaagggcaaccgcggggugcaggccuucagcaagggcuccguccaggccgaccucacccugauguucgacaacuucgagguggacuucgugggcgcggccgucagcugcgacgccgccuuccugaaccucaccgggugcuacuccugcaacgccggcgcgcgggugugccugagcaucacguccaccgggaccggcacccugagcgcccacaacaaggacgggucccuccacaucgugcugccgagcgagaacggcacgaaggaccagugccagauccugcacuucaccguccccgagguggaggaggaguucauguacuccugcgacggcgacgagcggccccuccuggucaaggggacccugaucgccaucgaccccuucgacgaccgccgggaggccggcggggagagcaccguggugaacccgaaguccggcagcuggaacuucuucgacugguucuccgggcucaugagcugguucggcggcccccugaagacgauccugcucaucugccuguacgucgcccuguccaucggccucuucuuccugcugaucuaccucgggcgcaccgggcugagcaagauguggcuggcggccaccaagaaggccucc

SEQ ID NO: 13039 - RNA, 1521 nt, Artificial Sequence
  derived and/or modified CDS sequence (opt1) from RVFV(Kenya 57 (Rintoul))__DQ380192.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacggucgaccugggcgcguccagcucccgguucaccaacugggggagcgugucccucagccuggacgccgagggcaucuccgggagcaacuccuucagcuucaucgagucccccggcaagggcuacgccaucguggacgagcccuucagcgagaucucccgccagggguuccugggcgagauccggugcaacagcgaguccagcguccucuccgcccacgagagcugccugcgcgcgcccaaccugaucuccuacaagccgaugaucgaccagcucgagugcaccaccaaccugaucgaccccuucgugguguucgagcgggggagccugccccagacgcgcaacgacaagaccuucgccgccagcaagggcaaccgcgggguccaggccuucuccaagggcagcgugcaggccgaccucacccugauguucgacaacuucgagguggacuucgucggcgcggccguguccugcgacgccgccuuccugaaccucaccgggugcuacagcugcaacgccggcgcgcgggugugccuguccaucacgagcaccgggaccggcacccuguccgcccacaacaaggacgggagccuccacaucguccugcccuccgagaacggcacgaaggaccagugccagauccugcacuucaccgugccggaggucgaggaggaguucauguacagcugcgacggcgacgagcggccccuccuggugaaggggacccugaucgccaucgaccccuucgacgaccgccgggaggccggcggggaguccaccguggucaaccccaagagcggcuccuggaacuucuucgacugguucagcgggcucauguccugguucggcggcccgcugaagacgauccugcucaucugccuguacguggcccugagcaucggccucuucuuccugcugaucuaccucgggcgcaccgggcuguccaagauguggcuggcggccaccaagaaggccagc

SEQ ID NO: 13040 - RNA, 1521 nt, Artificial Sequence
  derived and/or modified CDS sequence (opt1) from RVFV(Beijing-01)__KX611606.1__Gc
ugcagcgagcugauccaggccuccagccgcaucacgaccugcuccaccgagggcgugaacaccaagugccggcucagcgggaccgcccugauccgcgcgggcuccgucggggccgaggccugccugauguucgagggcgugaaggaggaccagaccaaguuccucaagaucaagacggugagcuccgagcugagcugccgggaggggcaguccuacuggaccggcagcuucucccccaagugccugagcucccgccggugccaccucgucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccuguucgugcacaccuaccuccaguccgugcggaaggaggcccugcgcgucuucaacugcaucgacugggugcacaagcugacccucgagaucaccgacuucgacggcagcgugagcacgaucgaccugggcgcguccagcucccgguucaccaacugggggagcgucucccugagccucgacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcugagcgcccacgaguccugccuccgcgcgccgaaccugaucagcuacaagcccaugaucgaccagcuggagugcaccaccaaccucaucgaccccuucgucguguucgagcgggggucccugccccagacgcgcaacgacaagaccuucgccgccagcaagggcaaccgcggggugcaggccuucagcaagggcuccguccaggccgaccugacccucauguucgacaacuucgagguggacuucgugggcgcggccgucagcugcgacgccgccuuccugaaccugaccgggugcuacuccugcaacgccggcgcgcgggugugccucagcaucacguccaccgggaccggcacccugagcgcccacaacaaggacgggucccugcacaucgugcucccgagcgagaacggcacgaaggaccagugccagauccugcacuucaccguccccgagguggaggaggaguucauguacuccugcgacggcgacgagcggccccugcucgucaaggggacccugaucgccaucgaccccuucgacgaccgccgggaggccggcggggagagcaccguggugaacccgaaguccggcagcuggaacuucuucgacugguucuccgggcugaugagcugguucggcggcccccucaagacgauccugcugaucugccucuacgucgcccuguccaucgggcuguucuuccuccugaucuaccugggccgcaccgggcucagcaagauguggcuggcggccaccaagaaggccucc

SEQ ID NO: 13041 - RNA, 1521 nt, Artificial Sequence
  derived and/or modified CDS sequence (opt1) from RVFV(ANK-6087)__DQ380216.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagaucaagacggugagcuccgagcugagcugccgggaggggcaguccuacuggaccggcagcuucucccccaagugccucagcucccgccggugccaccuggucggcgagugccacgugaaccgcugccugagcuggcgggacaacgagaccuccgccgaguucagcuucgugggggaguccaccacgaugcgcgagaacaagugcuucgagcagugcggcggguggggcugcgggugcuucaacgucaacccgagcugccucuucgugcacaccuaccugcaguccgugcggaaggaggcccugcgcgucuucaacugcaucgacugggugcacaagcucacccuggagaucaccgacuucgacggcagcgugagcacgaucgaccugggcgcguccagcucccgguucaccaacugggggagcgucucccucagccuggacgccgagggcaucuccgggagcaacuccuucagcuucaucgagucccccggcaagggcuacgccaucguggacgagcccuucagcgagaucccccgccagggguuccugggcgagauccggugcaacuccgagagcuccgugcucagcgcccacgaguccugccugcgcgcgccgaaccugaucagcuacaagcccaugaucgaccagcucgagugcuccaccaaccugaucgaccccuucgucguguucaagcgggggagccugccccagacccgcaacgacaagacguucgccgccagcaagggcaaccgcggggugcaggccuucuccaagggcagcguccaggccgaccucacccugauguucgacaacuucgagguggacuucgugggcgcggccgucuccugcgacgccgccuuccugaaccucaccgggugcuacagcugcaacgccggcgcgcgggugugccuguccaucaccagcacggggaccggcacccuguccgcccacaacaaggacgggagccuccacaucgugcugccguccgagaacggcaccaaggaccagugccagauccugcacuucacgguccccgagguggaggaggaguucauguacagcugcgacggcgacgagcggccccuccugguccgcgggacccugaucgccaucgaccccuucgacgaccggcgcgaggccggcggggaguccaccguggugaaccccaagagcggcuccuggaacuucuucgacugguucagcgggcucauguccugguucggcggcccgcugaagaccauccugcucaucugccuguacgucgcccugagcaucggccucuucuuccugcugaucuaccucgggcgcacggggcuguccaagauguggcuggcggccaccaagaaggccagc

SEQ ID NO: 13042 - RNA, 1521 nt, Artificial Sequence
  derived and/or modified CDS sequence (opt1) from RVFV(MP12)__Z30318.1__Gc
ugcagcgagcugauccaggccuccagccgcaucacgaccugcuccaccgagggcgugaacaccaagugccggcucagcgggaccgcccugauccgcgcgggcuccgucggggccgaggccugccugaugcucaagggcgugaaggaggaccagaccaaguuccugaagcugaagacggugagcuccgagcucagcugccgggaggggcaguccuacuggaccggcagcuucucccccaagugccugagcucccgccggugccaccuggucggcgagugccacgugaaccgcugccucagcuggcgggacaacgagaccuccgccgaguucagcuucgugggggaguccaccacgaugcgcgagaacaagugcuucgagcagugcggcggguggggcugcgggugcuucaacgucaacccgagcugccuguucgugcacaccuaccugcaguccgugcggaaggaggcccuccgcgucuucaacugcaucgacugggugcacaagcugacccuggagaucaccgacuucgacggcagcgugagcacgaucgaccucggcgcguccagcucccgguucaccaacugggggagcgucucccugagccuggacgccgagggcaucuccgggagcaacuccuucagcuucaucgagucccccggcaagggcuacgccaucguggacgagcccuucagcgagaucccccgccagggguuccucggcgagauccggugcaacuccgagagcuccgugcugagcgcccacgaguccugccugcgcgcgccgaaccucaucagcuacaagcccaugaucgaccagcuggagugcaccaccaaccugaucgaccccuucgucguguucgagcgggggucccucccccagacgcgcaacgacaagaccuucgccgccagcaagggcaaccgcggggugcaggccuucagcaagggcuccguccaggccgaccugacccugauguucgacaacuucgagguggacuucgugggcgcggccgucagcugcgacgccgccuuccucaaccugaccgggugcuacuccugcaacgccggcgcgcgggugugccugagcaucacguccaccgggaccggcagccucuccgcccacaacaaggacgggagccugcacaucgugcugccguccgagaacggcaccaaggaccagugccagauccuccacuucacgguccccgagguggaggaggaguucauguacagcugcgacggcgacgagcggccccugcuggucaaggggacccucaucgccaucgaccccuucgacgaccgccgggaggccggcggggaguccaccguggugaaccccaagagcggcuccuggaacuucuucgacugguucagcgggcugauguccugguucggcggcccgcugaagaccauccuccugaucugccuguacgucgcccucagcaucgggcuguucuuccugcucaucuaccugggcgggacgggccuguccaagauguggcucgcggccaccaagaaggccagc

SEQ ID NO: 13043 - RNA, 1521 nt, Artificial Sequence
  derived and/or modified CDS sequence (opt1) from RVFV(KEN/Bar-032/07)__HM586968.1__Gc
ugcagcgagcugauccaggccuccagccgcaucacgaccugcuccaccgagggcgugaacaccaagugccggcucagccacaccgcccugauccgcgcgggguccgucggcgccgaggccugccugaugcucaagggggugaaggaggaccagaccaaguuccugaagaucaagacggugagcuccgagcugagcugccgggagggccaguccuacuggaccgggagcuucucccccaagugccucagcucccgccggugccaccuggucggcgagugccacgugaaccgcugccugagcuggcgggacaacgagaccuccgccgaguucagcuucgugggcgaguccaccacgaugcgcgagaacaagugcuucgagcagugcgggggcugggggugcggcugcuucaacgucaacccgagcugccucuucgugcacaccuaccugcaguccgugcggaaggaggcccugcgcgucuucaacugcaucgacugggugcacaagcucacccuggagaucaccgacuucgacgggagcgugagcacgaucgaccugggcgcguccagcucccgguucaccaacuggggcagcgucucccucagccuggacgccgaggggaucuccggcagcaacuccuucagcuucaucgagucccccgggaagggcuacgccaucguggacgagcccuucagcgagaucccccgccagggcuuccugggggagauccggugcaacuccgagagcuccgugcucagcgcccacgaguccugccugcgcgcgccgaaccuggucagcuacaagcccaugaucgaccagcucgagugcaccaccaaccugaucgaccccuucgugguguucgagcggggcucccugccccagacgcgcaacgacaagaccuucgccgccagcaaggggaaccggggcguccaggccuucagcaagggguccgugcaggccgaccucacccugcgcuucgacaacuucgagguggacuucgucggcgcggccgugagcugcgacgccgccuuccugaaccucaccggcugcuacuccugcaacgccggggcgcgggugugccugagcaucacguccaccggcaccgggacccugagcgcccacaacaaggacggcucccuccacaucguccugccgagcgagaacgggacgaaggaccagugccagauccugcacuucaccgugcccgaggucgaggaggaguucauguacuccugcgacggcgacgagcgcccccuccuggugaagggcacccugaucgccaucgaccccuucgacgaccggcgcgaggccgggggcgagagcaccguggucaacccgaaguccgggagcuggaacuucuucgacugguucuccggccucaugagcugguucgggggcccccugaagacgauccugcucaucugccuguacguggcccuguccaucggccucuucuuccugcugaucuaccucgggcgcaccggccugagcaagauguggcuggcggccaccaagaaggccucc

SEQ ID NO: 13044 - RNA, 4020 nt, Artificial Sequence
  derived and/or modified CDS sequence (opt1) from SFNV(Toscana)__NC_006320.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgacugcaagcgggacaucaugagcaacuacguggccgaggugcacuccaaccuccacggccugggcgccaugaugcacaacuacggggacgacaagcgcgucgaggugcugaacgacgugauccccgacgagcucaacccgggccggcacaacugcagcgaccuggaccgcaagcccuucuggaccgaguucaucaacgucgccaagcccgccaacaagaucgcgcccaucuccgugaucccgccgcccaucgugaagcccaucccgaucgccgagagcaccaucaagaagaccauccccuucgacaagcugcucuccgaggccgagaaggagcugaaccagacgaagauccggcuggagaccgagcgccggagcaacgccgaggaggcggcccgcgagcgggcccgcaugcgggagaucgaggacaagcuccgcaagaacugggagcuggagcgggagcgcaaggacgccgucgccgacgaccuggcgaaggagaucgcccggcgccgggagaucgagcgcaaggcccacgagcucgacaagaugcugaagaagaaggagcgggaggaccagguggccaucgagcgcguguccgaggacaugcgcaaccacguccggcgccccaacaccaccaucgcccccgcgccgacgaucaucaccacccugcucauggccagcgccgugauggccgggccccuggagaaccgggagaccaaccaccuccugaaccgccccggcaacggggccuacacgcuguccgacuucgcggagagcacgugcacccuggccuacggcagcaagugcaaguccugggagcaccagcucgacgagcugagcuuccccuucuuccacuccaaccuggacaaguacagcaugcucgaggccgccaccgagaccaucccgauccugaacaaguccagcgccgugugcaccaucucccccagcacccacuccagcaacgcgugcggccgggaggccucccugaucaagaagaagugcgggaacaacaugagcgccuucuucuacgucaaccucgccggccagaucaccguggugaagugcgacacgaaccacguccuguccaacgacugcgggaacugcaucagcaagacccuguccggccagaagaucuacacccccgugcaggacauguucugccagcgcggcuggaccgagagcauccccuccacgcgguacagcaaggaccucugcuccaucgggcugcacaccgugaaggagugcaagaccggcaccacgaacuucgagcgcgucggguucaucguggucaagagccggaagauguacaucgagcagaugaagaugcgcagccggcaggaguucuccgaggaccaguuccugugcuacaagagcgaguccagcuccggcagcuccgugaagcucaagaaggugaaggucgagagcugcaagggggugaccaccuccagcgcguccaagugcagcggcgacgaguacuucugcucccgcuacccgugcgagaccgccaacguggaggcccacugcauccugcggcgccacagcgccgucaucgaggugaacgugaacggcgucuggguggugccccggugcaucggguacgaggagguccuggugcgccggacgucccucaagauggaggacaccagcucccgcgagugcgacacgugccugugggagugcggcaagaacaagcugaucgugaagacccacgggcccaagaucgucuacgccaccgcgugcagccacggcagcugcaaguccgugaugcagaagcccgccaccuucguguaccucccguaccccgggaacagcgagaucgucggcggcgacaucggggugcacaugaccgaggaguccagccccuccaacauccacaugguggcccacugccccgccaaggacagcugcgaggucuccagcugccuguucugcgugcacggccugcugaacuaccagugccacacccucuucuccgcccugcugaucagcaccacggugauguccauccucacccugcugcuccugcuggucaagggggcgaaggaccucgugaagaagcuguucuacuggcugaucaccccgcucugcuggcugagcguguucugcggcuggaugaucaaguccuggaagaagaaggucgggagcgccaucucccggaccaacgacacgaucggcuggcgcgacaaccgccgguacggccgcgacguggagcgggcccaguacaccgggggcgcccccggggccaaguacagcuucuacggcgugaugauccugggccuccuggggaacguccacuccugcagcgaguccgugaucgcggacagcaaggugaugcagugcaccaccagcggcuccagcacgcugugcaaggccuccgggaccgucaucaugaagcucggccccaucgggagcgaguccugccugauccugaagggccucaaggacaacgagaagcaguucaucagcaucaagaccaucuccagcgagcugaccugccgcgagggcgaguccuucuggacgacccuguacaccccggugugccucagcucccggcgcugccaccugaugggggagugcugcagcgaccggugccugaaguggaagaccaacgagacguccgccgaguucaccggcaaggcccacggggaggugaugcacgagaaccgcugcuucgagcagagcggcgggaucggcuacggcugcuucaacgucaaccccuccugccucuacgugcacagcauccugaaguccguguacaagaacggguucaagaucuuccggugcgucgcguggaaccaccgcauccggcuggaggugaccacccacagccgcaaguuccccauggugcucauggccauguccacgcagcccaccgacuggggcagcaucgggcugauccuggacagcgagggcaucaccgggaccaacgccuacuccuucaugaagcacggcagcggcucccucgccaucaucgacgacccguacagccccgagccccggaagggguuccugggcgagguccgcugccccacggaggagaccgccauccgggcguccccgagcugcaagauggcccccaaccugaucgaguaccagcccgagauggacaccgccgagugcaccacgaacaugaucgaccccauggccaucuucaaccgcgggucccucccccaggugcgggacggcaugaccuucacccagagcaucgagaagaacaccgugcaggcccugacgaccggggagguccgcgcguccauccggcugacccucgacgacuacgacgugguguaccacaacagccaguccgacugcagcgccaccuucaagaaccugaccggcugcuacuccugcgacgagggcagccgcaugugcuaccaggucaaggccgagggggagacgaucuuccacuucgugaacgaggacgaguccaucaacgugaucaacaaggucagccccgacguguccgacuacugcaccgugcugcacuucagccggcccgucaucuccaucgagggccgcuacgacugcgggcucagcaagagccccauggugaucaagggcacccugaucgccaccgccccgcacgacgaccgcaagcacgagggcggguccagccuggucgugaaccccaagggcgggacgguggacuucuucggcugggucuccgggcucaccagcuggcugggcggcccccugaagaccuuccucaccauccugggguuccuggcgcucggccugcugcucguggugaucaucaucacgaucgcccggaccggggucgagcaggcccugaagaagaagaacaaguga

SEQ ID NO: 13045 - RNA, 3972 nt, Artificial Sequence
  derived and/or modified CDS sequence (opt1) from SFNV__HM566171.1__GP
augcugaacaccaagagcaucauccucaucacgugccuggugcagcagguccaccugaaguacacgaucaucuccgaggugaccaagggcgcccgcgaggugagcugcuacuccagcaccacccggcucgaccagcugcuggaggccugggagaacaaguccgcgcucauggggcugcgcaagggcaacugcaagcugggggccauggagcaggucgacugcaaccucgaccugaugagcaacuacguguccaacguguacgacaacccccacggccugggggccaugauguacaacgacaagcggaucgagguccucaacgaccagaucccggacagcaugauccccggcggccacaacugcucccugcuggagcgcaagcccuucugggccgaccucauccccagcaagaaggagaacccgcggcccucccugaucagccuggugcccacgccccgcuccgacuucaagcggaaguucgaggaggccgaggaggagaugaagaagauccgcaaggagcuccaggacgagcggcaggcgcagcugagcgugaucgaggaggggcgcaagcggaugcgcgaccuggaggacaagcucaugcggcaguggaacgaggagaagcagaagaagggccugcuggaggagacccucgagaagaagcgccagcugaagaacaaggcccugcucgacgcccacaaccuggacaagcagcugaaggagaaggaccgggaguucaagaccgccauggaggagcaccagaacgagcgccaccggaucaacuccaacaugauccgcccgcccaucaccacgcccgcggccgucauccucaccagccugcuguccgccagcguggugcucggguucgagcuggagaaccggaacaccaaccacgcccugaaccgccccggcaacgggggcuacuccaucagcgacaacaaccucaucgaggccaagugcaugaucaccuacggcaacaagugcccgagcugggagaugcagcuggaccccgucuccuaccccuucuucagcuccaacuucgagaaguacagccugcucgaguccaucagcgagacgucccccaucaucgggaaguucagcgaggugugcgugcuguccaaccugccgggcgcgcagaagaccugcgccaaggaggccagccucaucaagaagcagugcuccgacgacaugcgggccuacuucuacaucaacagccuggggaagcuggccaucgugaccugccccgagaacaacguccucucccaggacugcaacuucugccugcgcaaggcgaagggcgagcaguacguguacaagcccauccaggacggcuucugccagaacgggggcgucagcuccgugcccagcauccgcuacuccaaggacaucugcagcaucgggccgaccaaggugaagaacugccacaagggcacgucccgguacgagcgcaccgccuucaucagcaccggggacaagaaggucuaccuggaggagaucaagauccggagccgccaggaguacgagcccgaccaguuccucugcuacaaggugaaggacuccagcuccagcccccuggccuacgagaaggugcaggucuccaagugcaagggcaucgagaccaacagccccaagaagugcacgggcgacgaguacuucugcuccaaguacccgugcgagagcaccucccccgaggccaacugcuuccugcggaagcacagcgccauccuggaggugaacaucgggggcauguggaucaagcccaagugcaucggguacgagauggcgcucgucaagcgcgugggccugcgguccgaggacgugagcuccaaggagugcgcgaccugccugugggagugcagcuccggguacaucagcaucaccacgcacggccccaagaucuccuacgccaccgccugcagccacggcagcugcaaguccaucguccagaacccgagcaccuccauccgcaucagcuaccccgggaacuccgagaucgugggcggggacaucggcauccaccucaccgaggacagcucccccaucaaccugcaccugaagauccacugcagcccgaaggacuccugcgaggugagcgacugcaucuucugcguccacgggcuccugaacuaccagugccacuccguggccagcgcccugcuccuguccacgaucaccgccagccugaucgugcucaugaucuacaugcuguccaagaccaaguucgucaugaagaagcugauccccaucaugcucacgccccugugcuggugcuucgugcugcucgccuggcugaccaagagcuggaagggcaagaugcggaacgccauccaguccgcgaacagcaccaucggcuggaccgagcgcgaggagcggaucguggccgagcgcccccggucccgcaacaccguccgguacagcuucuacgggguggugauccuggccaugcucgagagcgccuucggcugcuccgagagccugaucgccgaguccaaggucaugcagugcaacaucgcgaacgggaagaccagcugccgcgccuccggcaccaucaucaugaagcugggcccgaucgggagcgaggccugccucauccugaagggccugcgggacuccgacaagcaguacaucagcgugaagaccgaguccagcgagcucaucugccgcgagggggaguccuucuggaccagccuguacacccccgugugccuguccagccggcgcugccaccucaugggcgagugcacgggggaccugugccugaaguggaaguccaacaagaccagccucgaguucgccggcaagacccgcuccgacgucaucaacgagaacaagugcuucgagcagagcggcgggcugggcuacgggugcuucaacgugaaccccuccugccuguacacccacgccuaccucaagagcguguaccggaacggcuuccgcgucuucaagugcgcgagcuggacgcaccgggugaagcugaccaucaccacccacucccgcacguuccccaugacccuggccgccaugagcacccagccgaccgacuggggguccaucggccucauccuggacagcgagggcaucuccgggacgaacagcuucuccuucaugaagcacggccuggggagcuucgccaucaucgacgagcccuacuccauggagccccggaagggcuucaucggggaggugcgcugccccaccgaggaggccgcgaucaaggccagcacccucugcaagaccgccccgcagcugaucgaguaccagcccgagauggacuccgccgagugcacgaccaacaugaucgaccccaugagcgucuucaaccggggcucccugccccaggugcgcgagggcaugaccuucacccagagcauggagaagaacacggugcaggcgaugaccaccggggagguccacgccuccauccggaucgugcucgacgacuacgagguggaguaccugagcucccaggucgacugcgacgccaccuucaagaaccugacgggcugcuacagcugcgacgagggggcccgcgugugcaugcagaucaucgcccacggcgacaccaucuuccacuuccggaacccggacguguccaucaacauccuccagaaggucaacaccaacacccugaucuacugcagcguggugcacuucagcaagcccgucaucaaggaggaggggacguacgacugcggcgcgggcgagaagcccaugauccugaaggggacccucguggccgugagcccccacaacgaccgccuggagcagggcggguccuccaucgucaucaacccgaagggcggcgggguggacuuccugggcuggcucagcggguucuccagcugguucggcgggccccugaaggccauccugauggugaucggcuuccuccugcugggccucauccuguucgucaccaucgccaucgggcugaaguucgcccuccggcagaugaucgugaagcgcaugaaguga

SEQ ID NO: 13046 - RNA, 3873 nt, Artificial Sequence; identical to SEQ ID NO: 12729
  derived and/or modified CDS sequence (opt1) from SFNV(Namru)__HM566169.1__GP

SEQ ID NO: 13047 - RNA, 3990 nt, Artificial Sequence
  derived and/or modified CDS sequence (opt1) from SFNV/SFNV-like(Poona)__HM566177.1__GP
augcugaacgucaagagcgucauccucaucacgugccuggugcagcaggcccaccugaaguacaccaucaucuccgagguggccaagggcgcgcgcgaggucagcugcuacuccagcaccacccggcucgaccagcugcuggaggccugggagaacaaguccgcccucaucgggcugaagcgcggcaacugcaagcugggggccauggagcagaucaacugcaaccucgaccugaugagcaacuacguguccaacguguacgacaacccccacggccugggggccaugauguacaacaccgacagcgacaagcggaucgagguccucaacgaccagaucccggacuccaugauccccggcggccacaacugcagccugcuggagcgcaagcccuucugggcggaccucaucccgccgaagaaggagaaggagcuggaccccaagcccucccugaucagccucgugcccaccccgcgggacgacuucaagaagaaguucgaggaggccgaggaggagaugaagaagauccgcaaggagcugcagaacgagcggcaggcccagcuguccgugauggaggacagccgcaagaagaugcgggaccucgaggaccgccugaugcggcagugggaggaggagaagcagaagaaggggcugcucgaggagacgcuggagaaggagcgccagcugaagaacaaggcccuccuggacgcgcacgaccuggacaagcagcucaaggagcgggaccgcgaguucaagaccgccauggaggagcaccagaacgagcggcgccggaucaacuccaacaugauccgccccuacgucaccacccccgccgccaucauccugacgagccugcucuccgccagcgugguggucggcuucgagcuggagaaccggaacaccaaccacgugcugaaccgccccgggaacggcggguacuccaucagcgacaacaaccucaucgaggcgaagugcaugaucaccuacggcaccaagugccugagcugggagaugcagcugaacccgguguccuaccccuucuucagcuccaacuucgagaaguacagccuccuggaguccgucagcgagacgacccccaucaucggcaaguucuccgaggugugcgugcugagcaaccucuccggggcccagaagaccugcgccaaggaggccagccugaucaagaagcagugccccgacgacauccgggccuacuucuacaucaacucccugggcaagcucgcgaucgugaccugcccggagaacaacgugcugagccaggacugcaacuucugcgugcccaaggccaagggggagcgcuacaucuacaagcccauccaggacggcuucugccagaacggcggggucuccacggugcccagcgugcgcuacuccaaggacaucugcagcaucggcccgcugaaggucaagaacugccacaaggggaccucccgguacgagcgcaccgccuucaucagcaccggcgacaagaagguguaccucgaggaggucaagauccggucccgccaggaguacgagcccgaccaguuccugugcuacaaggugaaggacgggagcagcagcccccugguguacgagaagguccaggugagcaagugcaagggcaucgagacgaacucccccaagaagugcaccggcgacgaguacuucugcagcaaguacccgugcgaguccaccagccccgaggccaacugcuaccugcggaagcacuccgccaucaucgaggugaacaucgggggcaugugggucaagcccaagugcgugggguacgagauggcgcucgugaagcgcgucggccugcggagcgaggacgugucccugaaggagugcgcgaccugccucugggagugcagcuccagcuacaucuccaucacgacccacgggcccaagaucagcuacgccaccgccugcucccacggcagcugcaaguccgugguccagagcccgagcaccuccaucaagaucagcuaccccggcaacuccgagaucgucgggggcgacaucgggauccaccugacggaggacagcucccccgugaaccugcaccucaagauccacugcccgcccaaggacagcugcgagguguccgacugcauccugugcgugcacggccugcucaacuaccagugccacagcguggccuccgcccugcugcucagcaccaucaucgccucccugaucgcccuggucguguacaugcucagcaagacccgcuucgugaugcggaagaucguccccaucauguucauccccuucugcuggugcuucgugcugcuggccuggcucacccgcuccuggaaggggaaggugcggaacgcgauccagagcgccaacaacacgaucggcuggaccgagcgcgaggagcgggucaucgccgagcgcccgggcgggcggaacaccauccgcuacuccuucuacggcguggugauccuggccauccuggagagcgccuucgggugcuccgagagccucaucgcggaguccaagaucaugcagugcaacaucgccaacggcaagaccagcugccgggccagcggcacgaucaucaugaagcuggggcccaucggcuccgaggccugccugauccucaaggggcugcgcgacagcgacaagcaguacaucuccgucaagaccgagagcuccgagcugaucugccgggagggcgagagcuucuggaccucccucuacacccccgugugccugagcucccgccgcugccaccugaugggggagugcaccggcgaccucugccugaaguggaaguccaacaagacgucccuggaguucgccggcaagacccacagcgaggugaugaacgagaaccggugcuucgagcaguccgggggccucggguacggcugcuucaacaucaaccccagcugccuguacacccacgcguaccugaaguccgucuaccgcaacggguuccggguguucaagugcgccagcuggacccaccgcgugcggcucacgaucaccacccacucccgcaccuucccgaugacgcuggccgccaugagcacccagcccaccgacuggggcuccaucggccugauccucgacagcgaggggaucagcggcaccaacuccuucagcuucaugaagcacgggcugggcuccuucgccaucaucgacgagcccuacagcauggagccccggaagggguucaucggcgagguccgcugcccgacggaggaggcggccaucaaggccuccacccugugcaagaccgcgccccagcucaucgaguaccagcccgagauggacagcguggagugcaccacgaacaugaucgaccccauguccaucuucaaccggggcagccugccccaggugcgcgaggggaugaccuucacccaguccauggagaagaacaccguccaggccaugacgaccggcgaggugcacgccagcauccggcuggugcucgacgacuacgaggucgaguaccuguccaaccagguggacugcgacgccaccuucaagaaccugaccgggugcuacagcugcgacgagggcgcccgcgugugcaugcagaucaaggcccacggggacacgaucuuccacuucaagaacuccgacaugagcaugaacauccuccagaaggucuccaccaacacccugaucuacugcagcguggugcacuucuccaagcccgucaucaaggaggagggcguguacgacugcggcgcgggggagaagcccaugauccugaagggcacccucguggccgucagcccccacaacgaccggcuggagcagggcggguccagcaucgugaucaacccgaagggcagcgggguggacuuccugggcuggcucuccggguucagcuccugguucggcgggccccugaaggccauccugacggucaucggcuuccuccugcugggcuuccuccuguucaugcuggugaccaucgggcuccgcuacgcccugagccaggucgugaccaagaagaugaaguga

SEQ ID NO: 13048 - RNA, 4002 nt, Artificial Sequence
  derived and/or modified CDS sequence (opt1) from Arrabida virus(PoSFPhlebV/126/2008)__KP863800.1__GP
auguucuacgccaaguucauccugcuccugugcuucgugcagggcgcccugcucaaguacaccaucaucagcaaggucggguccagcaccuacaagcgcgugugccugucccacacgaccgaccuggacacccuccuggacaugaccagccgggagauguccaacaucaagcugacgggcgggagcugcucccucggcgaccugaccaagcccgacugcagcccggacuucuucuccaacuacguggcgaacauccagagcuccaacaccaagaucaccgggaaguuccaggacaucaucggcgagcgcgagauggaggucacgaacgacguggugcccgacagcuucggccccgggccccacgacugcgucuccuucgacaagaagccguucuggagcgaccugcuccccaccuccgugagcaaggaggagcccaagcccaucaucuccacccugagcgugcugccggccgccccgcccaucaaggacuucucccacaaggucguggaggccgaggagauggugaaggagaucgagggcgagcucaugaaggagaaggagcggaacagcgccaaggaggaggaggcgcgccagcggaugcgcgagcuggaggacgaccugcggaagcagugggccgccgagcgcauggccaagcagaacaugagcuccguccucgagcgggagcgccaggagaagcagagccuggagcggcgcaugcacgagguggacaagaagcugcgggcguccgaggaccgcgcccagaaguaccaggagcgggccgagcaggccgagaagucccacuccaagcuccugagccgcuccggggccgcgaccacgauggccaccguggucuucaccagccugcucgccuccggccuggccguggugaccgagcuggagaagcgggacacgaaccaccuccugaaccgccccgggaacggcgucuacauggccaacgcggacagccugauccagaccgagugcacccucaacuacggccagcggugccuggccugggagcugcagaucacccccgugcgcuaccccuucuucacguccaacguggacaaguacagccuccuggaguccaucaccgagacccccagcauccuggagaagaacaacgaguccugccagcucgccaccacgagcgggucccugaagaccugcgccaaggaggccagcaccaucaagaagcacugcaccgacgacguccgggcguucuucuucaucaacuccgugggcaagcugacgaucgugcgcugcgccgacaaccacauccucagcgaggacugcaacuucugcaucagcaaggcccgcaacuccaaccagaacauguucaugcccguccaggacgccuucugccagcggcaggggagcgacaccgccccggcgauccgcuacuccaaggacaucugcagcaucggcgccaucaagaucaagcagugccacaaggccaccuccaaguucgagcggaugggcuucaucagcguggggcagaagaagcuguacaucgaggagcugaagcuccgcuaccggcaggaguacgaccccgaccaguucaugugcuacaagaucaaguccagcagcccccugaaguacgagaaggucagcuccaagaagugcaaggagguggacaccggcgggaaccagaagugcagcggcgacgagcacuucugcaaccgcuaccccugcgacacggccaacccggaggcgcacugccugacccggaagcacuccgccaucgccgaggugaacaucgggggcgucuggauccgccccaagugcgugggcuacgagauggugcucgucaagcggagcgggcugaaguccgaggaccugagcauccgcgacugccccuccugccucugggagugcaagaagucccggaucaccaucaagacccacggccccaagaucgugagcgccacggccugcagccacgggagcugcaaguccgugaugcagaagccgagcaccuucgucgagauccccuaccccggcaacuccgagaucaucgggggcgacaucggcgugcacaugaccgagcgcgggagccccuccaacauccacgugcggacccacugcccgccccgcgacagcugcgacgucuccgacugcauguucugcgugcacggcauccugaacuaccagugccacacccuggcgagcgcccugacgaucgccaccaucguguccgccguccucgugguggucuacuuccugcuggcccggagcaagcgcgcggugaaguucaucaccucccuccugaucgugcccuucaaguggcugacccuccugagcaucugggucgugaagaacuggaagcggaagauguccaagcuggcccgcgccacgaacaacgccaucgggugggaccaggacguggagcggggccgcccgcgcgccgcggccgggcaccagaaccaggucgcccgguacaccuucuacggcgccaccauccucagccugaugaccuccggccugugcugcacggagagcgugaucgcggaguccaacaucaugcagugcaccaccagcgacagcaccacgaccugcaaggccuccgggaccaucauccuccgccugggccccaucgggagcgaguccugccugauccucaagggccugcgggacagcgagaagcaguucaucuccauccgcaccgugagcuccgagcugacgugccgggagggcgacagcuucuggaccucccucuacacccccaucugccugagcucccgccggugccaccugaugggggagugcaccggcgacaacugccucaaguggcaggacaacaagacgagcuccgaguucaccgggcgcacccacagcgagguccugcacgagaacaagugcuucgagcaguccggcgggaucggcuacggcugcuucaacgugaaccccagcugccugauggugcacuccuaccucaagccgaucuacaagaacgccuucaaggucuuccggugcguggccuggaaccaccgcgugaagcuggccaucaccacgcacaagaaguccuucgacgucacccugauggcgaugagcacccagcccaccgacugggggagcaucggccucauccuggacagcgaggggaucacgggcaccaacuccuacagcuucaugaaguacggggugggcuccuucgccaucaucgacgagcccuucagcaucgagccccggaagggcuuccugggggaggugcgcugcccgaccgaggagaccgccgucaaggccucccccagcugcaaggccgcgccccagaucaucgaguaccaccccgagauggacacgguggagugcaucaccaacaugauggacccgauggccaucuucaaccggggcucccucccccaggugcgcgacggggucaccuucgcccagagcaucgagaagaacuccgugcaggcccugaccacgggcgagaucaaggccagcgugcggcugguccucgacgacuacgagguggaguacaagguguccgagaacgacugcgacagcaccuucaucaacaucaccgggugcuacuccugcgacgagggcgcgcgccugugcguccggauccgcacccugggcgacagcaucuaccacuucaccgacuccgaggacaugaugaacgugauguucaaggugaacagcuccgucacggaguacugcaccgugcuccacuucagcaagcccguggucaacuucgaggggaaguacgacugcggcaagucccggaagcccaugaucaucaaggggacccugaucgccauggccccgcacgacgaccgcgugcacagcggcgggagcuccaucgucgugaaccccaagagcaagggcguggacuuccugggcuggcucuccgggcugagcuccuggcugggcgggccccucaagaccguccugacggugcugggcuuccucauccugggccugguguucgucaucguggugaucuuccucguccggguggggauccgccaggcccugcugaagaagaugaaguga

SEQ ID NO: 13049 - RNA, 4005 nt, Artificial Sequence
  derived and/or modified CDS sequence (opt1) from Massilia virus(127)__KT906100.1__GP
auguucuacgccaaguucgugaucagccugugccucgagcccggcuucucccugaaguacaccaucaucagcaaguccgggagcggcaccauccgccagaucugccugucccacagcacggacaucgacaagguccucgagcuguccagcggggagaugaacaccaucggcauccucgggggccugugcaccuucggcgagcugaagcgggaggacugcuccccggacguguucagcaacuacguggccaacauguacgggaccgcgcaccccuccagcugcaaguucgucgacaucacgggcgaccgcuccaucgaggugcugaacgacgccgugcccgacagcuucacccccggggcccacaacugcuccagcuucgagaagaagccguucuggaccgaccucauccccgccaagaacuccagcggcgccauccccuccgucgugagcgugcugcccagcgucgcggagcacgacuucaaccugaaggugaaggaggccaacgacaagcucgaggugauccagcgggagcuggccgccgagaaggcgcgcuccgggcggcuggaggacgaggcccgcgccaagaugaaggcccucgaggacgagcugcggaacggcuggcuggccgagcgcgaggcgaaggagcucgccaagagcgcccuggagaaggagcggaucaacaagcuggaggucgagcgcaagcuccacgaccugggcaagaagcugcggcaguccgaggacgacguggagaagaugcgcgugcaccacaagaaggggcggaaggagagcgacgaggagaugaagaucgcccgcaccacggccccguccgucagcaccacccucgcgaccgugguguucacgucccugcuggccaccggccucgccgccaucgagcccaucgaggaccggaacgucaaccacauccugaaccgccccgggagcggcguguacauggccucccccacccugacccagaacgagugcagccucgacuacggcaaggagugcaaggcgugggagcuccagguguccccgcugcacuaccccuucuucacgagcaacgucgacaaguacaccuuccuggaguccaucacccugcugccgcccauccuccugaucaacaacgaguucugcgagcugaccacgagcuccgggccccucaagcagugccagaaggagagcucccugaucaagaagugcugcaccgaggacgcccgggccuacuucuucaucgaccuggagggcaagcucagcaucgugcacugcuccaacaaccaggugcugagcgaggacugcaacuucugcgucaccaagagcgggggcgugucccacaagaucuucaugcccauccaggacgccuucugccagaagggcgggagcgaguccauccccgucgugcgcuacagcaaggacaucugcuccaucggccugagcaaggugaaguccugccacaagagcaccucccgguacgagcgcaugggguucaucgucgccggcaagaagaagcucuacaucgaggaccugaagaugcgguaccgccaggaguacgacgaggaccaguucuucugcuacaaggugaacaagacgagcccccuggaguacgggaaggaguccccgagcaagugcaagggcgugggguccaacgagcagaagugcaacggcgacgaguacuucugcaaccgcuaccccugcgagaccaacagccccgaggcgcacugcucccuccggcgccacgccgccgucguggagguguacgucggcggggccuggaucaagcccaagugcgugggcuacgagaaggugcuggucaagcgcgggggccugaagaccgaggaccugagcgugcgggagugcaccuccugccucugggagugcgagaagaacaagaucgugaucaagacgcacgggccgaagaucgucagcgcgaccgccugcggcggccggagcuggaaguccgugaugcagaagcccagcaccuuccuggaccugcccuaccccgggaacuccgagaucaucggcggggaccgcggcaaccaccucagcgagcggggcuccccguacaacauccacagcaccauccacuccccgcccgaggacagccgcgacgccuccgacugcaucuacugccggcacgggcugcugaacuaccagagccacuccguggagagcgccauccuccuguccacggucguggccaccauccuggcgcucaccggcgugguccugagccgcuccaagagcgccgugcgguuccuggccuccgccguggccguccccuuccgcugggugagccuccugguggucugggugaugaagaaguggaaggcgcggguggccaccgccauccgcgccacgaacaacgccaucgggugggacaacggccuggagcaggcgcgggucgagaacgccgcccgccggcagcagaccgccgggcgcuggcggucccucgacgcgagcaccauccugagcgugcuguccaccggccucugcugcaccgagagccugaucgccgaguccagcaucaugcagugcacgaccggcgagggguccacgaccugcaaggccaccggcaccgugguccugaagcucgggcccaucggcagcgaguccugccugauccugaaggggcuccgcgacaacgagcgccaguucaucagcaucaagaccaucuccagcgagcugaccugccgggagggcgaguccuucuggacgccccuguacacccccgugugccucagcucccgccggugccaccugaugggcgagugcaccggggacaugugccugaaguggaaguccaacaagaccagcagcgaguucacgggcaagacccacuccgaggugauccacgagaacaagugcuucgagcagagcgggggcaucggguacaugugcuucaacgucaacccguccugccucauggugcacagcuaccugaagcccaucuacaagaacgccuucaagguguuccgcugcaucgccuggaaccaccggguccgccugggcaucaccacccacaagcggaaguucgaggugacgcucauggcgaugagcacccagcaggccgacuggggcuccaucgggcugauccuggacagcgagggcaucuccgggaccaacagcuacuccuucaugaagcacggccucgggagcuacgccaucaucgacgagcccuacuccguggagccccgcaagggcuaccugggcgagguccggugcccgaccgaggagacggccaucaaggccagccccuccugcaagguggcgcccgggcugguggaguaccagcccgagauggacacccucgagugcaccaccaacaugauggacccgauggccaucuucaaccgcggcagccugccccagguccgcgggggcuggacguucucccagagcaucgagaagaacucccggcaggcccugaacaccggcgccaucaacgccagcgugcggcacgugcucgacgaguacgaguucgacuacaaggucaagaccaacgacugcgacuccaccuucgugaacaucacggggugcuacagcugcgacgagggcgcgcgccugugcgugaagguccggaccuccagcgaggccaucuaccacuucaccgacuccggguacaacaucaacgugcuguucaaggucgagagcggcgugcacgaccacugcaccauccuccacuucagcaagcccgugaucuccaucgaggggaaguacgacugcggcaagaacaagaagcccaugcugaucaagggcacgcugaucgccauggccccgcacgacgaccgcgucgugagcgggggcuccagcaccguggucaaccccaaggggcagggcguggacuuccucggguggcugucccggcugagcuccugguucggcggcgggccccucaagaccuuccugauggugaccggcuuccugaugacgggggucaucggcgggaucgugaccaucauccucauccgcaucgugcugcagcaggcgcuggccaagaaggucaaguga

SEQ ID NO: 13050 - RNA, 4005 nt, Artificial Sequence
  derived and/or modified CDS sequence (opt1) from Massilia virus(130)__KT906101.1__GP
auguucuacgccaaguucgugaucagccugugccucgagcccggcuucucccugaaguacaccaucaucagcaaguccgggagcggcaccauccgccagaucugccugucccacagcacggacaucgacaagguccucgagcugucccgcggggagauggacaccaucagcauccugggcgggcucugcaccuucggcgagcugaagcgggaggacugcuccccggacguguucagcaacuacguggccaacauguacggcaccacgcaccccuccagcugcaaguucgucgacaucaucggggaccgguccaucgaggugcugaacgacgcggugcccgacagcuucacccccggcgcccacaacugcuccagcuucgagaagaagccguucuggaccgaccucauccccgccaagaacuccagcggggccauccccuccgucgugagcgugcugcccagcgucgccgagcacgacuucaaccugaaggugaaggaggcgaacgagaagcucgaggugauccagcgcgagcuggccgccgagaaggcccgguccggccgccuggaggacgaggcgcgggccaagaugaaggcccucgaggacgagcugcgcaacggguggcuggccgagcgggaggccaaggagcucgccaagagcgcccuggagaaggagcgcaucaacaagcuggaggucgagcggaagcuccacgaccugggcaagaagcugcgccaguccgaggacgacguggagaagaugcgggugcaccacaagaagcgccggaaggagagcgacgaggagaugaagaucgccaagaccacggccccguccgucagcaccacccucgccaccgugguguucacgucccugcuggcgaccggccucgccgccaucgagcccaucgaggaccgcaacgucaaccacauccugaaccggcccgggagcggcguguacauggccucccccacccugacccagaacgagugcagccucgacuacgggaaggagugcaaggccugggagcuccagguguccccgcugcacuaccccuucuucacgagcaacgucgacaaguacuccauccuggagagcaucacccaguccagccccauccugcugaagaacaacaacuccugcgagcucaccaccagccccggcacgcagaagcagugccagaaggaguccagcaccaucaagaaguacugcaccgacgacgcgcgcgccuacuucuucaucgaccuggagggcaagcugagcaucgugcacugcaccaacaacuacauccucuccgaggacugcaacuucugcgugagcaagcugggggaggucggccacaagaucuucaugccgauccaggacgccuucugccagaagggcggguccgagagcauccccaucgugcgguacuccaaggacaucugcagcaucgggcuguucaagaucaagaacugccacaaguccacgagccgcuacgagcggaugggcuucaucgucgccggcaagaagaagcucuacaucgaggagcugaagaugcgcuaccgccaggaguacgacgaggaccaguucuucugcuacaaggugaagaagaccagcccccuggaguacgccaaggugagccccuccaagugcaagggggucggcagcaacgagcagaagugcaacggggacgaguacuucugcaaccgguacccgugcgagaccaacucccccgaggcgcacugcagccuccgccggcacgccgccgugguggaggucuacgugggcggggccuggaucaagcccaagugcgugggcuacgagaagguccuggugaagcgcggcgggcugaagaccgaggaccucuccgugcgggagugcacgagcugccugugggagugcgagaagaacaagaucgucaucaagacccacggccccaagaucguguccgcgaccgccugcgggcacggcagcugcaagagcgugaugcagaagccguccaccuuccuggaccugcccuaccccgggaacagcgagaucaucggcggcgaccgcgggaaccaccucuccgagcggggcagccccuacaacauccacuccacgauccacugcccgcccgaggacagccgcgacgccuccgacugcaucuacugccggcacgggcugcugaacuaccagagccacuccgucgccagcgccauccuccuguccaccgugguggcgaccauccuggcccucaccggcgucgugcugagccgcuccaagagcgccgugcgguuccuggccuccgccgucgcggugcccuuccgcugggugagccuccuggucgugugggugaugaagaaguggaaggcccgggucacgaccgccauccgcgccaccaacaacgccaucggcugggacaacgggcuggagcagguccggguggagaacgcggcccgccggcagcagccggccgugcgcuggcggucccucgacgccagcaccauccuguccauccugggcaccgggcucugcugcacggagagccugaucgcggagagcuccaucaugcagugcaccaccgaggagggcagcaccacgugcaaggccaccgggaccguggugcugaagcucggccccaucggcuccgagagcugccugauccugaaggggcuccgcgacaacgagaagcaguucaucuccaucaagaccaucagcuccgagcugacgugccgcgagggcgagagcuucuggaccucccuguacacccccgucugccucagcucccggcgcugccaccugaugggggagugcaccggcgacaucugccugaaguggaaguccaacaagacguccagcgaguucaccgggaagacccacuccgaggugauccacgagaacaagugcuucgagcagagcggcggcaucggguacaugugcuucaacgugaaccccuccugccucaugguccacagcuaccugaagccgaucuacaagaacgccuucaagguguuccggugcaucgccuggaaccaccgcgugcggcugggcaucaccacgcacaagcgcaaguucgagaucacccucauggccauguccacccagcagaccgacugggggagcaucggccugauccuggacagcgagggggucgcgggcacgaacgccuacuccuucaugaagcacggccucgggagcuucgccaucaucgacgagcccuacuccguggagccccggaagggcuaccugggggaggugaagggcccccgcgaggagaccgccaucaaggccagcccguccugccaggucgcgcccgggcugguggaguaccagcccgugauggacaccgucgagugcaccacgaacaugauggacccccucgccaucuucaaccggggcagccugccccaggugcgcggcggguggaccuucucccagagcaucgagaagaacucccugcaggcccucaacaccggcgccauccacgccagcgugcggcacguccuggacgaguacgaguucgaguacaaggugaaguccaacgacugcgacagcaccuucgugaacaucacggggugcuacuccugcgacgagggcgcgcgccugugcgucaaggugcggaccagcuccgaggccaucuaccacuucaccgacagcggcuacaacaucaacguccucuucaagguggacuccggggugcacgaccacugcaccauccugcacuucagcaagccggucaucuccaucgagggcaaguacgacugcgggaagaacaagaagcccaugcugaucaagggcacgcucaucgccauggcgccccacgacgaccgcguggugagcgggggcagcuccaccgucgugaacccgaagggccaggggguggacuuccugggcuggcugagcgggcucuccagcugguucggcgggggcccccugaagaccuuccugauggucaccggcuuccucaugacgggggugaucuccggcaucgugaccaucauccugauccggaucguccugcagcaggcgcucgccaagaaggugaaguga

SEQ ID NO: 13051 - RNA, 3999 nt, Artificial Sequence
  derived and/or modified CDS sequence (opt1) from Massilia virus(W)__EU725772.1__GP
auguucuacgccaaguucgugaucauccugugccucguccagggcuucagccugaaguacaccaucaucuccaagagcggguccggcaccauccgccagaucugccugagccacuccacggacaucgacaaggugcucgagcugagcuccggggagauggacaccaucaacauccagggcgggcugugcaccuucggcgagcucaagcgggaggacugcagccccgacguguucuccaacuacaucgccaacauguacggcaccacgcacccgagcuccugccgcuuccuggacaucaucggggaccggagcaucgaggucaugaacgacgcgucccccgacagcuucacccccggcgcccacaacugcuccagcuucgagaaggcccccuucugguccgaccugaucccggccaagaacgggagcggccccucccccagcguggugagcguccuccccuccgccaccgagagcgacuucucccugaaggugaagaaggcgaacgagcgccuggaggugauccagcgggagcucgccgccgagaaggcccgcagcgggcggcuggaggacgaggcgcgcaccaagaugcgggcccuggaggacgagcuccgcaacggcuggcuggccgagcgggaggccaaggagcuggccaaguccgaccucgagaaggagcgcgucaacaagcuggagguggagcggaagcugcacgaccucaacaagaagcugcgccagagcgaggacgaggcggagcggcugcgcgaguaccacaacaagcggcgcaaggaguccgacgagaagaugaagaugacgaagaccguggccccgaacgucagcaccacccucgccacgguggugcugaccucccugcucgccaccggccuggccgcgaucgagcccaucgaggaccggaacaccaaccacauccugaaccgccccgggacgggcgucuacauggccagccccacccucaccgagaacgacugcucccuggacuacgggaaggagugcaaggccugggagcuccaggugagcccgcuccacuaccccuucuucaccuccaacguggacaaguacagccugcuggaguccaucacgcaggccagccccauccucaucaagaacaacaacuccugcgagcugaccaccagccccggcucccagaagcagugccagaaggagagcagcaccaucaagaaguacugcacggacgacgcccgggcguacuucuucgucgaccuggagggcaaccucuccaucgugcacugcagcaacaacaacauccuguccgaggacugcaacuucugcaucagcaaguccggggugaccggccagaagaucuucaugccgauccaggacgccuucugccagcgcgggggcagcgagucccugcccgucauccgcuacagcaaggacaucugcuccaucgggcuguucaagaucaagagcugccacaaguccaccagccgguacgagcgcaugggcuucaucguggugggccggaagaagcuguaccuggaggagcucaagaugcgcuaccggcaggaguacgacgaggaccaguucuacugcuacaaggccaagaccacgucccagcugcaguaccagaaggucagccccuccaagugcaagggggugggcagcaaggaccagaagugcaacggggacgaguacuucugcaaccgcuuccccugcgagaccaacaacccggacgcccacugcucccugcggcgccacgccgcggucguggaggugaacgucggcggggccugggugaagcccaagugcgugggcuacgagaagguccucgugaagcggggcgggcugaagaccgaggaccugagcgugcgcgagugcaccagcugccugugggagugcgagaagaacaagaucgucaucaagacgcacggccccaagaucguguccgccaccgccugcagccacggguccugcaagagcgugaugcagaagcccuccaccuuccucgaccugccguaccccggcaacagcgagaucaucgggggcgacaucggcauccacauguccgagcgggggagccccuccaacauccacaucaccauccacugcccgccgaaggacagcugcgacgucuccgacugcaucuucugccgccacggcauccugaacuaccagugccacagcguggcguccgccauccuccugagcacgguggucgccaccauccuggcccucaccggggugaucaucucccggagcaaguucgccgugcgcuuccuggcguccgccgucgccauccccuuccggugggugagccugcucguggucugggugaugaagaaguggaagucccgcaucgccaccgccauccgggcgaccaacaacgccaucggcugggacaacggccuggagcagguccgcguggagaacgccgcccggcgcccccagccggccgugcgcuacgcguucuacgccacgaccauccugagcauccucgggagcggccugugcugcaccgagucccugaucgccgagagcuccaucaugcagugcaccacggaggacagcuccacgaccugcaaggccaccgggaccgugguccucaagcugggccccaucgggagcgaguccugccugauccucaagggccugcgggacaacgagaagcaguucaucagcaucaagaccaucuccagcgagcugaccugccgcgagggcgaguccuucuggaccagccucuacacgcccgugugccuguccagccggcgcugccaccugaugggggagugcaccggcgacaucugccucaaguggaaguccaacaagaccagcuccgaguucaccgggaaggcgcacagcgaggugauccacgagaacaagugcuucgagcaguccggcgggaucggcuacggcugcuucaacgucaaccccagcugccugauggugcacagcuaccugaagccgaucuacaagaacgccuuccggguguuccgcugcaucgccuggaaccaccggguccgccucggggugacgacccacaagcggaaguucgagaucacccugauggccauguccacccagcagacggacuggggcagcaucgggcugauccucgacuccgagggcaucgaggggaccaacgccuacagcuucaugaagcacggccugggcuccuucgcgaucguggacgagcccuacagcgucgagccccgcaagggguaccugggcgaggugcggugccccaccgaggagaccgccaucaaggccuccccgagcugcaagguggcccccgggcucaucgaguaccagcccgagauggacacggucgagugcaccaccaacaugauggaccccauggccaucuucaaccgcggcucccugccccaggugcgggaggggaagaccuucacgcagagcaucgagaagaacuccgugcaggcgcugaccaccggcgagauccacgccagcguccgccucgugcuggacgaguacgagaucgaguacaaggugaccuccaacgacugcgacagcacguucgucaacaucaccggcugcuacuccugcgacgagggggcccggcugugcgugaaggucaagagcuccagcgaggccaucuaccacuucaccgacuccagcuucagcgugaacguccucuucaaggugacccccuccgugcacgacuacugcacgauccugcacuucagccgccccgugaucuccaucgagggcaaguacgacugcgggaagaacaagaagcccaugcugaucaagggcacccucaucgccauggcgccgcacgacgaccgggucaucaacggcgggagcuccaccguggugaaccccaagggccacggggucgacuuccugggcuggcugagcgggcucuccagcugguucggcggcccccugaagaccuuccugauggugaugggguuccucaugaucggcgugaucaucgucaucgugaccaucauccugauccgcaucgggcugcagcaggcccucgccaagaaguucaaguga

SEQ ID NO: 13052 - RNA, 3996 nt, Artificial Sequence
  derived and/or modified CDS sequence (opt1) from Punique virus(PI-B4-2008)__JF920134.1__GP
auguucuacgccaaguucgugaucauccugugccucguccagggcuucagccugaaguacaccaucaucuccaagcuggggagcggcaccacgcgccaggugugccucucccacagcaccgaccuggacaaggugcuggagaucuccaacauggagauggacgccaucaaccuccucgggggcuucugcacccugggggagcugcggcgcgaggacugcagccccaacgucuucuccaacuacguggugaacguccacggcaccauccacagcuccaacugcaaguucguggacaucgugggcgaccggagcaucgagguccugaacgacgcgacgccggacuccuucacccccggggcccacaacugcagcuccuucgagaagccgcccuucuggaccgaccuggugcccaagaagaacgacaccgaccccagccccucccuccugagcgugcugcccgccgccgccgagcucgacuucaaccugaagcugaaggaggcgaacgacaaggucgaggccauccagcgcgagcucguggccgagaaggcccgguccggccgcaucgaggacgaggcgcggacgaagaugcgcgagcuggaggacgagcugcggcgcggguggaucgccgagcgggaggccaaggagcucgcccacaagaaccuggaggaggagcgcgugagcaagcuggagaucgagcggcgcaugcacgaccucgacaagaagcugcggcaguccgagaacgacgccgaccgccugcgggagcaguacaacaagaagcgcaagagcgaggaggaggucaagaccccgaaggcgagcacccucaacgccaccacgacccuggccaccguggugcugaccucccuccuggccacgggccuggccgcgaucgagcagaucgaggagcggaacaccaaccacauccucaaccgccccgggaccggcgucuacauggccagccccacccugacgcagaccgagugcucccugggcuacgggaaggagugcaagagcugggagcuccaggugagcccccugcacuacccguucuucaccagcaacguggacaaguacuccauccuggagagcaucacccaggagcccacgcuccugaucaagaacaacaacuccugcgagcugaccaccagccccggcucccagaagcagugccagaaggagagcuccaccaucaagaaguacugcacggacgacgcccgggccuacuucuucaucgaccucgggggcaaccugagcaucguccacugcuccaacaacuucgugcugagcgaggacugcaacuucugcaucuccaagagcggcggggugggccagaagaucuucaugcccauccaggacgccuucugccagcgcgggggcuccgagagcccgcccgucgugcgcuacagcaaggaccucugcuccaucgggcuguucaagaucaagagcugccacaaguccaccagccgguacgagcgcaugggcuucaucgucgcgggccagaagaagcuguaccucgaggagcugaagaugcgguaccgccaggaguacgacgaggaccaguucuucugcuacaaggugaaguccaacagcccccugcaguacgagaaggugucccccagcaagugcaagggggucggcucccaggaccagaagugcaacggggacgaguacuucugcaaccgguacccgugcgacaccaacaaccccgacgcccacugcagccugcgccggcacgccgccgugguggaggucaacgugggcgggguguggaucaagcccaagugcgucggcuacgagaaggugcucgugaagcgcggcgggcugaagaccgaggaccuguccguccgggagugcacgagcugccucugggagugcgagcgcaacaaggugguggucaagacccacggccccaagaucguguccgccaccgcgugcagccacggguccugcaagagcgugaugcagaagccguccaccuuccuggagauccccuaccccggcaacagcgagaucaucgggggcgacaucggcauccacaugagcgagcgggggucccccagcaacauccacgucguggugcacugcaagccgaaggacuccugcgacaucagcgacugcaucuucugcaagcacggcauccugaacuaccagugccacuccgucgccagcgccgugcuccuguccacgaugaucgccgcgugccuggcccucgugggggucaucgugagccgcuccaagcacgccgugaaguuccuggccagcgucguggccauccccuucaagugggugucccugcucaccgucuggguggugaagaacuggaagcugcggaucacccgcgucauccgggcgaccaacgacgccaucggcugggagaacaaccuggagcagguccgcguggagaacgccgcccggcgcccccagccggccgugcgguacgcguucuacggcaccacgauccucagcauccuguccaccgggcugugcugcagcgagucccucaucgccgagagcuccaucaugcagugcaccaccgaggacagcuccacggugugcaaggccaccggcaccgugguccugaagcuggggcccaucggcagcgagagcugccucauccugaaggggcugcgcgacaacgagaagcaguucaucuccaucaagaccaucagcuccgagcucacgugccgcgagggcgagagcuucuggaccucccuguacacccccgugugccugagcucccggcgcugccaccucaugggcgagugcaccggggacaucugccugaaguggaagacgaacaagaccagcgccgaguucaccggcaagacccacuccgaggugauccacgagaacaagugcuucgagcagagcgggggcaugggguacggcugcuucaacgucaaccccuccugccugauggugcacagcuaccucaagccgaucuacaagaacgccuucaagguguuccggugcgucgcguggaaccaccgcgugcggcugggcaucacgacccacaagcgcaacuucgagaucacccugauggccauguccacccagcagacggacugggggagcaucggccucauccuggacuccgaggggaucaccggcaccaacagcuacuccuucaugaagcacgggcugggcagcuucgccaucaucgacgagcccuacgugaccgagccccggaagggcuaccucggggagguccgcugccccacggaggagaccgccgugaaggcguccccgagcugcaagguggcccccggccugaucgaguaccagcccgagauggacgucguggagugcaccaccaacaugauggaccccauggccaucuucaaccgggggagccugccgcagguccgcgacggcaagacguucacccaguccaucgagaaguccuccgugcaggcccucaccaccggggagauccacgccagcgugcggcugguccuggacgaguacgagguggaguacaagguggucaacaacgacugcgacuccacguucgugaacaucaccggcugcuacagcugcgacgagggcgcgcgccucugcgugaaggucaaggccuccagcgacgugaucuaccacuucaccgacuccgacaacagcaugaacgugcuguucaaggucuccagcaacauccaggacuacugcaucgugcugcacuucuccaagcccguggucaacguggaggggaaguacgacugcggccggagcaagaagcccaugcucaucaaggggacccugaucgccauggcgccccacgacgaccgcgugacgaacggcggcuccagcaucaucaucaacccgaagggcggcggggucgacuuccugggguggcucuccgggcugagcuccugguucggcggcccccugaagaccuuccucaucaucgccggguuccugaucgugggcaucaucaucgugaucaucaucaucauccuggcccggcucgggauccagcaggcccuggccaagaagcugaaguga

SEQ ID NO: 13053 - RNA, 4020 nt, Artificial Sequence
  derived and/or modified CDS sequence (opt1) from TOSV(9028)__KU904264.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccgaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagaucgugcccaugagcgugaucccgccgcccgucgugaagcuccagccgcccgccgagcccuccagcaagaagcacgugcccuucgacguccugcuguccgaggcggagaaggagcucaaccagaccaagauccgccuggaggacgagcgcaagagcaacgccgaggagaccgccaaggagcgggcccggaugaaggagaucgaggacgagcugcgccgggagugggagcucgagcgcaagcggaaggacgcgauggccgacgaccuggccaaggagacggcccgccggcgcgagaucgagcggaaggcccacgagcuggacaagaugcucaagaagaaggagcgcgagucccugaucgcgaaggagaaggccgacgaggacaugcggagccacgugcacaagcccaacaccacccgcgcccccgcccccaccaucaucacgacccugcucauggccagcgcggcccuggccgggccccuggagaaccgggagaccaaccaccuccugaaccgccccggcaacggggccuacacccuguccgacuucgccgagagcacgugcacccucgcguacggcuccgagugcaagagcugggagcaccuccugaacgaggagcuguucccguucuuccacuccaaccuggacaaguacagcaugcuggaggccgccaccgagaccgugcccauccucaacaaguccagcgccgucugcacgaucucccccagcacccacuccagcaacgccugcggccgcgaggcguccgugauccggaagaagugcuacagcaacauguccgccuucuucuacaucaaccuggccgggcagaucaccgugaucaagugcgagaccaaccacguccugagcuccgacugcggcaacugcaucagcaagucccucagcgggcagaagguguacacgcccgugcaggacgucuucugccagaagggcuggacccagagcaucccguccacccgcuacagcaaggacaucugcuccaucggccugcacaccgugaaggagugcaagaucgggacgaccagcuucgagcgggugggcuucaucgucgugaaggggcgcaagauguacaucgagcagaugaagaugcggucccgccaggaguacagcgaggaccaguuccugugcuacaaguccgagagcggcuccgggagcuccgucaagcucaagaaguucaagguggagagcugcaagggcgugaccaccuccagcgccuccaagugcagcggcgacgaguacuucugcucccgguaccccugcgagacggcgaacgucgaggcccacugcauccugcgccggcacagcgccaucguggaggugaacgucaacgggguguggguggucccccgcugcaucggcuacgaggaggugcuggugaagcggaccagccucaaggucgaggacaccaccgggcgcgagugcgacuccugccugugggagugcggcaagaacaagcugaucgugaagacgcacgggcccaagguggucuacgccaccgccugcagccacggcuccugcaagagcgugaugcagaagccggcgaccuucguguaccugcccuaccccggcaacuccgagaucgucgggggcgacaucgggauccacaugaccgaggagagcucccccagcaacauccaccucguggcccacugcccggcccgggacuccugcgacgugagcgacugccuguucugcguccacggccugcucaacuaccagugccacacccuguucuccgcccugcucaucagcacgaccgugauguccauccugacccugcuccugcugcucgugaagggggccaaggaccuggucaagaagcuguuccacuggcucaucacgccccugugcuggcugagcguguucugcugcuggguggucaaguccuggaagcgccgggugggcagcgcgaucucccgcaccaacgacaccaucggcuggcgggagaaccgccggcacgcccaggacaucgagcgcgcccaguacaccgggggcgcccccggggccaaguacagcuucuacggcgugaugauccucggccugcuguccagcgcgcagagcugcuccgagagcgucaucgccgacuccaagaucaugcagugcaccacgagcggguccagcacccucugcaaggccuccggcaccgugaucaugcgccuggggccgaucggcagcgaguccugccugauccucaaggggcugaaggacagcgagaagcaguucaucuccaucaagaccaucagcuccgagcugacgugccgggagggcgagagcuucuggaccacccucuacacccccaucugccuguccagccgccggugccaccugaugggcgagugcguguccgaccgcugccucaaguggaagacgaaccagaccagcgccgagcugaccgggaaggcgcacggcgacgucaugcacgagaaccggugcuucgagcaguccgggggcaucggguacggcugcuucaacgugaaccccagcugccuguacgugcacagcuaccucaaguccgucuaccgcaacggcuucaagguguuccggugcguggccuggaaccaccgcauccggcuggaggucaccacgcacagccgcaaguuccccauggugcugauggccauguccacccagccgaccgacugggggagcaucggccucauccuggacuccgaggggaucaccggcacgaacagcuacuccuucaugaagcacgggagcggcuccuucgccaucaucgacgaccccuacagccccgagccccggaagggcuuccugggggaggugcgcugcccgaccgaggagaccgccaugcgggcgucccccagcugcaagauggcccccaaccucaucgaguaccagcccgagauggacaccgccgagugcacgaccaacaugaucgacccgauggccaucuucaaccgcggcucccugccccagguccgggacgggaugaccuucacccagagcaucgagaagaacacggugcaggcccugaccaccggcgaggugaaggcguccauccgccucauccuggacgacuacgacgucguguaccagaacagccaguccgacugcagcgccaccuucaagaaccugacggggugcuacuccugcgacgagggcagccggcucugcuaccaggugaaggccgagggcgagaccaucuuccacuucaucaacgaggaggagagcaucaacgucaucaacaaggugucccccggggugagcgacuacugcaccguccugcacuucucccgccccgugaucagcaucgagggcaccuacgacugcgggcuguccaagcggccgauggucaucaagggcacccucaucgccacggcgccccacgacgaccgcaagcacgagggcgggagcucccugguggugaaccccaagggcgggagcgucgacuucuucggcuggcuguccgggcucaccagcuggcugggcggcccccugaagaccuuccucaccauccugggguuccuggccgugggccuccugcugguggucaucaucaucaucaucauccggacggggaugcagcaggcccucaagaagaagaucaaguga

SEQ ID NO: 13054 - RNA, 4020 nt, Artificial Sequence
  derived and/or modified CDS sequence (opt1) from TOSV(A189)__KP694241.1__GP
auguucaucgccaagcugcuccugaucagcugccuggugcagcaggccuaccucaaguacaccaucaucuccgagaucggcaacgggacccgcacgagcuccugcuacagcucccggaccagccugggcucccugcucgaggcgugggacaacaucaccgagagcaucgggcugaccuccggcacgugcaaggucgggagccuggagaaccgcgacugcaagcgggacaucauguccaacuacguggccgaggugcacagcaaccuccacggccugggcgccaugaugcacaacuacggggacgacaagcgcgucgaggugcugaacgacgugauccccgacgagcucaacccgggccggcacaacugcuccgaccuggaccgcaagcccuucuggaccgaguucaucaacgucgcccggcccaccaacaagauggcccccaugagcgugaucccgccgcccaucgugaagcccauccccgucgcggagcccaccaucgagaagacgauccccuucgacaagcugcucuccgaggccgagaaggagcugaaccagaccaagauccgccuggaggccgagcggcgcagcaacgccgaggaggcggccaaggagcgggcccgcaugcgggagaucgaggacaagcuccgcaaggacugggagcuggagcgggagcgcaaggacgccguggccgacgaccuggcgaaggagaucgcccggcgccgggagaucgagcgcaaggcccacgagcucgacaagaugcugaagaagaaggagcgggaggaccugguggcccgcgagcgcgucuccgaggacaugcggaaccacgugcgccggcccaacaccaccaucgccccggcgcccacgaucaucaccacccuccugauggccagcgccgugauggccgggccccuggagaaccgcgagaccaaccaccuccugaaccggcccggcaacggggccuacacgcuguccgacuucgcggagagcacgugcacccucgccuacggcagcgagugcaaguccugggagcaccagcuggacgagcugagcuucccguucuuccacuccaaccucgacaaguacagcaugcuggaggccgccaccgagacgguccccauccugaacaaguccagcgccgugugcaccaucuaccacccccgcauccaccggauggcgugcggccgcgaggccucccucaucaagaagaagugcgggagcaacauguccgccuucuucuacgugaaccuggccggccagaucaccgucgugaagugcgacaccaaccacgugcugagcaacgacugcgggaacugcaucuccaagacgcucagcggccagaagaucuacacccccguccaggacauguucugccagaagggcuggaccgaguccaucccgaacacccgguacagcaaggaccugugcuccaucgggcugcacacggugaaggagugcaagaccggcaccaccaacuucgagcgcgugggguucaucgucgugaagggccggaagauguacaucgagcagaugaagaugcgcagccggcaggaguucuccgaggaccaguuccucugcuacaagagcgaguccagcagcggguccagcgucaagcugaagaaggugaagguggaguccugcaagggcgucacgaccagcuccgcgagcaagugcuccggcgacgaguacuucugcagccgcuaccccugcgagaccgccaacguggaggcccacugcauccugcggcgccacuccgccgugaucgaggucaacgugaacggggugugggucgugccccggugcaucggcuacgaggaggugcucguccgccggaccagccugaagguggaggacacguccagccgcgagugcgacacgugccugugggagugcgggaagaacaagcucaucgugaagacccacggccccaagaucgucuacgccaccgcgugcucccacgggagcugcaaguccgugaugcagaagccggccaccuucguguaccugcccuaccccggcaacagcgagaucgucggcggggacaucggcgugcacaugaccgaggaguccagccccagcaacauccacaugguggcccacugcccggccaaggacuccugcgaggucagcuccugccuguucugcgugcacgggcugcucaacuaccagugccacacccuguucagcgcccugcucaucuccaccaccgugaugagcauccugacgcugcuccugcugcucaugcgcggcgcgaaggaccuggucaagcggcuguucuacuggcucaucacgccccugugcuggcuguccguguucugcagcuggaugaucaaguccuggaagaagcgcguggggagcgccaucucccggaccaacgacaccaucggcuggcgcgacaaccggcgcuacggccaggacgucgagcgggcccaguacaccgggggcgcccccggggccaaguacagcuucuacggcgugaugauccucggccugcuggggaacgugcacuccugcagcgaguccguccucgcggacagcaagaucaugcagugcaccaccuccggcagcuccacccugugcaaggccagcgggaccgugaucaugaagcugggcccgaucgggagcgaguccugccucauccugaagggccugaaggacagcgagaagcaguucaucuccaucaagaccaucagcuccgagcugaccugccgcgagggcgagagcuucuggaccacgcucuacacccccgugugccuguccagccggcgcugccaccucaugggggagugcgucuccgaccggugccugaaguggaagaccaacgagaccagcgccgaguucacgggcaaggcccacggggaggugaugcacgagaaccgcugcuucgagcaguccggcgggaucggcuacggcugcuucaacgugaaccccagcugccuguacguccacuccuaccucaagagcguguacaagaacggguucaagaucuuccggugcguggcguggaaccaccgcauccggcuggaggucaccacccacucccgcaaguuccccauggugcugauggccaugagcacccagccgacggacuggggcuccaucgggcucauccuggacagcgagggcaucaccgggaccaacgccuacuccuucaugaagcacggcagcggcagcuucgccaucaucgacgaccccuacucccccgagccccggaagggguuccugggcgaggugcgcugcccgaccgaggagacggccauccgggcgagccccuccugcaagauggcccccaaccucaucgaguaccagcccgagauggacaccgccgagugcaccaccaacaugaucgacccgauggccaucuucaaccgcgggagccugccccagguccgggacggcaugacguucacccaguccaucgagaagaacaccgugcaggcccugaccacgggggaggugcgcgcgagcauccgccucacccuggacgacuacgacgucguguaccagaacucccagagcgacugcuccgccaccuucaagaaccugaccggcugcuacagcugcgacgagggcucccggaugugcuaccaggugaaggccgagggggagaccaucuuccacuucgucaacgaggacgagagcaucaacgugaucaacaaggugucccccgacgucagcgacuacugcacggugcuccacuucucccgccccgucaucagcaucgagggccgguacgacugcgggcuguccaagcgcccgauggugaucaagggcacccugaucgccaccgcgccccacgacgaccggaagcacgagggcgggagcucccucguggucaaccccaagggcgggaccguggacuucuucggcugggugagcgggcugacgagcuggcugggcggcccccucaagaccuuccugaccauccugggguuccucgcccugggccugcuccuggucgugaucaucaucaucaucgcccgcaccggggugcagcaggcccugaagaagaagaacaaguga

SEQ ID NO: 13055 - RNA, 4020 nt, Artificial Sequence
  derived and/or modified CDS sequence (opt1) from TOSV(AR)__EF656362.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagcccuccagcgagaucgugcccauguccgugaucccgccgcccgucgugaagcugcagccgcccgccgagcccagcuccaagaagcacgugcccuucgacguccuccugagcgaggcggagaaggagcugaaccagaccaagauccgccucgaggacgagcggaaguccaacgccgaggagaccgccaaggagcgcgcccggaugaaggagaucgaggacgagcugcgccgggagugggagcuggagcgcaagcggaaggacgcgauggccgacgaccucgccaaggagacggcccgccggcgcgagaucgagcggaaggcccacgagcuggaccgcaugcugaagaagaaggagcgggagagccucaucgcgaaggagaaggccgacgaggacaugcgcagccacgugcacaagcccaacaccacccgggcccccgcccccaccaucaucacgacccugcugauggccuccgcggcccucgccgggccccuggagaaccgcgagaccaaccaccuccugaaccgccccggcaacggggccuacacccugagcgacuucgccgaguccacgugcacccuggcguacggcagcgagugcaaguccugggagcaccuccugaacgaggagcuguucccguucuuccacagcaaccucgacaaguacuccaugcuggaggccgccaccgagaccgugcccauccugaacaagagcuccgccgucugcacgaucagccccuccacccacagcuccaacgccugcggccgggaggcgagcgugauccgcaagaagugcuacuccaacaugagcgccuucuucuacaucaaccucgccgggcagaucaccguggucaagugcgagaccaaccacgugcuguccagcgacugcggcaacugcaucuccaagagccugagcgggcagaagguguacacgcccguccaggacguguucugccagaagggcuggacccaguccaucccgagcacccgguacuccaaggacaucugcagcaucggccuccacaccgugaaggagugcaagaucgggacgaccuccuucgagcgcgucggcuucaucguggucaaggggcggaagauguacaucgagcagaugaagaugcgcagccggcaggaguacuccgaggaccaguuccugugcuacaagagcgaguccggcagcggguccagcgugaagcugaagaaguucaagguggaguccugcaagggcgucaccaccagcuccgccagcaagugcuccggcgacgaguacuucugcaaccgcuaccccugcgagacggcgaacguggaggcccacugcauccuccggcgccacagcgccaucguggaggucaacgugaacggggugugggucgugccccggugcaucggcuacgaggaggugcuggucaagcgcaccagccugaagguggaggacaccaccgggcgggagugcgacuccugccucugggagugcggcaaggacaagcugaucgugaagacgcacgggcccaaggucguguacgccaccgccugcagccacggcuccugcaagagcgugaugcagaagccggcgaccuucgucuaccugcccuaccccggcaacuccgagaucgucgggggcgacaucgggauccacaugaccgaggagagcucccccagcaacauccaccugguggcccacugcccggccaaggacuccugcgacgugagcgacugccucuucugcgugcacggccugcugaacuaccagugccacacccucuucuccgcccugcugaucagcacgaccgugauguccauccucacccugcugcuccugcuggucaagggggccaaggaccucgugaagaagcuguucuacuggcugaucacgccccucugcuggcugagcguguucugcugcugggucgugaaguccuggaagcgccgggugggcagcgcgaucucccgcaccaacgacaccaucggcuggcgggagaaccgccggcacgcccaggacaucgagcgcgcccaguacaccgggggcgcccccggggccaaguacagcuucuacggcgucaugauccugggccuccuguccagcgcgcagagcugcuccgagagcgugaucgccgacuccaagaucaugcagugcaccacgagcggguccagcacccugugcaaggccuccggcaccgugaucaugcgccucgggccgaucggcagcgaguccugccugauccugaaggggcucaaggacagcgagaagcaguucaucuccaucaagaccaucagcuccgagcugacgugccgggagggcgagagcuucuggaccacccuguacacccccaucugccucuccagccgccggugccaccugaugggcgagugcgucuccgaccgcugccugaaguggaagacgaaccagaccagcgccgaguucaccgggaaggcgcacggcgacgugaugcacgagaaccggugcuucgagcaguccgggggcaucggguacggcugcuucaacgugaaccccagcugccucuacguccacagcuaccugaaguccguguaccgcaacggcuucaagguguuccggugcgucgccuggauccaccgcauccggcuggaggugaccacgcacagccgcaaguuccccauggugcucauggccauguccacccagccgaccgacugggggagcaucggccugauccuggacuccgaggggaucaccggcacgaacagcuacuccuucaugaagcacgggagcggcuccuucgccaucaucgacgaccccuacagccccgagccccggaagggcuuccucggggagguccgcugcccgaccgaggagaccgccaugcgggcgucccccagcugcaagauggcccccaaccugaucgaguaccagcccgagauggacaccgccgagugcacgaccaacaugaucgacccgauggccaucuucaaccgcggcucccugccccaggugcgggacgggaugaccuucacccagagcaucgagaagaacacggugcaggcccucaccaccggcgaggucaaggcguccauccgccugacccuggacgacuacgacgugguguaccagaacagccaguccgacugcagcgccacguucaagaaccucaccgggugcuacuccugcgacgagggcagccggcugugcuaccaggucaaggccgagggcgagaccguguuccacuucaucaacgaggaggagagcaucaacgugaucaacaaggucucccccggggugagcgacuacugcaccguccugcacuucucccgccccgugaucagcaucgagggcaccuacgacugcgggcucuccaagcggccgauggugaucaagggcacgcugaucgccaccgcgccccacgacgaccgcaagcacgagggcgggagcucccuggucgugaaccccaagggcgggagcguggacuucuucggcugggucuccgggcucaccagcuggcugggcggcccccugaagaccuuccucacgauccugggguuccuggccgugggccuccugcugguggucaucaucaucaucaucauccggaccgggaugcagcaggcccucaagaagaagaucaaguga

SEQ ID NO: 13056 - RNA, 4020 nt, Artificial Sequence
  derived and/or modified CDS sequence (opt1) from TOSV(EsPhGR40)__FJ153283.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggccugggacaacgucaccgaguccaucgggcugaccagcggcacgugcaagguggggucccuggagaaccgcgacugcggcaaggacaucaugagcaacuacguggccgagguccacuccaaccuccacggccugggggccaugaugcacaacuacggcgacgacaagcggguggagauccugaacgacgugauccccgacgagcucaacccggggcaccacaacugcagcgaccuggaccgcaagcccuucuggaccgaguucaucaacgucgccaagccccuguccgagaucgcccccaugagcgugaucccgccgcccguggucaagcuccagccgcccgcggagcccuccagcaagaagcacgugcccuucgacgugcugcuguccgaggccgagaaggagcucaaccagaccaagauccggcuggaggacgagcgcaagagcaacgccgaggagaccgcccgggagcgcgcgcggaugcgcgacaucgaggaggagcugcggaaggagugggagcucgagcgcaagcggaaggacgccauggccgacgaccuggccaaggagacggccaagcgccgggagaucgagcgcaaggcgcacgagcuggaccggaugcucaagaagaaggagcgcgagucccugaucgccaaggagaaggaggacgagaacaugcggagccgcguccacaagcccagcaccacccgggcccccgcccccaccaucaucacgacccugcucauggccuccaccgcgcuggccggcccccuggagaaccgcgagaccaaccaccuccugaaccgccccgggaacggcgccuacacgcugagcgacuucgccgaguccacgugcacccucgccuacggcagcgagugcaaguccugggagcaccuccugaacgaggagcuguucccguucuuccacagcaaccuggacaaguacuccaugcuggaggcggccaccgagacggugcccauccucaacaagagcuccgccgugugcaccaucagccccuccacccacagcuccaacgccugcgggcgggaggccagcgucauccgcaagaagugcuacuccaacaugagcgcgcuguucuacaucaaccuggccggccagaucaccguggugaagugcgagacgaaccacguccucuccagcgacugcgggaacugcaucuccaagagccugagcggccagaagguguacacccccgugcaggacgucuucugccagaagggcuggaccgaguccaucccgagcacccgguacuccaaggacaucugcagcaucgggcugcacacggugaaggagugcaagaucggcaccaccuccuucgagcgcgugggguucaucgucgugaagggccggaagauguacaucgagcagaugaagaugcgcagccggcaggaguacuccgaggaccaguuccucugcuacaagagcgaguccgggagcggcuccagcgucaagcugaagaaguucaagguggaguccugcaagggcgugaccacgagcuccgccagcaagugcuccggggacgaguacuucugcagccgcuaccccugcgagaccgccaacgucgaggcgcacugcauccugcggcgccacagcgccaucguggaggugaacgucaacggcguguggguggucccccggugcaucggguacgaggaggugcucgugaagcgcaccucccugaaggucgaggacaccacggagcgggagugcgacagcugccugugggagugcggcaagaacaagcugaucgugaagacccacgggcccaagguggucuacgccaccgccugcucccacggcagcugcaaguccgugaugcagaagccgaccaccuucguguaccuccccuaccccggcaacagcgagaucgucgggggcgacaucgggauccacaugacggaggaguccagccccuccaacauccaccugguggcccacugcccggcgcgcgacagcugcgacguguccgacugccuguucugcguccacggccuccugaacuaccagugccacacccuguucagcgcccuccugaucuccaccaccgugaugagcauccugacgcuccugcugcuccuggugaagggggccaaggaccuggucaagaagcuguucuacuggcugaucacgccccugugcuggcucuccguguucugcugcuggguggucaagagcuggaagcggcgcgugggcuccgccaucagccggaccaacgacaccaucggcuggcgcgagaaccggcgcuacgcccaggacaucgagcgcgcgcaguacaccgggggcgcccccggggccaaguacuccuucuacggcgugaugauccugggccugcucagcagcgcccaguccugcagcgaguccgucaucgccgacagcaagaucaugcagugcaccaccuccgggagcuccacccugugcaaggcgagcggcaccgugaucaugcggcuggggccgaucggcuccgagagcugccucauccugaaggggcugaaggacuccgagaagcaguucaucagcaucaagaccaucuccagcgagcugaccugccgcgagggcgaguccuucuggaccacgcucuacacccccaucugccugagcucccggcgcugccaccucaugggcgagugcgugagcgaccggugccugaaguggaagaccaacgagaccuccgccgaguucacggggaaggcccacggcgacgucaugcacgagaacaagugcuucgagcagagcgggggcaucggguacggcugcuucaacgugaaccccagcugccuguacgugcacuccuaccucaagagcgucuaccgcaacggcuucaagaucuuccggugcguggccuggaaccaccgcauccggcuggaggugaccacccagucccgcaaguuccccaugguccugauggcgaugagcacccagccgacggacuggggguccaucggccucauccuggacagcgaggggaucaccggcaccaacuccuacagcuucaugaagcacggguccggcagcuucgccaucaucgacgaccccuacucccccgagccccggaagggcuuccugggggaggugcgcugcccgaccgaggagacggccaugcgggccagccccuccugcaagauggcccccaaccucaucgaguaccagcccgagauggacaccgcggagugcaccaccaacaugaucgacccgauggccaucuucaaccgcggcagccugccccaggugcgggacgggaugacguucacccaguccaucgagaagaacaccguccaggcccugaccacgggcgaggugaaggccagcauccgccucacccuggacgacuacgacguggucuaccagaacucccagagcgacugcuccgccaccuucaagaaccugaccgggugcuacagcugcgacgagggcagccggcucugcuaccaggugaaggcggagggcgagaccguguuccacuucaucaacgaggaggaguccaucaacgucaucaacaaggugagccccgacguguccgacuacugcacgguccugcacuucagccgccccaucaucuccaucgaggggaccuacgacugcggccugagcaagcggccgauggugaucaaggggacccucaucgccaccgcgccccacgacgaccgcaagcacgagggcggcuccagccuggucgugaaccccaagggcggguccguggacuucuucggguggcugagcggccucacguccuggcucgggggcccccugaagaccuuccucaccauccugggcuuccuggccgucgggcuccugcugguggugaucaucaucaucaucauccggaccggcaugcagcaggcccucaagaagaagaucaaguga

SEQ ID NO: 13057 - RNA, 4014 nt, Artificial Sequence
  derived and/or modified CDS sequence (opt1) from TOSV(SI-121283)__JF330279.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgggccggcacaacugcagcgaccuggaccgcaagcccuucuggaccgaguucaucaacguggccaagcccgccaacgagauggcgcccauguccgucaucccgccgcccaucgugaagcccauccccguggccgagagcaccaccaagaagacgauccccuucgacaagcugcucuccgaggccgagaaggagcugaaccagaccaagauccggcuggagaccgagcgccggagcaacgccgaggaggcggccaaggagcgcgcccggaugcgcgagaucgaggacaagcuccggaaggacugggagcuggagcgcgagcggaaggacgccgucgccgaggaccuggcgaaggagaucgcccgccggcgcgagaucgagcggaaggcccacgagcucgacaagaugcugaagaagaaggagcgcgaggaccugguggcccgggagcgcguggacgaggacaugcgcaaccacguccggcgccccaacaccacgaucgcccccaccaucaucaccacccuccugaugggguccgcggugauggccggcccgcuggagaaccgggagcccacgcaccuccugaaccgccccgggaacggcgccuacccccugagcgacuucgccgagccgaccugcacccucgccuacggcuccgagugcaagagcugggagcaccagcuggacgagcugagcuuccccuucuuccacuccaaccucgacaaguacagcaugcuggaggcggccaccgagacgauccccauccugaacaaguccagcgccgugugcaccaucucccccagcacccacuccagcaacgccugcgggcgggaggccucccucaucaagaagaagugcggcagcgacauguccgcguucuucuacgucaaccuggccgggcagaucaccguggugaagugcgacacgaaccacguccugagcaacgacugcggcaacugcaucuccaagacccucagcggccagaagaucuacaccccggugcaggacauguucugccagaaggggugguccgagagcauccccuccacccgcuacagcaaggaccugugcuccaucggccugcacacggugaaggagugcaagaucgggaccaccaacuucgagcgggucggcuucaucguggugaaggggcgcaagauguacaucgagcagaugaagaugcggagccgccaggaguucagcgaggaccaguuccucugcuacaaguccgagggcagcuccggcagcuccgucaagcugaagaaggugaaggucgagagcugcaagggggugaccacguccagcgccuccaagugcagcggcgacgaguacuucugcucccgguaccccugcgagaccgccaacguggaggcgcacugcauccugcgccggcacagcgccgucaucgaggugaacgugaacggggucuggguggugccccgcugcaucggcuacgaggagguccucgugcggcgcaccucccugaagguggaggacaccagcucccgggagugcgacacgugccugugggagugcgggaagaacaagcucaucgucaagacccacggcccgaagaucguguacgccaccgccugcagccacggcuccugcaagagcgugaugcagaagcccgccaccuucgucuaccugcccuaccccgggaacagcgagaucgugggcggggacaucggcgugcacaugaccgaggaguccagcccguccaacauccacauggucgcgcacugccccgccaaggacagcugcgagguguccagcugccuguucugcgugcacgggcugcucaacuaccagugccacacgcuguucuccgcccugcucaucagcaccaccgucauguccauccugacccugcuccugcugcucgugaagggcgccaaggaccuggugaagcgccuguucuacuggcucaucacgccccugugcuggcugagcgucuucugcggcuggaugauccgguccuggaagaagcgcguggggagcgccaucucccgcaccaacgacaccaucggcuggcgggacaacagccgccgggggcaggacaucgagcgcgcgcaguacaccggcggcgccccgggggccaaguacuccuucuacggcgugaugauccucgggcugcugggcaacguccacagcugcuccgagagcaucaucgccgacuccaagaucaugcagugcacgaccagcgggagcuccacccucugcaaggccagcggcaccgugaucaugaagcugggccccaucggguccgagagcugccugauccucaagggccugaaggacuccgagaagcaguucaucagcaucaagacgaucuccagcgagcugaccugccgggagggggaguccuucuggaccacccucuacacgcccgugugccugagcucccgccggugccaccugaugggcgagugcgucagcgaccgcugccuccgguggaagaccaacgagaccuccgcggaguucaccgggaaggcccacggcgaggugaugcacgagaaccgcugcuucgagcagagcggcgggaucggcuacgggugcuucaacgugaaccccuccugccuguacguccacagcuaccugaaguccguguacaagaacggcuucaagaucuuccggugcguggccuggaaccaccgcauccggcucgaggucacgacccacagccgcaaguucccgauggugcugauggccauguccacccagcccaccgacugggggagcaucggccugauccucgacagcgagggcaucacggggaccaacgcguacuccuucaugaagcacggccuggggagcuucgccaucaucgacgaccccuacucccccgagccgcggaagggcuuccugggggaggugcgcugccccaccgaggagaccgccauccgggccagccccuccugcaagauggcccccaaccucaucgaguaccagccggagauggacacggcggagugcaccaccaacaugaucgaccccauggccaucuucaaccgcggcagccugccccagguccgggacggcaugaccuucacgcaguccaucgagaagaacaccgugcaggcccugaccaccggggaggugcgcgccagcauccggcucacgcuggacgacuacgacgucguguaccagaacucccaguucgacugcagcgccaccuucaagaaccugaccggcugcuacuccugcgacgaggggagccgcaugugcuaccaggugaaggcggagggcgagaccaucuuccacuucgucaacgaggacgaguccaucaacgugaucaacaaggugagccccgacgucuccgacuacugcaccgugcuccacuucagccgcccggugaucuccaucgagggccgguacgacugcgggcugagcaagcgccccauggucaucaagggcacgcugaucgccaccgcgccccacgacgaccggaagcacgagggcggguccagccucguggucaaccccaagggcgggaccguggacuucuucggcugggugagcgggcugaccuccuggcugggcgggccgcucaagacguuccugaccauccugggcuuccucgcccuggggcugcuccuggucgugaucaucaucaucaucgcccgcaccggcguggagcaggcccugaagaagaagaacaaguga

SEQ ID NO: 13058 - RNA, 4014 nt, Artificial Sequence
  derived and/or modified CDS sequence (opt1) from TOSV(SI-121487)__JF330280.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgggccggcacaacugcagcgaccuggaccgcaagcccuucuggaccgaguucaucaacguggccaagcccgccaacgagauggcgcccauguccgucaucccgccgcccaucgugaagcccauccccguggccgagagcaccaccaagaagacgauccccuucgacaagcugcucuccgaggccgagaaggagcugaaccagaccaagaucaugcuggagaccgagcggcgcagcaacgccgaggaggcggccaaggagcgggcccgcaugcgggagaucgaggacaagcuccgcaaggacugggagcuggagcgggagcgcaaggacgccgucgccgaggaccuggcgaaggagaucgcccggcgccgggagaucgagcgcaaggcccacgagcucgacaagaugcugaagaagaaggagcgggaggaccugguggcccgcgagcggguggacgaggacaugcgcaaccacguccgccggcccaacaccacgaucgcccccaccaucaucaccacccuccugauggcguccgccgugauggccgggccgcuggagaaccgcgagaucaaccaccuccugaacuggcccggcaacggggccuacacgcugagcgacuucgccgaguccacgugcacccucgcguacggcagcgagugcaagagcugggagcaccagcuggacgagcuguccuuccccuucuuccacagcaaccucgacaaguacuccaugcuggaggccgccaccgagaccauccccauccugaacaagagcuccgccgugugcaccaucagcccguccacccacagcuccaacgccugcggccgggaggcgagccucaucaagaagaagugcggguccgacaugagcgccuucuucuacgucaaccuggccggccagaucaccguggugaagugcgacacgaaccacguccuguccaacgacugcgggaacugcaucagcaagacccucuccggccagaagaucuacacccccgugcaggacauguucugccagaagggcuggagcgaguccauccccagcacccgcuacuccaaggaccugugcagcaucgggcugcacacggugaaggagugcaagaucggcaccaccaacuucgagcgggucggguucaucguggugaagggccgcaagauguacaucgagcagaugaagaugcggagccgccaggaguucuccgaggaccaguuccucugcuacaagagcgagggguccagcggcuccagcgucaagcugaagaaggugaaggucgaguccugcaagggcgugaccacgagcuccgccagcaagugcuccggggacgaguacuucugcagccgguaccccugcgagaccgcgaacguggaggcccacugcauccugcgccggcacuccgccgucaucgaggugaacgugaacggcgucuggguggugccgcgcugcaucggguacgaggagguccucgugcggcgcaccagccugaagguggaggacaccuccagccgggagugcgacacgugccugugggagugcggcaagaacaagcucaucgucaagacccacgggcccaagaucguguacgccaccgccugcucccacggcagcugcaagagcgugaugcagaagcccgcgaccuucgucuaccugcccuacccgggcaacuccgagaucgucgggggcgacaucggggugcacaugaccgaggagagcucccccagcaacauccacaugguggcccacugccccgccaaggacuccugcgaggugagcuccugccuguucugcgugcacggccugcucaacuaccagugccacacgcuguucagcgcccugcucaucuccaccaccgucaugagcauccugacccugcuccugcugcucgugaagggggccaaggaccuggugaagcgccuguucuacuggcucaucacgccccugugcuggcuguccgucuucugcggcuggaugauccggagcuggaagaagcgcgugggcuccgcgaucagccggaccaacgacaccaucggguggcgcgacaacucccgccggggccaggacaucgagcgcgcccaguacaccgggggcgccccgggcgccaaguacagcuucuacggggugaugauccucggccugcuggggaacguccacuccugcagcgaguccaucaucgccgacagcaagaucaugcagugcacgaccagcggcuccagcacccucugcaaggcguccgggaccgugaucaugaagcugggccccaucggcagcgaguccugccugauccucaaggggcugaaggacagcgagaagcaguucaucuccaucaagacgaucagcuccgagcugaccugccgggagggcgagagcuucuggaccacccucuacacgcccgugugccuguccagccgccggugccaccugaugggggagugcgucuccgaccgcugccuccgguggaagaccaacgagaccagcgccgaguucaccggcaaggcccacggggaggugaugcacgagaaccgcugcuucgagcaguccggcggcaucggguacggcugcuucaacgugaacccgagcugccuguacguccacuccuaccucaagagcguguacaagaacggguucaagaucuuccggugcguggccuggaaccaccgcauccggcuggaggucacgacccacucccgcaaguuccccauggugcugauggcgaugagcacccagcccaccgacuggggcagcaucgggcugauccucgacuccgagggcaucacgggcaccaacgccuacagcuucaugaagcacggguccggcagcuucgccaucaucgacgaccccuacuccccggagccccggaagggguuccugggcgaggugcgcugccccaccgaggagaccgccauccgggccagccccuccugcaagauggcgccgaaccugaucgaguaccagcccgagauggacacggccgagugcaccaccaacaugaucgaccccauggccaucuucaaccgcgggagccucccccagguccgggacggcaugaccuucacgcaguccaucgagaagaacaccgugcaggcccugaccaccggcgaggugcgcgccagcauccggcugacgcucgacgacuacgacgucguguaccagaacucccaguucgacugcagcgcgaccuucaagaaccugaccgggugcuacuccugcgacgagggcagccgcaugugcuaccaggugaaggccgagggggagaccaucuuccacuucgucaacgaggacgaguccaucaacgugaucaacaaggugagcccggacgucuccgacuacugcaccgugcugcacuucagccggcccgugaucuccaucgagggccgcuacgacugcggccucagcaagcgccccauggucaucaagagcacgcugaucgccaccgcgccccacgacgaccggaagcacgagggcggguccagccugguggucaacccgaagggcgggaccguggacuucuucggguggguguccggccucaccagcuggcugggcgggccccugaagacguuccucaccauccugggcuuccuggcccucgggcugcugcucgucgugaucaucaucaucaucgcccgcaccggcgugcagcaggcccugaagaagaagaacaaguga

SEQ ID NO: 13059 - RNA, 4014 nt, Artificial Sequence
  derived and/or modified CDS sequence (opt1) from TOSV(SI-21137)__EU003173.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgcggcgccacaacugcagcgaccuggaccggaagcccuucuggaccgaguucaucaacguggccaagcccgccaacgagaucgcgcccauguccgucaucccgccgcccaucgugaagcccauccccguggccgagagcaccaccaagaagacgauccccuucgacaagcugcucuccgaggccgagaaggagcugaaccagaccaagauccgccuggagaccgagcggcgcagcaacgccgaggaggcggccaaggagcgggcccgcaugcgggagaucgaggacaagcuccgcaaggacugggagcuggagcgggagcgcaaggacgccgucgccgaggaccuggcgaaggagaucgcccggcgccgggagaucgagcgcaaggcccacgagcucgacaagaugcugaagaagaaggagcgggaggaccugguggcccgcgagcgcguggacgaggacaugcggaaccacguccgccggcccaacaccacgaucgcccccaccaucaucaccacccuccugauggcguccgccgugauggccggcccgcuggagaaccgcgagacgaaccaccuccugaaccggcccgggaacggcgccuacacccugagcgacuucgccgaguccacgugcacccucgcguacgggagcgagugcaagagcugggagcaccagcuggacgagcuguccuuccccuucuuccacagcaaccucgacaaguacuccaugcuggaggccgccaccgagaccauccccauccugaacaagagcuccgccgugugcaccaucagcccguccacccacagcuccaacgccugcggccgcgaggcgagccucaucaagaagaagugcggcuccaacaugagcgccuucuucuacgucaaccuggccgggcagaucacgguggugaagugcgacaccaaccacguccuguccaacgacugcggcaacugcaucagcaagacccucuccgggcagaagaucuacacccccgugcaggacauguucugccagaagggcuggagcgagacgaaccccuccacccgguacagcaaggaccugugcuccaucggccugcacaccgugaaggagugcaagaucgggaccacgaacuucgagcgcgagggcuucaucgucgugaaggggcggaagauguacaucgagcagaugaagaugcgcagccggcaggaguucagcgaggaccaguuccucugcuacaaguccgagggcagcuccgggagcuccgugaagcugaagaaggucaagguggagagcugcaagggcgucaccaccuccagcgccuccaagugcagcggcgacgaguacuucugcucccgcuaccccugcgagaccgcgaacguggaggcccacugcauccugcggcgccacagcgccgugaucgaggucaacgugaacggggugugggucgugccgcggugcaucggcuacgaggaggugcucguccgccggacgucccugaagguggaggacaccagcucccgcgagugcgacacgugccugugggagugcgggaagaacaagcucaucgugaagacccacggccccaagaucgucuacgccaccgccugcagccacggguccugcaagagcgugaugcagaagcccgcgaccuucguguaccugcccuacccgggcaacagcgagaucgucggcggggacaucggcgugcacaugaccgaggaguccagccccuccaacauccacaugguggcccacugccccgccaaggacagcugcgaggucuccagcugccuguucugcgugcacgggcugcucaacuaccagugccacacccuguucuccgcccugcucaucagcaccacggugauguccauccugacccugcuccugcugcucgucaagggcgccaaggaccuggugaagcggcuguucuacuggcucaucacgccccugugcuggcugagcguguucugcggguggaugauccgcuccuggaagaagcgcgucggcagcgcgaucucccggaccaacgacaccaucggcuggcgcgacaacagccggcgcgggcaggacaucgagcgggcccaguacaccggcggggccccgggcgccaaguacuccuucuacggcgugaugauccucgggcugcugggcaacgugcacagcugcuccgagagcaucaucgccgacuccaagaucaugcagugcaccaccagcgggagcuccacgcucugcaaggcgagcggcaccgucaucaugaagcuggggcccaucggcuccgagagcugccugauccucaagggccugaaggacuccgagaagcaguucaucagcaucaagaccaucuccagcgagcugaccugccgcgagggggaguccuucuggacgacccucuacacccccgugugccugagcucccggcgcugccaccugaugggcgagugcgugagcgaccggugccuccgcuggaagaccaacgagacguccgccgaguucaccgggaaggcccacggcgaggucaugcacgagaaccggugcuucgagcagagcgggggcaucggcuacgggugcuucaacgugaacccguccugccuguacgugcacagcuaccugaaguccgucuacaagaacggcuucaagaucuuccgcugcguggccuggaaccaccggauccgccucgaggugaccacccacagccggaaguuccccaugguccugauggcgauguccacgcagcccaccgacugggggagcaucggccugauccucgacagcgggggcaucaccggcaccaacgccuacuccuucaugaagcacgggcugggcagcuucgccaucaucgacgaccccuacuccccggagccccgcaagggguuccugggcgaggugcggugccccacggaggagaccgccauccgcgccagccccuccugcaagauggcgccgaaccucaucgaguaccagcccgagauggacaccgccgagugcaccacgaacaugaucgaccccauggccaucuucaaccgggggagccugccccaggugcgcgacggcaugaccuucacccaguccaucgagaagaacaccguccaggcccugacgaccggcgaggugcgggccagcauccgccucacccuggacgacuacgacguggucuaccagaacucccaguucgacugcagcgcgaccuucaagaaccugaccgggugcuacuccugcgacgagggcagccgcaugugcuaccaggugaaggccgagggggagacgaucuuccacuucgugaacgaggacgaguccaucaacgucaucaacaaggugagcccggacguguccgacuacugcaccguccuccacuucagccggcccgugaucuccaucgagggccgcuacgacugcggccugagcaagcggcccauggugaucaaggggacccugaucgccaccgcgccccacgacgaccgcaagcacgagggcggguccagccucgucgugaacccgaagggcgggacggucgacuucuucggcugggugagcggccugaccuccuggcucgggggcccccugaagaccuuccugaccauccugggguuccucgcccugggccugcuccugguggucaucaucaucaucaucgcccggacggggguggagcaggcccugaagaagaagaacaaguga

SEQ ID NO: 13060 - RNA, 4014 nt, Artificial Sequence
  derived and/or modified CDS sequence (opt1) from TOSV(SI-31051)__EU003174.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgggccggcacaacugcagcgaccuggaccgcaagcccuucugcaccgaguucaucaacguggccaagcccgccaacgagauggcgcccauguccgucaucccgccgcccaucgugaagcccauccccguggccgagcccaccaccaagaagacgauccccuucgacaagcugcucagcgaggccgagaaggagcugaaccagaccaagauccggcuggagaccgagcgccgguccaacgccgaggaggcggccaaggagcgcgcccggaugcgcgagaucgaggacaagcuccggaaggacugggagcuggagcgcgagcggaaggacgccgucgccgaggaccuggcgaaggagaucgcccgccggcgcgagaucgagcggaaggcccacgagcucgacaagaugcugaagaagaaggagcgcgaggaccugguggcccgggagcgcguggacgaggacaugcgcaaccacguccggcgccccaacaccacgaucgccccgaccaucaucaccacccuccugauggcgagcgccgugauggccgggccccuggagaaccgggagacgaaccaccuccugaaccgccccggcaacggggccuacacccuguccgacuucgccgagagcacgugcacccucgcguacggcuccgagugcaagagcugggagcaccagcuggacgagcugagcuuccccuucuuccacuccaaccucgacaaguacagcaugcuggaggccgccacggagaccaucccgauccugaacaaguccagcgccgugugcaccaucucccccagcacccacuccagcaacgccugcggccgggaggcgucccucaucaagaagaagugcgggagcgacauguccgccuucuucuacgucaaccuggccggccagaucacgguggugaagugcgacaccaaccacguccugagcaacgacugcgggaacugcaucuccaagacccucagcggccagaagaucuacacccccgugcaggacauguucugccagaagggcugguccgagagcauccccuccacgcgcuacagcaaggaccugugcuccaucgggcugcacaccgugaaggagugcaagaucggcaccaccaacuucgagcgggucggguucaucguggugaagggccgcaagauguacaucgagcagaugaagaugcggagccgccaggaguucagcgaggaccaguuccucugcuacaaguccgaggggagcuccggcagcuccgucaagcugaagaaggugaaggucgagagcugcaagggcgugacgaccuccagcgccuccaagugcagcggggacgaguacuucugcucccgguacccgugcgagaccgcgaacguggaggcccacugcauccugcgccggcacagcgccgucaucgaggugaacgugaacggcgucuggguggugccccgcugcaucggguacgaggagguccucgugcggcgcaccucccugaagguggaggacacgagcucccgggagugcgacacgugccugugggagugcggcaagaacaagcucaucgucaagacccacgggcccaagaucguguacgccaccgccugcagccacggcuccugcaagagcgugaugcagaagcccgcgaccuucgucuaccugccguaccccggcaacagcgagaucgucgggggcgacaucggggugcacaugaccgaggaguccagccccuccaacauccacaugguggcccacugccccgccaaggacagcugcgagguguccagcugccuguucugcgugcacggccugcucaacuaccagugccacacccuguucuccgcccugcucaucagcaccaccgucauguccauccugacgcugcuccugcugcucgugaagggggccaaggaccuggugaagcgccuguucuacuggcucaucaccccgcugugcuggcugagcgucuucugcggcuggaugauccgguccuggaagaagcgcgugggcagcgcgaucucccgcaccaacgacaccaucggguggcgggacaacagccgccggggccaggacaucgagcgcgcccaguacaccgggggcgcccccggcgccaaguacuccuucuacggggugaugauccucggccugcuggggaacguccacagcugcuccgagagcaucaucgccgacuccaagaucaugcagugcaccaccagcggcagcuccacccucugcaaggcgagcgggacggugaucaugaagcugggccccaucggcuccgagagcugccugauccucaaggggcugaaggacuccgagaagcaguucaucagcaucaagaccaucuccagcgagcugaccugccgggagggcgaguccuucuggaccacgcucuacaccccggugugccugagcucccgccggugccaccugaugggggagugcgucagcgaccgcugccuccgguggaagaccaacgagaccuccgccgaguucacgggcaaggcccacggggaggugaugcacgagaaccgcugcuucgagcagagcggcggcaucggguacggcugcuucaacgugaaccccuccugccuguacguccacagcuaccugaaguccguguacaagaacggguucaagaucuuccggugcguggccuggaaccaccgcauccggcucgaggucaccacccacagccgcaaguuccccauggugcugauggcgauguccacccagcccacggacuggggcagcaucgggcugauccucgacagcggcggcaucaccgggaccaacgccuacuccuucaugaagcacggccuggggagcuucgccaucaucgacgacccguacucccccgagccccggaagggcuuccugggggaggugcgcugccccaccgaggagacggccauccgggccagcccguccugcaagauggcgcccaaccucaucgaguaccagcccgagauggacaccgccgagugcaccaccaacaugaucgaccccauggccaucuucaaccgcggcagccugccgcagguccgggacggcaugacguucacccaguccaucgagaagaacaccgugcaggcccugaccacgggggaggugcgcgccagcauccggcucacccuggacgacuacgacgucguguaccagaacucccaguucgacugcagcgcgaccuucaagaaccugaccggcugcuacuccugcgacgaggggagccgcaugugcuaccaggugaaggccgagggcgagaccaucuuccacuucgucaacgaggacgaguccaucaacgugaucaacaaggugagccccgacgucuccgacuacugcacggugcuccacuucagccgccccgugaucuccaucgagggccgguacgacugcgggcugagcaagcgccccauggucaucaagggcacccugaucgccaccgccccgcacgacgaccggaagcacgagggcggguccagccucguggucaaccccaagggcgggaccguggacuucuucggcugggugagcgggcugacguccuggcugggcgggccccucaagaccuuccugaccauccugggcuuccucgcccuggggcugcuccuggucgugaucaucaucaucaucgcgcgcaccggcguggagcaggcccugaagaagaagaacaaguga

SEQ ID NO: 13061 - RNA, 4014 nt, Artificial Sequence
  derived and/or modified CDS sequence (opt1) from TOSV(SI-39538)__EU003175.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgggccggcacaacugcagcgaccuggaccgcaagcccuucuggaccgaguucaucaacguggccaagcccgccaacgagauggcgcccauguccgucaucccgccgcccaucgugaagcccauccccguggccgagagcaccaccaagaagacgauccccuucgacaagcugcucuccgaggccgagaaggagcugaaccagaccaagauccggcuggagaccgagcgccggagcaacgccgaggaggcggccaaggagcgcgcccggaugcgcgagaucgaggacaagcuccggaaggacugggagcuggagcgcgagcggaaggacgccgucgccgaggaccuggcgaaggagaucgcccgccggcgcgagaucgagcggaaggcccacgagcucgacaagaugcugaagaagaaggagcgcgaggaccugguggcccgggagcgcguggacgaggacaugcgcaaccacguccggcgccccaacaccacgaucgcccccaccaucaucaccacccuccugauggcguccgccgugauggccgggccgcuggagaaccgggagacgaaccaccuccugaaccgccccggcaacggggccuacacccugagcgacuucgccgaguccacgugcacccucgcguacggcagcgagugcaagagcugggagcaccagcuggacgagcuguccuuccccuucuuccacagcaaccucgacaaguacuccaugcuggaggccgccacggagaccauccccauccugaacaagagcuccgccgugugcaccaucagcccguccacccacagcuccaacgccugcggccgggaggcgagccucaucaagaagaagugcggguccgacaugagcgccuucuucuacgucaaccuggccggccagaucacgguggugaagugcgacaccaaccacguccuguccaacgacugcgggaacugcaucagcaagacccucuccggccagaagaucuacacccccgugcaggacauguucugccagaagggcuggagcgaguccauccccagcacgcgcuacuccaaggaccugugcagcaucgggcugcacaccgugaaggagugcaagaucggcaccaccaacuucgagcgggucggguucaucguggugaagggccgcaagauguacaucgagcagaugaagaugcggagccgccaggaguucuccgaggaccaguuccucugcuacaagagcgagggguccagcggcuccagcgucaagcugaagaaggugaaggucgaguccugcaagggcgugacgaccagcuccgccagcaagugcuccggggacgaguacuucugcagccgguaccccugcgagaccgcgaacguggaggcccacugcauccugcgccggcacuccgccgucaucgaggugaacgugaacggcgucuggguggugccgcgcugcaucggguacgaggagguccucgugcggcgcaccagccugaagguggaggacacguccagccgggagugcgacacgugccugugggagugcggcaagaacaagcucaucgucaagacccacgggcccaagaucguguacgccaccgccugcucccacggcagcugcaagagcgugaugcagaagcccgcgaccuucgucuaccugcccuacccgggcaacuccgagaucgucgggggcgacaucggggugcacaugaccgaggagagcucccccagcaacauccacaugguggcccacugccccgccaaggacuccugcgaggugagcuccugccuguucugcgugcacggccugcucaacuaccagugccacacccuguucagcgcccugcucaucuccaccaccgucaugagcauccugacgcugcuccugcugcucgugaagggggccaaggaccuggugaagcgccuguucuacuggcucaucacgccccugugcuggcuguccgucuucugcggcuggaugauccggagcuggaagaagcgcgugggcuccgcgaucagccgcaccaacgacaccaucggguggcgggacaacucccgccggggccaggacaucgagcgcgcccaguacaccgggggcgccccgggcgccaaguacagcuucuacggggugaugauccucggccugcuggggaacguccacuccugcagcgaguccaucaucgccgacagcaagaucaugcagugcaccaccagcggcuccagcacccucugcaaggcguccgggaccgugaucaugaagcugggccccaucggcagcgaguccugccugauccucaaggggcugaaggacagcgagaagcaguucaucuccaucaagaccaucagcuccgagcugaccugccgggagggcgagagcuucuggaccacgcucuacacccccgugugccuguccagccgccggugccaccugaugggggagugcgucuccgaccgcugccuccgguggaagaccaacgagaccagcgccgaguucacgggcaaggcccacggggaggugaugcacgagaaccgcugcuucgagcaguccggcggcaucggguacggcugcuucaacgugaacccgagcugccuguacguccacuccuaccucaagagcguguacaagaacggguucaagaucuuccggugcguggccuggaaccaccgcauccggcacgaggucaccacccacucccgcaaguuccccauggugcugauggcgaugagcacccagcccacggacuggggcagcaucgggcugauccuggacuccggcggcaucaccgggaccaacgccuacagcuucaugaagcacggccucggguccuucgccaucaucgacgaccccuacagcccggagccccggaagggcuuccugggggaggugcgcugccccaccgaggagacggccauccgggccucccccagcugcaagauggcgccgaaccugaucgaguaccagcccgagauggacaccgccgagugcaccaccaacaugaucgaccccauggccaucuucaaccgcggcucccucccccagguccgggacggcaugacguucacccagagcaucgagaagaacaccgugcaggcccugaccacgggggaggugcgcgccuccauccggcugacccucgacgacuacgacgucguguaccagaacagccaguucgacugcuccgcgaccuucaagaaccugaccggcugcuacagcugcgacgaggggucccgcaugugcuaccaggugaaggccgagggcgagaccaucuuccacuucgucaacgaggacgagagcaucaacgugaucaacaagguguccccggacgucagcgacuacugcacggugcugcacuucucccgccccgugaucagcaucgagggccgguacgacugcgggcucuccaagcgccccauggucaucaagggcacccugaucgccaccgcgccccacgacgaccggaagcacgagggcgggagcagccugguggucaacccgaagggcgggaccguggacuucuucggcuggguguccgggcucacgagcuggcugggcgggccccugaagaccuuccucaccauccugggcuuccuggcccucgggcugcugcucgucgugaucaucaucaucaucgcccgcaccggcguggagcaggcccugaagaagaagaacaaguga

SEQ ID NO: 13062 - RNA, 4014 nt, Artificial Sequence
  derived and/or modified CDS sequence (opt1) from TOSV(SI-40463)__EU003176.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcgucgaggugcugaacgacgugauccccgacgagcucaacccgggccggcacaacugcagcgaccuggaccgcaagcccuucuggaccgaguucaucaacgucgccaagcccgugaacgagauggcccccauguccgugaucccgccgcccaucgucaagcccauccccguggcggagagcaccaccaagaagacgauccccuucgacaagcugcucuccgaggccgagaaggagcugaaccagaccaagauccggcuggagaccgagcgccggagcaacgccgaggaggccgcgaaggagcgcgcccggaugcgcgagaucgaggacaagcuccggaaggacugggagcuggagcgcgagcggaaggacgccguggccgaggaccuggccaaggagaucgcgcgccggcgcgagaucgagcggaaggcccacgagcucgacaagaugcugaagaagaaggagcgcgaggaccuggucgcccgggagcgcguggacgaggacaugcgcaaccacgugcggcgccccaacaccacgaucgcccccaccaucaucaccacccuccugauggccuccgcggucauggccgggccgcuggagaaccgggagacgaaccaccuccugaaccgccccggcaacggggccuacacccugagcgacuucgccgaguccacgugcacccucgccuacggcagcgagugcaagagcugggagcaccagcuggacgagcuguccuuccccuucuuccacagcaaccucgacaaguacuccaugcuggaggcggccacggagaccauccccauccugaacaagagcuccgccgugugcaccaucagcccguccacccacagcuccaacgccugcggccgggaggccagccucaucaagaagaagugcggguccgacaugagcgcguucuucuacgugaaccuggccggccagaucacggucgugaagugcgacaccaaccacgugcuguccaacgacugcgggaacugcaucagcaagacccucuccggccagaagaucuacacccccguccaggacauguucugccagaagggcuggagcgaguccauccccagcacgcgcuacuccaaggaccugugcagcaucgggcugcacaccgugaaggagugcaagaucggcaccaccaacuucgagcgggugggguucaucgucgugaagggccgcaagauguacaucgagcagaugaagaugcggagccgccaggaguucuccgaggaccaguuccucugcuacaagagcgagggguccagcggcuccagcgucaagcugaagaaggugaagguggaguccugcaagggcgucacgaccagcuccgccagcaagugcuccggggacgaguacuucugcagccgguaccccugcgagaccgccaacguggaggcgcacugcauccugcgccggcacuccgccgugaucgaggucaacgugaacggcgugugggucgugccgcgcugcaucggguacgaggaggugcucguccggcgcaccagccugaagguggaggacacguccagccgggagugcgacacgugccugugggagugcggcaagaacaagcucaucgugaagacccacgggcccaagaucgucuacgccaccgccugcucccacggcagcugcaagagcgugaugcagaagcccgccaccuucguguaccugcccuacccgggcaacuccgagaucgucgggggcgacaucggggugcacaugaccgaggagagcucccccagcaacauccacaugguggcgcacugccccgccaaggacuccugcgaggucagcuccugccuguucugcgugcacggccugcucaacuaccagugccacacccuguucagcgcccugcucaucuccaccaccgugaugagcauccugacgcugcuccugcugcucgucaagggggccaaggaccuggugaagcgccuguucuacuggcucaucacgccccugugcuggcuguccguguucugcggcuggaugauccggagcuggaagaagcgcgucggcuccgccaucagccgcaccaacgacaccaucggguggcgggacaacucccgccggggccaggacaucgagcgcgcgcaguacaccgggggcgccccgggcgccaaguacagcuucuacggggugaugauccucggccugcuggggaacgugcacuccugcagcgaguccaucaucgccgacagcaagaucaugcagugcaccaccagcggcuccagcacccucugcaaggccuccgggaccgucaucaugaagcugggccccaucggcagcgaguccugccugauccucaaggggcugaaggacagcgagaagcaguucaucuccaucaagaccaucagcuccgagcugaccugccgggagggcgagagcuucuggaccacgcucuacacccccgugugccuguccagccgccggugccaccugaugggggagugcguguccgaccgcugccuccgguggaagaccaacgagaccagcgcggaguucacgggcaaggcccacggggaggucaugcacgagaaccgcugcuucgagcaguccggcggcaucggguacggcugcuucaacgugaacccgagcugccuguacgugcacuccuaccucaagagcgucuacaagaacggguucaagaucuuccggugcguggccuggaaccaccgcauccggcuggaggugaccacccacucccgcaaguuccccaugguccugauggccaugagcacccagcccacggacuggggcagcaucgggcugauccucgacuccggcggcaucaccgggaccaacgcguacagcuucaugaagcacggccugggguccuucgccaucaucgacgaccccuacagcccggagccccggaagggcuuccugggggaggugcgcugccccaccgaggagacggccauccgggccucccccagcugcaagauggccccgaaccucaucgaguaccagcccgagauggacaccgcggagugcaccaccaacaugaucgaccccauggccaucuucaaccgcggcucccugccccaggugcgggacggcaugacguucacccagagcaucgagaagaacaccguccaggcccugaccacgggggaggugcgcgccuccauccggcucacccuggacgacuacgacguggucuaccagaacagccaguucgacugcuccgccaccuucaagaaccugaccggcugcuacagcugcgacgaggggucccgcaugugcuaccaggugaaggcggagggcgagaccaucuuccacuucgugaacgaggacgagagcaucaacgucaucaacaagguguccccggacgugagcgacuacugcacgguccuccacuucucccgccccgugaucagcaucgagggccgguacgacugcgggcuguccaagcgccccauggucaucaagggcacccugaucgccaccgcgccccacgacgaccggaagcacgagggcgggagcagccucguggugaacccgaagggcgggaccgucgacuucuucggcuggguguccgggcugacgagcuggcugggcgggccccucaagaccuuccugaccauccugggcuuccucgcccuggggcugcuccugguggucaucaucaucaucaucgcccgcaccggcguggagcaggcccugaagaagaagaacaaguga

SEQ ID NO: 13063 - RNA, 4020 nt, Artificial Sequence
  derived and/or modified CDS sequence (opt1) from TOSV(SI-40614)__EU003177.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgacugcaagcgggacaucaugagcaacuacguggccgaggugcacuccaaccuccacggccugggcgccaugaugcacaacuacggggacgacaagcgcgucgaggugcugaacgacgugauccccgacgagcucaacccgggccggcacaacugcagcgaccuggaccgcaagcccuucuggaccgaguucaucaacgucgccaagcccgccaacaagaucgcgcccaucuccgugaucccgccgcccaucgugaagcccauccccaucgccgagagcaccaucaagaagaccauccccuucgacaagcugcucuccgaggccgagaaggagcugaaccagacgaagauccggcuggagaccgagcgccggagcaacgccggggaggcggcccgcgagcgggcccgcaugcgggagaucgaggacaagcuccgcaagaacugggagcuggagcgggagcgcaaggacgccgucgccgacgaccuggcgaaggagaucgcccggcgccgggagaucgagcgcaaggcccacgagcucgacaagaugcugaagaagaaggagcgggaggaccagguggccaucgagcgcguguccgaggacaugcgcaaccacguccggcgccccaacaccaccaucgcccccgcgccgacgaucaucaccacccugcucauggccagcgccgugauggccggcccccuggagaaccgggagaccaaccaccuccugaaccgccccgggaacggcgccuacacgcuguccgacuucgcggagagcacgugcacccuggccuacggcagcgagugcaaguccugggagcaccagcucgacgagcugagcuuccccuucuuccacuccaaccuggacaaguacagcaugcucgaggccgccaccgagaccaucccgauccugaacaaguccagcgccgugugcaccaucucccccagcacccacuccagcaacgcgugcgggcgggaggccucccugaucaagaagaagugcggcaacaacaugagcgccuucuucuacgucaaccucgccgggcagaucaccguggugaagugcgacacgaaccacguccuguccaacgacugcggcaacugcaucagcaagacccuguccggccagaagaucuacacccccgugcaggacauguucugccagcgcggguggaccgagagcauccccuccacgcgguacagcaaggaccucugcuccaucggccugcacaccgugaaggagugcaagaccggggcgaccaacuucgagcgcgucggcuucaucguggucaagagccggaagauguacaucgagcagaugaagaugcgcagccggcaggaguucuccgaggaccaguuccugugcuacaagagcgaguccagcuccgggagcuccgugaagcucaagaaggugaaggucgagagcugcaagggcgugacgaccuccagcgccuccaagugcagcggcgacgaguacuucugcucccgcuacccgugcgagaccgccaacguggaggcccacugcauccugcggcgccacagcgccgucaucgaggugaacgugaacggggucuggguggugccccggugcaucggcuacgaggagguccuggugcgccggaccucccucaagauggaggacacgagcucccgcgagugcgacacgugccugugggagugcgggaagaacaagcugaucgugaagacccacggccccaagaucgucuacgcgaccgccugcagccacgggagcugcaaguccgugaugcagaagcccgccaccuucguguaccucccguaccccggcaacagcgagaucgucggcggggacaucggcgugcacaugaccgaggaguccagccccuccaacauccacaugguggcccacugccccgccaaggacagcugcgaggucuccagcugccuguucugcgugcacgggcugcugaacuaccagugccacacccucuucuccgcgcugcugaucagcaccaccgugauguccauccucacgcugcugcuccugcuggucaagggcgccaaggaccucgugaagaagcuguucuacuggcugaucaccccgcucugcuggcugagcguguucugcggguggaugaucaaguccuggaagaagcgggucggcagcgccaucucccgcaccaacgacaccaucggcuggcgcgacaaccggcgcuacgggcgggacguggagcgcgcccaguacacgggcggggugcccggcgccaucuacagcuucuacggcgucaugauccuggggcuccugggcaacgugcacuccugcagcgaguccgugaucgcggacagcaaggucaugcagugcaccaccagcggguccagcacccugugcaaggccuccggcacggugaucaugaagcucgggcccaucggcagcgaguccugccugauccugaagggccucaaggacaacgagaagcaguucaucagcaucaagaccaucuccagcgagcugaccugccgggagggggaguccuucuggaccacgcuguacaccccggugugccucagcucccgccggugccaccugaugggcgagugcgucagcgaccgcugccugaaguggaagaccaacgagaccucccccgaguucacggggaaggcccacggcgaggugaugcacgagaaccggugcuucgagcagagcgggggcaucggcuacgggugcuucaacgugaaccccuccugccucuacguccacagcauccugaaguccguguacaagaacggcuucaagaucuuccgcugcguggccuggaaccaccggauccgccuggaggucaccacccacagccggaaguuccccauggugcucauggcgauguccacccagccgacggacugggggagcaucggccugauccuggacagcgaggggaucaccggcaccaacgccuacuccuucaugaagcacggcagcggguccuucgccaucaucgacgaccccuacagccccgagccccgcaagggcuuccucggggaggugcggugcccgaccgaggagacggccauccgcgccucccccagcugcaagauggcgcccaaccugaucgaguaccagcccgagauggacaccgccgagugcaccaccaacaugaucgacccgauggccaucuucaaccggggcucccugccccagguccgcgacgggaugacguucacccagagcaucgagaagaacaccgugcaggcccucaccacgggcgaggugcgggccuccauccgccugacccuggacgacuacgacgucguguaccagaacagccaguccgacugcagcgcgaccuucaagaaccucaccggcugcuacuccugcgacgaggggagccggaugugcuaccaggugaaggccgagggcgagaccaucuuccacuucgucaacgaggacgaguccaucaacgugaucaacaaggugagccccgacgucuccgacuacugcacggugcugcacuucagccgccccgucaucuccaucgaggggcgcuacgacugcggccugagcaagcggccgauggugaucaagggcacccucaucgccaccgcgccccacgacgaccgcaagcacgagggcgggagcucccugguggucaaccccaagggcgggaccguggacuucuucgggugggugagcggccugacguccuggcucggcgggccccugaagaccuuccugaccauccucggcuuccuggcccuggggcuccugcuggucgugaucaucaucaucaucgcccggaccggcguggagcaggcccucaagaagaagaacaaguga

SEQ ID NO: 13064 - RNA, 4014 nt, Artificial Sequence
  derived and/or modified CDS sequence (opt1) from TOSV(SI-51903)__EU003178.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgggccggcacaacugcagcgaccuggaccgcaagcccuucuggaccgaguucaucaacguggccaagcccgccaacgagaucgcgcccauguccgucaucccgccgcccaucgugaagcccauccccguggccgagagcaccaccaagaagacgauccccuucgacaagcugcucuccgaggccgagaaggagcugaaccagaccaagauccggcuggagaccgagcgccggagcaacgccgaggaggcggccaaggagcgcgcccggaugcgcgagaucgaggacaagcuccggaaggacugggagcuggagcgcgagaagaaggacgccgucgccgaggaccuggcgaaggagaucgcccggcgccgggagaucgagcgcaaggcccacgagcucgacaagaugcugaagaagaaggagcgggaggaccugguggcccgcgagcggguggacgaggacaugcgcaaccacguccgccggcccaacgccaccaucgcgcccacgaucaucaccacccuccugauggccuccgccgugauggccgggccgcuggagaaccgcgagaccaaccaccuccugaaccggcccggcaacggggccuacacgcugagcgacuucgcggaguccacgugcacccucgccuacggcagcgagugcaagagcugggagcaccagcuggacgagcuguccuuccccuucuuccacagcaaccucgacaaguacuccaugcuggaggccgccaccgagaccauccccauccugaacaagagcuccgccgugugcaccaucagcccguccacccacagcuccaacgcgugcggccgcgaggccagccucaucaagaagaagugcggguccgacaugagcgccuucuucuacgucaaccuggccggccagaucaccguggugaagugcgacacgaaccacguccuguccaacgacugcgggaacugcaucagcaagacccucuccggccagaagaucuacacccccgugcaggacauguucugccagaagggcuggagcgaguccauccccagcacccgguacuccaaggaccugugcagcaucgggcugcacacggugaaggagugcaagaucggcaccaccaacuucgagcgcgucggguucaucguggugaagggccggaagauguacaucgagcagaugaagaugcgcagccggcaggaguucuccgaggacgaguuccucugcuacaagagcgagggguccagcggcuccagcgucaagcugaagaaggugaaggucgaguccugcaagggcgugaccacgagcuccgcgagcaagugcuccggggacgaguacuucugcagccgcuaccccugcgagaccgccaacguggaggcccacugcauccugcggcgccacuccgccgucaucgaggugaacgugaacggcgucuggguggugccgcggugcaucggguacgaggagguccucgugcgccggaccagccugaagguggaggacaccuccagccgcgagugcgacacgugccugugggagugcggcaagaacaagcucaucgucaagacccacgggcccaagaucguguacgccaccgcgugcucccacggcagcugcaagagcgugaugcagaagcccgccaccuucgucuaccugcccuacccgggcaacuccgagaucgucgggggcgacaucggggugcacaugaccgaggagagcucccccagcaacauccacaugguggcccacugccccgccaaggacuccugcgaggugagcuccugccuguucugcgugcacggccugcucaacuaccagugccacacgcuguucagcgcccugcucaucuccaccaccgucaugagcauccugacccugcuccugcugcucgugaagggggcgaaggaccuggugaagcggcuguucuacuggcucaucacgccccugugcuggcuguccgucuucugcggcuggaugauccgcagcuggaagaagcgggugggcuccgccaucagccgcaccaacgacaccaucggguggcgcgacaacucccggcgcggccaggacguggagcgggcccaguacaccgggggcgccccgggcgccaaguacagcuucuacggggucaugauccucggccugcuggggaacgugcacuccugcagcgaguccaucaucgcggacagcaagaucaugcagugcacgaccagcggcuccagcacccucugcaaggccuccgggaccgugaucaugaagcugggccccaucggcagcgaguccugccugauccucaaggggcugaaggacagcgagaagcaguucaucuccaucaagacgaucagcuccgagcugaccugccgcgagggcgagagcuucuggaccacccucuacacgcccgucugccuguccagccggcgcugccaccugaugggggagugcguguccgaccggugccuccgcuggaagaccaacgagaccagcgccgaguucaccggcaaggcccacggggaggugaugcacgagaaccggugcuucgagcaguccggcggcaucggguacggcugcuucaacgucaacccgagcugccuguacgugcacuccuaccucaagagcguguacaagaacggguucaagaucuuccgcugcgucgcguggaaccaccggauccgccuggaggugacgacccacucccggaaguuccccauggugcugauggccaugagcacccagcccaccgacuggggcagcaucgggcugauccucgacuccggcggcaucacggggaccaacgccuacagcuucaugaagcacggccugggguccuucgccaucaucgacgaccccuacagcccggagccccgcaagggcuuccugggggagguccggugccccaccgaggagaccgccauccgcgcgucccccagcugcaagauggccccgaaccucaucgaguaccagcccgagauggacacggccgagugcaccaccaacaugaucgaccccauggccaucuucaaccggggcucccugccccaggugcgcgacggcaugaccuucacgcagagcaucgagaagaacaccgugcaggcccugaccaccggggagguccgggcguccauccgccucacgcuggacgacuacgacgugguguaccagaacagccaguucgacugcuccgccaccuucaagaaccugaccggcugcuacagcugcgacgaggggccgcggaugugcuaccaggucaaggccgagggcgagaccaucuuccacuucgugaacgaggacgaguccaucaacgugaucaacaaggucagccccgacguguccgacuacugcaccgugcuccacuucagccgccccgucaucuccaucgagggccgcuacgacugcgggcugagcaagcggcccauggugaucaagggcacgcugaucgccaccgccccgcacgacgaccgcaagcacgagggcggguccagccucgucgugaaccccaagggcgggaccguggacuucuucggcugggucagcgggcugaccuccuggcugggcgggccccucaagacguuccugaccauccugggcuuccucgcgcuggggcugcuccugguggugaucaucaucaucaucgcccggaccggcgucgagcaggcccugaagaagaagaacaaguga

SEQ ID NO: 13065 - RNA, 4014 nt, Artificial Sequence
  derived and/or modified CDS sequence (opt1) from TOSV(SI-68809)__EU003179.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgggccggcacaacugcagcgaccuggaccgcaagcccuucuggaccgaguucaucgacguggccaagcccgccaacgagaucgcgcccauguccgucaucccgccgcccaucgugaagcccauccccguggccgagagcaccaucaagaagaccauccccuucgacaagcugcucuccgaggccgaggaggagcugaaccagacgaagauccggcuggagaccgagcgccggagcaacgccgaggaggcggccaaggagcgcgcccggaugcgcgagaucgaggacaagcuccggaaggacugggagcuggagcgcgagcggaaggacgccgucgccgaggaccuggcgaaggagaucgcccgccggcgcgagaucgagcggaaggcccacgagcucgacaagaugcugaagaagaaggagcgcgaggaccugguggcccgggagcgcgugaacgaggacaugcgcaaccacguccggcgccccaacaccaccaucgcccccacgaucaucaccacccuccugauggcguccgccgugauggccgggccgcuggagaaccgggagaccaaccaccuccugaaccgccccggcaacggggccuacacgcugagcgacuucgccgaguccacgugcacccucgcguacggcagcgagugcaagagcugggagcaccagcuggacgagcuguccuuccccuucuuccacagcaaccucgacaaguacuccaugcuggaggccgccaccgagacgauccccauccugaacaagagcuccgccgugugcaccaucagcccguccacccacagcuccaacgccugcggccgggaggcgagccucaucaagaagaagugcggguccaacaugagcgccuucuucuacgucaaccuggccggccagaucaccguggugaagugcgacacgaaccacguccuguccaacgacugcgggaacugcaucagcaagacccucuccggccagaagaucuacacccccgugcaggacauguucugccagaagggcuggagcgaguccauccccagcacccgcuacuccaaggaccugugcagcaucgggcugcacacggugaaggagugcaagaccggcaccaccaacuucgagcgggucggguucaucguggugaagggccgcaagauguacaucgagcagaugaagaugcggagccgccaggaguucuccgaggaccaguuccucugcuacaagagcgagggguccagcggcuccagcgucaagcugaagaaggugaaggucgaguccugcaagggcgugacgaccagcuccgccagcaagugcuccggggacgaguacuucugcagccgguaccccugcgagaccgcgaacguggaggcccacugcauccugcgccggcacuccgccgucaucgaggugaacgugaacggcgucuggguggugccgcgcugcaucggguacgaggagguccucgugcggcgcaccagccugaagguggaggacacguccagccgggagugcgacacgugccugugggagugcggcaagaacaagcucaucgucaagacccacgggcccaagaucguguacgccaccgccugcucccacggcagcugcaagagcgugaugcagaagcccgcgaccuucgucuaccugcccuacccgggcaacuccgagaucgucgggggcgacaucggggugcacaugaccgaggagagcucccccagcaacauccacaugguggcccacugccccgccaaggacuccugcgaggugagcuccugccuguucugcgugcacggccugcucaacuaccagugccacacccuguucagcgcccugcucaucuccaccaccgucaugagcauccugacgcugcuccugcugcucgugaagggggccaaggaccuggugaagcgccuguucuacuggcucaucacgccccugugcuggcuguccgucuucugcggcuggaugauccggagcuggaagcgccgcgugggcuccgcgaucagccggaccaacgacaccaucggguggcgcgacaacucccggcgcggccaggacguggagcgggcccaguacaccgggggcgccccgggcgccaaguacagcuucuacggggucaugauccucggccugcugggggaggugcacuccugcagcgaguccaucaucgccgacagcaagaucaugcagugcaccaccagcggcuccagcacccucugcaaggcguccgggaccgugaucaugaagcugggccccaucggcagcgaguccugccugauccucaaggggcugaaggacagcgagaagcaguucaucuccaucaagaccaucagcuccgagcugaccugccgcgagggcgagagcuucuggaccacgcucuacacccccgucugccuguccagccggcgcugccaccugaugggggagugcguguccgaccggugccucaaguggaagaccaacgagaccagcgccgaguucacgggcaaggcccacggggaggugaugcacgagaaccgcugcuucgagcaguccggcggcaucggguacggcugcuucaacgucaacccgagcugccuguacgugcacuccuaccucaagagcguguacaagaacggguucaagaucuuccggugcgucgccuggaaccaccgcauccggcuggaggugaccacccacucccgcaaguuccccauggugcugauggcgaugagcacccagcccacggacuggggcagcaucgggcugauccucgacuccggcggcaucaccgggaccaacgccuacagcuucaugaagcacggccugggguccuucgccaucaucgacgaccccuacagcccggagccccggaagggcuuccugggggagguccgcugccccaccgaggagacggccauccgggccucccccagcugcaagauggcgccgaaccucaucgaguaccagcccgagauggacaccgccgagugcaccaccaacaugaucgaccccauggccaucuucaaccgcggcucccugccccaggugcgggacggcaugacguucacccagagcaucgagaagaacaccgugcaggcccugaccacgggggagguccgcgccuccauccggcucacccuggacgacuacgacgugguguaccagaacagccaguucgacugcuccgcgaccuucaagaaccugaccggcugcuacagcugcgacgaggggucccgcaugugcuaccaggucaaggccgagggcgagaccaucuuccacuucgugaacgaggacgagagcaucaacgugaucaacaaggucuccccggacgugagcgacuacugcacggugcuccacuucucccgccccgucaucagcaucgagggccgguacgacugcgggcuguccaagcgccccauggugaucaagggcacccugaucgccaccgcgccccacgacgaccggaagcacgagggcgggagcagccucgucgugaacccgaagggcgggaccguggacuucuucggcugggucuccgggcugacgagcuggcugggcgggccccucaagaccuuccugaccauccugggcuuccucgcccuggggcugcuccugguggugaucaucaucaucaucgcccgcaccggcgucgagcaggcccugaagaagaagaacaaguga

SEQ ID NO: 13066 - RNA, 4014 nt, Artificial Sequence
  derived and/or modified CDS sequence (opt1) from TOSV(SI-76082)__EU003180.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgagugcaagcgggacaucaugagcaacuacguggccgaggugcacuccaaccuccacggccugggcgccaugaugcacaacuacggggacgacaagcgcaucgagguccugaacgacgugauccccgacgagcucaacccgggccggcacaacugcagcgaccuggaccgcaagcccuucuggaccgaguucaucaacguggccaagcccgccaacgagauggcgcccauguccgucaucccgccgcccaucgugaagcccauccccguggccgagagcaccaccaagaagacgauccccuucgacgagcugcucuccgaggccgagaaggagcugaaccagaccaagauccggcuggagaccgagcgccggagcaacgccgaggaggcggccaaggagcgcgcccggaugcgcgagaucgaggacaagcuccggaaggacugggagcuggagcgcgagcggaaggacgccgucgccgaggaccuggcgaaggagaucgcccgccggcgcgagaucgagcggaaggcccacgagcucgacaagaugcugaagaagaaggagcgcgaggaccugguggcccgggagcgcguggacgaggacaugcgcaaccacguccggcgccccaacaccacgaucgcccccaccaucaucaccacccuccugauggcguccgccgugauggccgggccgcuggagaaccgggagacgaaccaccuccugaaccgccccggcaacggggccuacacccugagcgacuucgccgaguccacgugcacccucgcguacggcagcgagugcaagagcugggagcaccagcuggacgagcuguccuuccccuucuuccacagcaaccucgacaaguacuccaugcuggaggccgccacggagaccauccccauccugaacaagagcuccgccgugugcaccaucagcccguccacccacagcuccaacgccugcggccgggaggcgagccucaucaagaagaagugcggguccgacaugagcgccuucuucuacgucaaccuggccggccagaucacgguggugaagugcgacaccaaccacguccuguccaacgacugcgggaacugcaucagcaagacccucuccggccagaagaucuacacccccgugcaggacauguucugccagaagggcuggagcgaguccauccccagcacgcgcuacuccaaggaccugugcagcaucgggcugcacaccgugaaggagugcaagaucggcaccaccaacuucgagcgggucggguucaucguggugaagggccgcaagauguacaucgagcagaugaagaugcggagccgccaggaguucuccgaggaccaguuccucugcuacaagagcgagggguccagcggcuccagcgucaagcugaagaaggugaaggucgaguccugcaagggcgugacgaccagcuccgccagcaagugcuccggggacgaguacuucugcagccgguaccccugcgagaccgcgaacguggaggcccacugcauccugcgccggcacuccgccgucaucgaggugaacgugaacggcgucuggguggugccgcgcugcaucggguacgaggagguccucgugcggcgcaccagccugaagguggaggacacguccagccgggagugcgacacgugccugugggagugcggcaagaacaagcucaucgucaagacccacgggcccaagaucguguacgccaccgccugcucccacggcagcugcaagagcgugaugcagaagcccgcgaccuucgucuaccugcccuacccgggcaacuccgagaucgucgggggcgacaucggggugcacaugaccgaggagagcucccccagcaacauccacaugguggcccacugccccgccaaggacuccugcgaggugagcuccugccuguucugcgugcacggccugcucaacuaccagugccacacccuguucagcgcccugcucaucuccaccaccgucaugagcauccugacgcugcuccugcugcucgugaagggggccaaggaccuggugaagcgccuguucuacuggcucaugacgccccugugcuggcuguccgucuucugcggcuggaugauccggagcuggaagaagcgcgugggcuccgcgaucagccgcaccaacgacaccaucggguggcgggacaacucccgccggggccaggacguggagcgcgcccaguacaccgggggcgccccgggcgccaaguacagcuucuacggggucaugauccucggccugcuggggaacgugcacuccugcagcgaguccaucaucgccgacagcaagaucaugcagugcaccaccagcggcuccagcacccucugcaaggcguccgggaccgugaucaugaagcugggccccaucggcagcgaguccugccugauccucaaggggcugaaggacagcgagaagcaguucaucuccaucaagaccaucagcuccgagcugaccugccgggagggcgagagcuucuggaccacgcucuacacccccgucugccuguccagccgccggugccaccugaugggggagugcguguccgaccgcugccuccgguggaagaccaacgagaccagcgccgaguucacgggcaaggcccacggggaggugaugcacgagaaccgcugcuucgagcaguccggcggcaucggguacggcugcuucaacgucaacccgagcugccuguacgugcacuccuaccucaagagcguguacaagaacggguucaagaucuuccggugcgucgccuggaaccaccgcauccggcuggaggugaccacccacucccgcaaguuccccauggugcugauggcgaugagcacccagcccacggacuggggcagcaucgggcugauccucgacuccggcggcaucaccgggaccaacgccuacagcuucaugaagcacggccugggguccuucgccaucaucgacgaccccuacagcccggagccccggaagggcuuccugggggagguccgcugccccaccgaggagacggccauccgggccucccccagcugcaagauggcgccgaaccucaucgaguaccagcccgagauggacaccgccgagugcaccaccaacaugaucgaccccauggccaucuucaaccgcggcucccugccccaggugcgggacggcaugacguucacccagagcaucgagaagaacaccgugcaggcccugaccacgggggagguccgcgccuccauccggcucacccuggacgacuacgacgugguguaccagaacagccaguucgacugcuccgcgaccuucaagaaccugaccggcugcuacagcugcgacgaggggucccgcaugugcuaccaggucaaggccgagggcgagaccaucuuccacuucgugaacgaggacgagagcaucaacgugaucaacaaggucuccccggacgugagcgacuacugcacggugcuccacuucucccgccccgucaucagcaucgagggccgguacgacugcgggcuguccaagcgccccauggugaucaagggcacccugaucgccaccgcgccccacgacgaccggaagcacgagggcgggagcagccucgucgugaacccgaagggcgggaccguggacuucuucggcugggucuccgggcugacgagcuggcugggcgggccccucaagaccuuccugaccauccugggcuuccucgcccuggggcugcuccugguggugaucaucaucaucaucgcccgcaccggcgucgagcaggcccugaagaagaagaacaaguga

SEQ ID NO: 13067 - RNA, 4020 nt, Artificial Sequence
  derived and/or modified CDS sequence (opt1) from TOSV(TOSV/Mantova.ITA/2013)__KM507329.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgacugcaagcgggacaucaugagcaacuacguggccgaggugcacuccaaccuccacggccugggcgccaugaugcacaacuacggggacgacaagcgcgucgaggugcugaacgacgugauccccgacgagcucaacccgggccggcacaacugcagcgaccuggaccgcaagcccuucuggaccgaguucaucaacgucgccaagcccgccaacaagaucgcgcccaucuccgugaucccgccgcccaucgugaagcccauccccaucgccgagagcaccaucaaggagaccauccccuucgagaagcugcucuccgaggccgagaaggagcugaaccagacgaagauccggcuggagaccgagcgccggagcaacgccgaggaggcggcccgcgagcgggcccgcguccgggagaucgaggacaagcuccgcaagaacugggagcuggagcgggagcgcaaggacgccguggccgacgaccuggcgaaggagaucgcccggcgccgggagaucgagcgcaaggcccacgagcucgacaagaugcugaagaagaaggagcgggaggaccagguggccaucgagcgcgucuccgaggacaugcgcaaccacgugcggcgccccaacaccaccaucgcccccgcgccgacgaucaucaccacccugcucauggccagcgccgugauggccgggccccuggagaaccgggagaccaaccaccuccugaaccgccccggcaacggggccuacacgcuguccgacuucgcggagagcacgugcacccuggccuacggcagcgagugcaaguccugggagcaccagcucgacgagcugagcuuccccuucuuccacuccaaccuggacaaguacagcaugcucgaggccgccaccgagaccaucccgauccugaacaaguccagcgccgucugcaccaucucccccagcacccacuccagcaacgcgugcggccgggaggccucccugaucaagaagaagugcgggaacaacaugagcgccuucuucuacgugaaccucgccggccagaucaccguggucaagugcgacacgaaccacgugcuguccaacgacugcgggaacugcuucagcaagacccuguccggccagaagaucuacacccccgugcaggacauguucugccagcgcggcuggaccgagagcauccccuccacgcgguacagcaaggaccucugcuccaucgggcugcacaccgucaaggagugcaagaccggcaccacgaacuucgagcgcgugggguucaucguggucaagagccggaagauguacaucgagcagaugaagaugcgcagccggcaggaguucuccgaggaccaguuccugugcuacaagagcgaguccagcuccggcagcuccgugaagcucaagaaggucaagguggagagcugcaagggggugaccaccuccagcgcguccaagugcagcggcgacgaguacuucugcucccgcuacccgugcgagaccgccaacgucgaggcccacugcauccugcggcgccacagcgccgugaucgaggugaacgucaacggcguguggguggucccccggugcaucggguacgaggaggugcuggugcgccggacgucccucaagauggaggacaccagcucccgcgagugcgacacgugccugugggagugcggcaagaacaagcugaucgucaagacccacgggcccaagaucguguacgccaccgcgugcagccacggcagcugcaaguccgugaugcagaagcccgccaccuucgucuaccucccguaccccgggaacagcgagaucgugggcggcgacaucggggugcacaugaccgaggaguccagccccuccaacauccacauggucgcccacugccccgccaaggacagcugcgagguguccagcugccuguucugcgugcacggccugcugaacuaccagugccacacccucuucuccgcccugcugaucagcaccacggucauguccauccucacccugcugcuccugcuggugaagggggcgaaggaccucgugaagaagcuguucuacuggcugaucaccccgcucugcuggcugagcgucuucugcggcuggaugaucaaguccuggaagaagcggguggggagcgccaucucccgcaccaacgacacgaucggcuggcgcgacaaccggcgcuacggccgggacguggagcgcgcccaguacaccgggggcgcccccggggccaaguacagcuucuacggcgucaugauccugggccuccuggggaacgugcacuccugcagcgaguccgugaucgcggacagcaaggucaugcagugcaccaccagcggcuccagcacgcugugcaaggccuccgggaccgugaucaugaagcucggccccaucgggagcgaguccugccugauccugaagggccucaaggacaacgagaagcaguucaucagcaucaagaccaucuccagcgagcugaccugccgggagggcgaguccuucuggacgacccuguacaccccggugugccucagcucccgccggugccaccugaugggggagugcgucagcgaccgcugccugaaguggaagaccaacgagacguccgccgaguucaccggcaaggcccacggggaggugaugcacgagaaccggugcuucgagcagagcggcgggaucggcuacggcugcuucaacgugaaccccuccugccucuacguccacagcuaccugaaguccguguacaagaacggguucaagaucuuccgcugcguggcguggaaccaccggauccgccuggaggucaccacccacagccggaaguuccccauggugcucauggccauguccacgcagcccaccgacuggggcagcaucgggcugauccuggacagcgagggcaucaccgggaccaacgccuacuccuucaugaagcacggcagcggcuccuucgccaucaucgacgacccguacagccccgagccccgcaagggguuccucggcgaggugcggugccccacggaggagaccgccauccgcgcguccccgagcugcaagauggcccccaaccugaucgaguaccagcccgagauggacaccgccgagugcaccacgaacaugaucgaccccauggccaucuucaaccgggggucccugccgcagguccgcgacggcaugaccuucacccagagcaucgagaagaacaccgugcaggcccucacgaccggggaggugcgggcguccauccgccugacccuggacgacuacgacgucguguaccagaacagccaguccgacugcagcgccaccuucaagaaccucaccggcugcuacuccugcgacgagggcagccggaugugcuaccaggugaaggccgagggggagacgaucuuccacuucgucaacgaggacgaguccaucaacgugaucaacaaggugagccccgacgucuccgacuacugcaccgugcugcacuucagccgccccgucaucuccaucgagggccgcuacgacugcgggcugagcaagcggcccauggugaucaagggcacccucaucgccaccgccccgcacgacgaccgcaagcacgagggcgggagcucccugguggucaaccccaagggcgggacgguggacuucuucggcugggugagcgggcugaccuccuggcucggcggcccccugaagaccuuccugaccauccucggguuccuggcgcugggccuccugcuggucgugaucaucaucaucaucgcccggacgggggugcagcaggcccucaagaagaagaacaaguga

SEQ ID NO: 13068 - RNA, 4020 nt, Artificial Sequence
  derived and/or modified CDS sequence (opt1) from TOSV(TOSV/Phl.233/FR/2009)__HQ184337.1__GP
auguucaucgccaagcugcuccugaucagcugccuggugcagcaggccuaccucaaguacaccaucaucuccgagaccggcaacgggacgcgcaccagcuucugcuacuccagccggaccucccugggcagccugcucgaggcgugggacaacgucaccgaguccaucgggcugacgagcgggaccugcaaggugggcucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagaucgugcccaugagcgugaucccgccgcccgucgugaagccccagccgcccgccgagcccuccagcaagaagcacgugcccuucgacguccuccuguccgaggcggagaaggagcugaaccagaccaagauccgccucgaggacgagcgcaagagcaacgccgaggagacggccaaggagcgggcccggaugaaggagaucgaggacgagcugcgccgggagugggagcuggagcgcaagcggaaggacgcgauggccgacgaccucgccaaggagaccgcccgccggcgcgagaucgagcggaaggcccacgagcuggacaagaugcugaagaagaaggagcgcgagucccucaucgcgaaggagaaggccgacgaggacaugcggagccacgugcacaagcccaacaccacccgcgcccccgcccccacgaucaucaccacccugcugauggccagcgcggcccucgccgggccccuggagaaccgggagaccaaccaccuccugaaccgcccgggcaacggggccuacacgcuguccgacuucgccgagagcacgugcacccuggcguacggcuccgagugcaagagcugggagcaccuccugaacgaggagcuguuccccuucuuccacuccaaccucgacaaguacagcaugcuggaggccgccaccgagacggugcccauccugaacaaguccagcgccgucugcaccaucucccccagcacccacuccagcaacgccugcggccgcgaggcguccgugauccggaagaagugcuacagcaacauguccgccuucuucuacaucaaccucgccgggcagaucaccgugaucaagugcgagacgaaccacguccugagcuccgacugcggcaacugcaucagcaagucccugagcgggcagaagguguacaccccggugcaggacgucuucugccagaagggcuggacccagagcauccccuccacccgcuacagcaaggacaucugcuccaucggccuccacacggugaaggagugcaagaucgggaccaccagcuucgagcgggugggcuucaucgucgugaaggggcgcaagauguacaucgagcagaugaagaugcggucccgccaggaguacagcgaggaccaguuccugugcuacaaguccgagagcggcuccgggagcuccgucaagcugaagaaguucaaggugcagagcugcaagggcgugaccacguccagcgccuccaagugcagcggcgacgaguacuucugcucccgguaccccugcgagaccgcgaacgucgaggcccacugcauccuccgccggcacagcgccaucguggaggugaacgucaacgggguguggguggucccccgcugcaucggcuacgaggaggugcuggugaagcggaccagccugaaggucgaggacaccacggggcgcgagugcgacuccugccucugggagugcggcaagaacaagcugaucgugaagacccacgggccgaagguggucuacgccaccgccugcagccacggcuccugcaagagcgugaugcagaagcccgcgaccuucguguaccugcccuaccccggcaacuccgagaucgucgggggcgacaucgggauccacaugaccgaggagagcuccccgagcaacauccaccugguggcccacugccccgcccgggacuccugcgacgugagcgacugccucuucugcguccacggccugcugaacuaccagugccacacccucuucuccgcccugcugaucagcaccaccgugauguccauccucacccugcugcuccugcuggugaagggggccaaggaccucgucaagaagcuguuccacuggcugaucacgccccucugcuggcugagcguguucugcugcuggguggucaaguccuggaagcgccgggugggcagcgcgaucucccgcaccaacgacaccaucggcuggcgggagaaccgccggcacgcccaggacaucgagcgcgcccaguacaccgggggcgccccgggggccaaguacagcuucuacggcgugaugauccugggccuccuguccagcgcgcagagcugcuccgagagcgucaucgccgacuccaagaucaugcagugcacgaccagcggguccagcacccugugcaaggccuccggcaccgugaucaugcgccucgggcccaucggcagcgaguccugccugauccugaaggggcucaaggacagcgagaagcaguucaucuccaucaagacgaucagcuccgagcugaccugccgggagggcgagagcuucuggaccacccuguacacgcccaucugccucuccagccgccggugccaccugaugggcgagugcguguccgaccgcugccugaaguggaagaccaaccagaccagcgccgaguucaccgggaaggcgcacggcgacgucaugcacgagaaccggugcuucgagcaguccgggggcaucggguacggcugcuucaacgugaaccccagcugccucuacgugcacagcuaccugaaguccgucuaccgcaacggcuucaagguguuccggugcguggccuggaaccaccgcauccggcuggaggucacgacccacagccgcaaguucccgauggugcucauggccauguccacccagcccaccgacugggggagcaucggccugauccuggacuccgaggggaucacgggcaccaacagcuacuccuucaugaagcacgggagcggcuccuucgccaucaucgacgaccccuacagccccgagccgcggaagggcuuccucggggaggugcgcugccccaccgaggagaccgccaugcgggcgucccccagcugcaagauggcccccaaccugaucgaguaccagccggagauggacacggccgagugcaccaccaacaugaucgaccccauggccaucuucaaccgcggcucccugccccagguccgggacgggaugaccuucacgcagagcaucgagaagaacaccgugcaggcccucaccaccggcgaggugaaggcguccauccgccugacgcuggacgacuacgacgucguguaccagaacagccaguccgacugcagcgccaccuucaagaaccucaccgggugcuacuccugcgacgagggcagccggcugugcuaccaggugaaggccgagggcgagaccaucuuccacuucaucaacgaggaggagagcaucaacgucaucaacaaggugucccccggggugagcgacuacugcaccguccugcacuucucccgcccggugaucagcaucgagggcacguacgacugcgggcucuccaagcggcccauggucaucaagggcacccugaucgccaccgcgccccacgacgaccgcaagcacgagggcgggagcucccugguggugaaccccaagggcgggagcgucgacuucuucggcuggcucuccgggcugaccagcuggcugggcggcccgcucaagacguuccugaccauccugggguuccucgccgugggccugcugcucguggucaucaucaucaucaucauccggaccgggaugcagcaggcccugaagaagaagaucaaguga

SEQ ID NO: 13069 - RNA, 4020 nt, Artificial Sequence
  derived and/or modified CDS sequence (opt1) from TOSV(TOSV/Phl.51/FR/2009)__HQ184336.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagaucgugcccaugagcgugaucccgccgcccgucgugaagcuccagccgcccgccgagcccuccagcaagaagcacgugcccuucgacguccugcuguccgaggcggagaaggagcucaaccagaccaagauccgccuggaggacgagcgcaagagcaacgccgaggagaccgccaaggagcgggcccggaugaaggagaucgaggacgagcugcgccgggagugggagcucgagcgcaagcggaaggacgcgauggccgacgaccuggccaaggagacggcccgccggcgcgagaucgaccggaaggcccacgagcuggaccgcaugcucaagaagaaggagcgggagucccugaucgcgaaggagaaggccgacgagaacaugcgcagccacgugcacgagcccaacaccacccgggcccccgcccccaccaucaucacgacccugcucauggccagcgcggcccuggccgggccccuggagaaccgcgagaccaaccaccuccugaaccgccccggcaacggggccuacacccuguccgacuucgccgagagcacgugcacccucgcguacggcuccgagugcaagagcugggagcaccuccugaacgaggagcuguucccguucuuccacuccaaccuggacaaguacagcaugcuggaggccgccaccgagaccgugcccauccucaacaaguccagcgccgucugcacgaucucccccagcacccacuccagcaacgccugcggccgggaggcguccgugauccgcaagaagugcuacagcaacauguccgccuucuucuacaucaaccuggccgggcagaucaccguggucaagugcgagaccaaccacgugcugagcuccgacugcggcaacugcaucagcaagucccucagcgggcagaagguguacacgcccguccaggacguguucugccagaagggcuggacccagagcaucccguccacccgguacagcaaggacaucugcuccaucggccugcacaccgugaaggagugcaagaucgggacgaccagcuucgagcgcgucggcuucaucguggucaaggggcggaagauguacaucgagcagaugaagaugcgcucccggcaggaguacagcgaggaccaguuccugugcuacaaguccgagagcggcuccgggagcuccgugaagcucaagaaguucaagguggagagcugcaagggcgucaccaccuccagcgccuccaagugcagcggcgacgaguacuucugcucccgcuuccccugcgagacggcgaacguggaggcccacugcauccugcggcgccacagcgccaucguggaggucaacgugaacggggugugggucgugccccggugcaucggcuacgaggaggugcuggucaagcgcaccagccucaagguggaggacaccaccgagcgggagugcgacuccugccugugggagugcgggaagaacaagcugaucgugaagacgcacggccccaaggucguguacgccaccgccugcagccacggguccugcaagagcgugaugcagaagccggcgaccuucgucuaccugcccuaccccggcaacuccgagaucgugggcggggacaucggcauccacaugaccgaggagagcucccccagcaacauccaccucguggcccacugcccggcccgcgacuccugcgacgucagcgacugccuguucugcgugcacgggcugcucaacuaccagugccacacccuguucuccgcccugcucaucagcacgaccgugauguccauccugacccugcuccugcugcucgucaagggcgccaaggaccuggugaagaagcuguuccacuggcucaucacgccccugugcuggcugagcguguucugcugcugggucgugaaguccuggaagcggcgcguggggagcgcgaucucccggaccaacgacaccaucggcuggcgcgagaaccggcgccacgcccaggacaucgagcgcgcccaguacaccggcggggcccccggcgccaaguacagcuucuucggggucaugauccucggccugcuguccagcgcgcagagcugcuccgagagcgugaucgccgacuccaagaucaugcagugcaccacgagcggcuccagcacccucugcaaggccuccgggaccgugaucaugcggcugggcccgaucgggagcgaguccugccugauccucaagggccugaaggacagcgagaagcaguucaucuccaucaagaccaucagcuccgagcugacgugccgcgagggggagagcuucuggaccacccucuacacccccaucugccuguccagccggcgcugccaccugaugggcgagugcgucuccgaccggugccucaaguggaagacgaaccagaccagcgccgaguucaccggcaaggcgcacggggacgugaugcacgagaaccgcugcuucgagcaguccggcgggaucggcuacgggugcuucaacgugaaccccagcugccuguacguccacagcuaccugaaguccguguaccggaacggcuucaagguguuccgcugcgucgccuggaaccaccggauccgccucgaggugaccacgcacagccggaaguuccccauggugcugauggccauguccacccagccgaccgacuggggcagcaucgggcugauccucgacuccgagggcaucaccgggacgaacagcuacuccuucaugaagcacggcagcggguccuucgccaucaucgacgaccccuacagccccgagccccgcaagggcuuccugggcgagguccggugcccgaccgaggagaccgccaugcgcgcgucccccagcugcaagauggcccccaaccugguggaguaccagcccgagauggacaccgccgagugcacgaccaacaugaucgacccgauggccaucuucaaccgggggucccucccccaggugcgcgacggcaugaccuucacccagagcaucgagaagaacacgguccaggcccugaccaccggggaggugaaggcguccauccggcugacccucgacgacuacgacguggucuaccagaacagccaguccgacugcagcgccacguucaagaaccugaccggcugcuacuccugcgacgaggggagccgccugugcuaccaggugaaggccgagggcgagaccaucuuccacuucaucaacgaggaggagagcaucaacgugaucaacaaggucagcccccggguguccgacuacugcaccguccuccacuucucccgccccgugaucagcaucgagggcaccuacgacugcgggcuguccaagcggccgauggugaucaagggcacgcugaucgccaccgcgccccacgacgaccgcaagcacgagggcgggagcucccucgucgugaaccccaagggcgggagcguggacuucuucggcuggcuguccgggcugaccagcuggcucggcgggccccugaagaccuuccugacgauccucggcuuccuggccgucggccugcuccugguggugaucaucaucaucaucauccgcaccgggaugcagcaggcccugaagaagaagaucaaguga

SEQ ID NO: 13070 - RNA, 4020 nt, Artificial Sequence
  derived and/or modified CDS sequence (opt1) from TOSV(11368)__KU925897.1__GP
auguucaucgccaagcugcuccugaucagcugccuggugcagcaggccuaccucaaguacaccaucaucuccgagaccggcaacgggacgcgcaccagcuucugcuacuccagccggaccucccugggcagccugcucgaggcgugggacaacgucaccgaguccaucgggcugacgagcgggaccugcaaggugggcucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagauggugcccaugagcgugaucccgccgcccgucgugaagcuccagccgcccgccgagcccuccagcaagaagcacgugcccuucgacguccugcuguccgaggcggagaaggagcucaaccagaccaagauccgccuggaggacgagcgcaagagcaacacggaggagaccgccaaggagcgggcccggaugaaggagaucgaggacgagcugcgccgggagugggagcucgagcgcaagcggaaggacgccauggcggacgaccuggccaaggagaccgcccgccggcgcgagaucgagcggaaggcccacgagcuggacaagaugcucaagaagaaggagcgcgagucccugaucgccaaggagaaggcggacgaggacaugcggagccacgugcacaagcccaacaccacgcgcgcccuggcccccaccaucaucaccacccuccugauggccagcgccgcgcuggccgggccccucgagaaccgggagacgaaccaccuccugaaccgccccggcaacggggccuacacccucuccgacuucgccgagagcacgugcacccuggccuacggcuccgagugcaagagcugggagcaccuccucaacgaggagcuguuccccuucuuccacuccaaccuggacaaguacagcaugcucgaggcggccacggagaccgugccgauccugaacaaguccagcgccgucugcaccaucucccccagcacccacuccagcaacgccugcggccgcgaggccuccgugauccggaagaagugcuacagcaacauguccgcguucuucuacaucaaccuggccgggcagaucacggugaucaagugcgagaccaaccacguccucagcuccgacugcggcaacugcaucagcaagucccugagcgggcagaagguguacacccccgugcaggacgucuucugccagaagggcuggacccagagcauccccuccacgcgcuacagcaaggacaucugcuccaucggccugcacaccgugaaggagugcaagaucgggaccaccagcuucgagcgggugggcuucaucgucgugaaggggcgcaagauguacaucgagcagaugaagaugcggucccgccaggaguacagcgaggaccaguuccucugcuacaaguccgagagcggcuccgggagcuccgucaagcugaagaaguucaaggugcagagcugcaagggcgugacgaccuccagcgccuccaagugcagcggcgacgaguacuucugcucccgguacccgugcgagaccgccaacgucgaggcgcacugcauccugcgccggcacagcgccaucguggaggugaacgucaacgggguguggguggucccccgcugcaucggcuacgaggaggugcucgugaagcggaccagccugaaggucgaggacacgaccgggcgcgagugcgacuccugccugugggagugcggcaagaacaagcugaucgugaagacccacgggcccaagguggucuacgccaccgccugcagccacggcuccugcaagagcgugaugcagaagcccgccaccuucguguaccucccguaccccggcaacuccgagaucgucgggggcgacaucgggauccacaugacggaggagagcucccccagcaacauccaccugguggcgcacugccccgcccgggacuccugcgacgugagcgacugccuguucugcguccacggccuccugaacuaccagugccacacccuguucuccgcccuccugaucagcaccaccgugauguccauccugacgcuccugcugcuccuggugaagggggccaaggaccuggucaagaagcuguuccacuggcugaucaccccgcugugcuggcucagcguguucugcugcuggguggucaaguccuggaagcgccgggugggcagcgccaucucccgcaccaacgacaccaucggcuggcgggagaaccgccggcacgcgcaggacaucgagcgcgcccaguacaccgggggcgcccccggggccaaguacagcuucuacggcgugaugauccugggccugcucuccagcgcccagagcugcuccgagagcgucaucgcggacuccaagaucaugcagugcaccaccagcggguccagcacccugugcaaggccuccggcacggugaucaugcgccuggggcccaucggcagcgaguccugccucauccugaaggggcugaaggacagcgagaagcaguucaucuccaucaagaccaucagcuccgagcugaccugccgggagggcgagagcuucuggaccacgcuguacaccccgaucugccuguccagccgccggugccaccucaugggcgagugcguguccgaccgcugccugaaguggaagaccaaccagaccagcgccgaguucacggggaaggcccacggcgacgucaugcacgagaaccggugcuucgagcaguccgggggcaucggguacggcugcuucaacgugaaccccagcugccuguacgugcacagcuaccucaaguccgucuaccgcaacggcuucaagguguuccggugcguggcguggaaccaccgcauccggcuggaggucaccacccacagccgcaaguuccccauggugcugauggccauguccacccagcccacggacugggggagcaucggccucauccuggacuccgaggggaucaccggcaccaacagcuacuccuucaugaagcacgggagcggcuccuucgccaucaucgacgacccguacagccccgagccccggaagggcuuccugggggaggugcgcugccccaccgaggagacggccaugcgggccuccccgagcugcaagauggcgcccaaccucaucgaguaccagcccgagauggacaccgccgagugcaccaccaacaugaucgaccccauggccaucuucaaccgcggcucccugccgcagguccgggacgggaugacguucacccagagcaucgagaagaacaccgugcaggcccugaccacgggcgaggugaaggccuccauccgccucauccuggacgacuacgacgucguguaccagaacagccaguccgacugcagcgcgaccuucaagaaccugaccgggugcuacuccugcgacgagggcagccggcucugcuaccaggugaaggccgagggcgagaccaucuuccacuucaucaacgaggaggagagcaucaacgucaucaacaaggugucccccggggugagcgacuacugcaccguccugcacuucucccgccccgugaucagcaucgagggcacguacgacugcgggcuguccaagcggcccauggucaucaagggcacccucaucgccaccgccccgcacgacgaccgcaagcacgagggcgggagcucccugguggugaaccccaagggcgggagcgucgacuucuucggcuggcuguccgggcucaccagcuggcugggcggcccccugaagacguuccucaccauccugggguuccuggccgugggccuccugcugguggucaucaucaucaucaucauccggaccgggaugcagcaggcgcucaagaagaagaucaaguga

SEQ ID NO: 13071 - RNA, 4020 nt, Artificial Sequence
  derived and/or modified CDS sequence (opt1) from TOSV(5904242804)__KU935737.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgacugcaagcgggacaucaugagcaacuacguggccgaggugcacuccaaccuccacggccugggcgccaugaugcacaacuacggggacgacaagcgcgucgaggugcugaacgacgugauccccgacgagcucaacccgggccggcacaacugcagcgaccuggaccgcaagcccuucuggaccgaguucaucgacgucgccaagcccaccaacaagaucgcccccauguccgugaucccgccgcccaucgugaagcccaucccggucgcggagagcaccaucaagaaguccauccccuucgacaagcugcucagcgaggccgagaaggagcugaaccagacgaagauccggcuggagaccgagcgccgguccaacgccgaggaggccgcgaaggagcgcgcccggaugcgcgagaucgaggacaagcuccggaaggacugggagcuggagcgcgagcggaaggacgccguggccgacgaccuggccaaggagaucgcgcgccggcgcgagaucgagcggaaggcccacgagcucgacaagaugcugaagaagaaggagcgcgaggaccugguggcccgggagcgcgucagcgaggacaugcgcaaccacgugcggaagcccaacaccaccaucgcccccgccccgacgaucaucaccacccuccugauggcguccgccgugauggccgggccccuggagaaccgcgagaccaaccaccuccugaaccggcccggcaacggggccuacacgcugagcgacuucgccgagagcacgugcacccucgcguacggcuccgagugcaagagcugggagcaccagcuggacgagcuguccuuccccuucuuccacagcaaccucgacaaguacuccaugcuggaggccgccaccgagaccaucccgauccugaacaagagcuccgccgucugcaccaucagccccuccacccacagcuccaacgccugcggccgcgaggcgagccucaucaagaagaagugcggguccaacaugagcgccuucuucuacgugaaccuggccggccagaucaccguggucaagugcgacacgaaccacgugcuguccaacgacugcgggaacugcaucagcaagacccucuccggccagaagaucuacacccccgugcaggacauguucugccagaagggcuggaccgagagcauccccaacacgcgguacuccaaggaccugugcagcaucgggcugcacaccgucaaggagugcaagaccggcaccacgaacuucgagcgcgugggguucaucguggucgagggccggaagauguacaucgagcagaugaagaugcgcagccggcaggaguucuccgaggaccaguuccucugcuacaagagcgaguccagcuccgggagcuccgugaagcugaagaaggucaagguggagagcugcaagggcgugaccaccuccagcgccuccaagugcagcggcgacgaguacuucugcucccgcuacccgugcgagaccgcgaacgucgaggcccacugcauccugcggcgccacagcgccgugaucgaggugaacgucaacgggguguggaucgugccccggugcaucggcuacgaggagguccucgugcgccggacgucccugaagguggaggacaccagcucccgcgagugcgacacgugccugugggagugcgggaagaacaagcucaucgucaagacccacggccccaagaucguguacgccaccgccugcagccacgggagcugcaaguccgugaugcagaagcccgcgaccuucgucuaccugccguaccccggcaacagcgagaucgugggcggggacaucggcgugcacaugaccgaggaguccagccccuccaacauccacauggucgcccacugccccgccaaggacagcugcgagguguccagcugccuguucugcgugcacgggcugcucaacuaccagugccacacccuguucuccgcccugcucaucagcaccacggucauguccauccugacccugcuccugcugcucgugaagggcgccaaggaccuggugaagcggcuguucuacuggcucaucaccccgcugugcuggcugagcgucuucugcgggugggugaucaaguccuggaagaagcgcgugggcagcgcgaucucccggaccaacgacacgaucggcuggcgcgacaaccgccgguaccgccaggacgucgagcgggcccaguacaccgggggcgcccccggggccaaguacagcuucuacggcgugauggugcucggccugcuggggaacguccacuccugcagcgaguccaucaucgccgacagcaagaucaugcagugcaccaccagcggcuccagcacgcucugcaaggcguccgggaccgugaucaugaagcugggccccaucgggagcgaguccugccugauccucaagggccugaaggacagcgagaagcaguucaucuccaucaagaccaucagcuccgagcugaccugccgcgagggcgagagcuucuggacgacccucuacaccccggugugccuguccagccggcgcugccaccugaugggggagugcgucuccgaccggugccucaaguggaagaccaacgagacgagcgccgaguucaccggcaaggcccacggggagguggugcacgagaaccgcugcuucgagcaguccggcgggaucggcuacggcugcuucaacgucaaccccagcugccuguacgugcacuccuaccucaagagcguguacaagaacggguucaagaucuuccggugcgucgccuggaaccaccgcauccggcuggaggugaccacccacucccgcaaguuccccauggugcugauggcgaugagcacgcagcccaccgacuggggcagcaucgggcugauccucgacuccgagggcaucaccgggaccaacgccuacagcuucaugaagcacggcuccggcagcuucgccaucaucgacgacccguacucccccgagccccggaagggguuccugggcgagguccgcugccccacggaggagaccgccauccgggccagcccguccugcaagauggcgcccaaccugaucgaguaccagcccgagauggacaccgccgagugcaccacgaacaugaucgaccccauggccaucuucaaccgcgggagccucccccaggugcgggacggcaugaccuucacccaguccaucgagaagaacaccgugcaggcccugacgaccggggagguccgcgccagcauccggcugacccucgacgacuacgacgugguguaccagaacucccagagcgacugcuccgcgaccuucaagaaccugaccggcugcuacagcugcgacgagggcucccgcaugugcuaccaggucaaggccgagggggagacgaucuuccacuucaucaacgaggacgagagcaucaacgugaucaacaaggugaaccccgacgucuccgacuacugcaccgugcugcacuucagccggcccgucaucuccaucgagggccgcuacgacugcgggcucagcaagcgccccauggugaucaagggcacccugaucgccaccgccccgcacgacgaccggaagcacgagggcgggagcucccugaucgugaaccccaagggcgggacggucgacuucuucggcugggugagcgggcucaccuccuggcugggcggcccccugaagaccuuccucaccauccugggguuccuggcccucggccugcugcucguggucaucaucaucaucaucgcgcgcacgggggugcagcaggcccugaagaagaagaacaaguga

SEQ ID NO: 13072 - RNA, 4020 nt, Artificial Sequence
  derived and/or modified CDS sequence (opt1) from TOSV(5963930705)__KU935734.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccugggggagaucgugcccauguccgugaucccgccgcccgucgugaagcuccagccgcccgccgagcccagcuccaagaagcacgugcccuucgacguccugcugagcgaggcggagaaggagcucaaccagaccaagauccgccuggaggacgagcggaaguccaacgccgaggagaccgccaaggagcgcgcccggaugaaggagaucgaggaggagcugcgccgggagugggagcucgagcgcaagcggaaggacgcgauggccgacgaccuggccaaggagacggcccgccggcgcgagaucgagcggaaggcccacgagcuggaccgcaugcucaagaagaaggagcgggagagccugaucgcgaaggagaaggccgacgaggacaugcgcucccacgugcacaagcccaacaccacccgggcccccgcccccaccaucaucacgacccugcucauggccagcgcggcccuggccggcccccuggagaaccgcgagaccaaccaccuccugaaccgccccgggaacggcgccuacacccugagcgacuucgccgaguccacgugcacccucgcguacggcagcgagugcaaguccugggagcaccuccugaacgaggagcuguucccguucuuccacagcaaccuggacaaguacuccaugcuggaggccgccaccgagaccgugcccauccucaacaagagcuccgccgucugcacgaucagccccuccacccacagcuccaacgccugcgggcgggaggcgagcgugauccgcaagaagugcuacuccaacaugagcgccuucuucuacaucaaccuggccggccagaucaccguggucaagugcgagaccaaccacgugcuguccagcgacugcgggaacugcaucuccaagagccucuccggccagaagguguacacgcccguccaggacguguucugccagaagggcuggacccagagcaucccgagcacccgguacuccaaggacaucugcagcaucgggcugcacaccgugaaggagugcaagaucggcacgaccuccuucgagcgcgucggguucaucguggucaagggccggaagauguacaucgagcagaugaagaugcgcagccggcaggaguacuccgaggaccaguuccugugcuacaagagcgaguccgggagcggcuccagcgugaagcucaagaaguucaagguggaguccugcaagggcgucaccaccagcuccgccagcaagugcuccggggacgaguacuucugcagccgcuaccccugcgaggcggccaacguggaggcccacugcauccugcggcgccacuccgccaucguggaggucaacgugaacggcgugugggucgugccccggugcaucggguacgaggaggugcuggucaagcgcacgagccucaagguggaggacaccaccgagcgggagugcgacagcugccugugggagugcggcaagaacaagcugaucgugaagacccacgggcccaaggucguguacgccacggcgugcucccacggcagcugcaaguccgugaugcagaagccggccaccuucgucuaccugcccuaccccggcaacagcgagaucgucgggggcgacaucgggauccacaugaccgaggaguccagccccuccaacauccaccucguggcccacugcccggcccgcgacagcugcgacguguccgacugccuguucugcgugcacggccugcucaacuaccagugccacacccuguucagcgcccugcucaucuccaccacggugaugagcauccugacccugcuccugcugcucgucaagggggcgaaggaccuggugaagaagcuguuccacuggcucaucacgccccugugcuggcuguccguguucugcugcuggauggucaagagcuggaagcggcgcgugggcuccgccaucagccggaccaacgacaccaucggcuggcgcgagaaccggcgccacgcccaggacaucgagcgcgcccagcacaccgggggcgcccccggggcgaaguacuccuucuacggcgugaugauccucggccugcugagcuccgcccagagcugcagcgaguccgucaucgccgacagcaagaucaugcagugcaccaccuccgggagcuccacgcucugcaaggccagcggcaccgugaucaugcggcuggggccgaucggcuccgagagcugccugauccucaaggggcugaaggacuccgagaagcaguucaucagcaucaagaccaucuccagcgagcugaccugccgcgagggcgaguccuucuggacgacccucuacacccccaucugccugagcucccggcgcugccaccugaugggcgagugcgugagcgaccggugccucaaguggaagaccaaccagacguccgcggaguucaccgggaaggcccacggcgacgucaugcacgagaaccgcugcuucgagcagagcgggggcaucggguacggcugcuucaacgugaaccccuccugccuguacgugcacagcuaccucaagagcgucuaccggaacggcuucaagguguuccgcugcguggccuggaaccaccggauccgccuggaggucaccacccacucccggaaguuccccauggugcugauggccaugagcacgcagccgaccgacuggggguccaucggccugauccucgacagcgaggggaucaccggcaccaacuccuacagcuucaugaagcacggguccggcagcuucgccaucaucgacgaccccuacucccccgagccccgcaagggcuuccugggggaggugcggugcccgacggaggagaccgcgaugcgcgccagccccuccugcaagauggcccccaaccugaucgaguaccagcccgagauggacaccgccgagugcaccacgaacaugaucgacccgauggccaucuucaaccggggcagccucccccagguccgcgacgggaugaccuucacccaguccaucgagaagaacaccgugcaggcgcugacgaccggcgaggugaaggccagcauccggcugacccucgacgacuacgacgucguguaccagaacucccagagcgacugcuccgccaccuucaagaaccugacggggugcuacagcugcgacgagggcucccgccugugcuaccaggugaaggccgagggcgagaccaucuuccacuucaucaacgaggaggagagcaucaacgucaucaacaaggugagccccgggguguccgacuacugcaccguccuccacuucagcucccccgugaucagcaucgagggcaccuacgacugcgggcuguccaagcggccgauggucaucaagggcacccugaucgccacggcgccccacgacgaccgcaagcacgagggcgggagcucccucguggugaaccccaagggcgggagcgucgacuucuucggcuggcuguccgggcugaccagcuggcucggcggcccccugaagaccuuccugaccauccucggguuccuggccgugggccugcuccugguggucaucaucaucaucaucauccggacggggaugcagcaggcccugaagaagaagaucaaguga

SEQ ID NO: 13073 - RNA, 4020 nt, Artificial Sequence
  derived and/or modified CDS sequence (opt1) from TOSV(H4906)__KU922125.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagaucgugcccaugagcgugaucccgccgcccgucgugaagccccagccgcccgccgagcccuccagcaagaagcacgugcccuucgacguccuccuguccgaggcggagaaggagcugaaccagaccaagauccgccucgaggacgagcgcaagagcaacgccgaggagaccgccaaggagcgggcccggaugaaggagaucgaggacgagcugcgccgggagugggagcuggagcgcaagcggaaggacgcgauggccgacgaccucgccaaggagacggcccgccggcgcgagaucgagcggaaggcccacgagcuggaccgcaugcugaagaagaaggagcgggagucccucaucgcgaaggagaaggccgacgaggacaugcgcagccacgugcacaagcccaacaccacccgggcccccgcccccaccaucaucacgacccugcugauggccagcgcggcccucgccgggccccuggagaaccgcgagaccaaccaccuccugaaccgcccgggcaacggggccuacacccuguccgacuucgccgagagcacgugcacccuggcguacggcuccgagugcaagagcugggagcaccuccugaacgaggagcuguuccccuucuuccacuccaaccucgacaaguacagcaugcuggaggccgccaccgagaccgugcccauccugaacaaguccagcgccgucugcacgaucucccccagcacccacuccagcaacgccugcggccgggaggcguccgugauccgcaagaagugcuacagcaacauguccgccuucuucuacaucaaccucgccgggcagaucaccguggucaagugcgagaccaaccacgugcugagcuccgacugcggcaacugcaucagcaagucccugagcgggcagaagguguacacgccgguccaggacguguucugccagaagggcuggacccagagcauccccuccacccgguacagcaaggacaucugcuccaucggccuccacaccgugaaggagugcaagaucgggacgaccagcuucgagcgcgucggcuucaucguggucaaggggcggaagauguacaucgagcagaugaagaugcgcucccggcaggaguacagcgaggaccaguuccugugcuacaaguccgagagcggcuccgggagcuccgugaagcugaagaaguucaagguggagagcugcaagggcgucaccaccuccagcgccuccaagugcagcggcgacgaguacuucugcucccgcuuccccugcgagacggcgaacguggaggcccacugcauccuccggcgccacagcgccaucguggaggucaacgugaacggggugugggucgugccccggugcaucggcuacgaggaggugcuggucaagcgcaccagccugaagguggaggacaccaccgagcgggagugcgacuccugccucugggagugcgggaagaacaagcugaucgugaagacgcacggcccgaaggucguguacgccaccgccugcagccacggguccugcaagagcgugaugcagaagcccgcgaccuucgucuaccugcccuaccccggcaacuccgagaucgugggcggggacaucggcauccacaugaccgaggagagcuccccgagcaacauccaccugguggcccacugccccgcccgcgacuccugcgacgucagcgacugccucuucugcgugcacgggcugcugaacuaccagugccacacccucuucuccgcccugcugaucagcacgaccgugauguccauccucacccugcugcuccugcuggucaagggcgccaaggaccucgugaagaagcuguuccacuggcugaucacgccccucugcuggcugagcguguucugcugcugggucgugaaguccuggaagcggcgcguggggagcgcgaucucccggaccaacgacaccaucggcuggcgcgagaaccggcgccacgcccaggacaucgagcgcgcccaguacaccggcggggccccgggcgccaaguacagcuucuacggggucaugauccugggccuccuguccagcgcgcagagcugcuccgagagcgugaucgccgacuccaagaucaugcagugcaccacgagcggcuccagcacccugugcaaggccuccgggaccgugaucaugcggcucggccccaucgggagcgaguccugccugauccugaagggccucaaggacagcgagaagcaguucaucuccaucaagaccaucagcuccgagcugacgugccgcgagggggagagcuucuggaccacccuguacacccccaucugccucuccagccggcgcugccaccugaugggcgagugcgucuccgaccggugccugaaguggaagacgaaccagaccagcgccgaguucaccggcaaggcgcacggggacgugaugcacgagaaccgcugcuucgagcaguccggcgggaucggcuacgggugcuucaacgugaaccccagcugccucuacguccacagcuaccugaaguccguguaccggaacggcuucaagguguuccgcugcgucgccuggaaccaccggauccgccuggagaugaccacgcacagccggaaguucccgauggugcucauggccauguccacccagcccaccgacuggggcagcaucgggcugauccuggacuccgagggcaucaccgggacgaacagcuacuccuucaugaagcacggcagcggguccuucgccaucaucgacgaccccuacagccccgagccgcgcaagggcuuccucggcgaggugcggugccccaccgaggagaccgccaugcgcgcgucccccagcugcaagauggcccccaaccugaucgaguaccagccggagauggacaccgccgagugcacgaccaacaugaucgaccccauggccaucuucaaccgggggucccugccccagguccgcgacggcaugaccuucacccagagcaucgagaagaacacggugcaggcccucaccaccggggaggugaaggcguccauccggcugacccuggacgacuacgacgucguguaccagaacagccaguccgacugcagcgccacguucaagaaccucaccggcugcuacuccugcgacgaggggagccgccugugcuaccaggugaaggccgagggcgagaccaucuuccacuucaucaacgaggaggagagcaucaacgucaucaacaaggugaaccccggcguguccgacuacugcaccguccugcacuucagccggccggugaucuccaucgaggggaccuacgacugcggccucagcaagcgccccauggucaucaaggggacgcugaucgccaccgcgccccacgacgaccggaagcacgagggcggcuccagccugguggugaaccccaagggcggguccgucgacuucuucggguggcucagcggccugaccuccuggcucgggggcccgcugaagaccuuccugacgauccugggcuuccucgccguggggcugcugcucguggucaucaucaucaucaucauccgcaccggcaugcagcaggcccugaagaagaagaucaaguga

SEQ ID NO: 13074 - RNA, 4020 nt, Artificial Sequence
  derived and/or modified CDS sequence (opt1) from TOSV(MRS2010-4319501)__KC776215.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaucagcgggaccugcaagguggggucccuggagaaccgcgacugccggaaggacaucaugagcaacuacguggccgagguccacuccaaccuccacggccugggcgccaugaugcacaacuacgccgacgacaagcgcguggagauccugaacgacgugauccccgacgagcucaacccggggcaccacaacugcagcgaccuggaccggaagcccuucuggacggaguucaucaacgucgccaagccccuguccgagaucgugcccaugagcgugaucccgccgcccgucgugaagcuccagccgcccgcggagcccuccagcaagaagcacgugcccuucgacguccugcuguccgaggccgagaaggagcucaaccagaccaagauccgccuggaggacgagcgcaagagcaacgccgaggagaccgccaaggagcgggcgcggaugaaggagaucgaggacgagcugcgccgggagugggagcucgagcgcaagcggaaggacgccauggccgacgaccuggccaaggagaccgcccgccggcgcgagaucgagcggaaggcgcacgagcuggaccgcaugcucaagaagaaggagcgggagucccugaucgccaaggagaaggccgacgaggacaugcgcagccacguguacaagcccaacacgacccgggcccccgcccccaccaucaucaccacgcugcucauggcgagcgccgcccuggccggcccccuggagaaccgcgagaccaaccaccuccugaaccgccccgggaacggcgccuacacccuguccgacuucgcggagagcacgugcacccucgccuacggguccgagugcaagagcugggagcaccuccugaacgaggagcuguucccguucuuccacuccaaccuggacaaguacagcaugcuggaggccgccaccgagaccgugcccauccucaacaaguccagcgccgucugcaccaucucccccagcacgcacuccagcaacgcgugcggccgggaggccuccgugauccgcaagaagugcuacagcaacauguccgccuucuucuacaucaaccuggccggccagaucaccguggucaagugcgagaccaaccacgugcugagcuccgacugcgggaacugcaucagcaagucccucagcggccagaagguguacacccccguccaggacguguucugccagaagggguggacgcagagcaucccguccaccaaguacagcaaggacaucugcuccaucggccugcacaccgugaaggagugcaagaucggcaucaccagcuucgagcgggucggguucaucguggucaagggccgcaagauguacaucgagcagaugaagaugcggucccgccaggaguacagcgaggaccaguuccugugcuacaaguccgagagcuccagcggguccagcgugaagcucaagaaguucaagguggaguccugcaagggcgucacgaccagcuccgcgagcaagugcuccggggacgaguacuucugcagccgguaccccugcgagaccgccaacguggaggcccacugcauccugcgccggcacagcgccaucguggaggucaacgugaacggcgugugggucgugccccgcugcaucggcuacgaggaggugcuggucaagcggaccucccucaagguggaggacacgaccgggcgcgagugcgacagcugccugugggagugcggcaagaacaagcugaucgugaagacccacgggcccaaggucguguacgccaccgcgugcucccacggcagcugcaaguccgugaugcagaagccggccacguucgucuaccugcccuaccccgggaacagcgagaucgugggcggcgacaucgggauccacaugaccgaggaguccagccccuccaacauccaccucguggcccacugcccggcccgggacagcugcgacgucuccgacugccuguucugcgugcacggccugcucaacuaccagugccacacccuguucagcgcccugcucaucuccaccaccgugaugagcauccugacgcugcuccugcugcucgucaagggggcgaaggaccuggugaagaagcuguuccacuggcucaucacgccccugugcuggcuguccguguucugcugcugggucgucaagagcuggaagcgccgggugggcuccgccaucagccgcaccaacgacaccaucggguggcgggagaaccgccggcacgcccaggacaucgagcgcgcccaguacaccggcggcgcccccggggcgaaguacuccuucuacggcgugaugauccucgggcugcugagcagcgcccaguccugcagcgaguccgugaucgccgacagcaagaucaugcagugcaccaccuccggcagcuccacccucugcaaggccagcggcacggugaucaugcgcgucgggccgaucggcuccgagagcugccugauccugaaggggcucaaggacuccgagaagcaguucaucagcaucaagaccaucuccagcgagcugaccugccgggagggcgaguccuucuggaccacgcuguacacccccaucugccucagcucccgccggugccaccugaugggggagugcgugagcgaccgcugccugaaguggaagaccaaccagaccuccgcggaguucacgggcaaggcccacggcgacgugaugcacgagaaccggugcuucgagcagagcgggggcaucggguacggcugcuucaacgucaaccccagcugccucuacgugcacuccuaccucaagagcguguaccgcaacggguucaaggucuuccggugcguggccuggaaccaccgcauccggcuggaggugaccacccacucccgcaaguuccccaugguccugauggccaugagcacccagccgacggacuggggcuccaucggccugauccuggacagcgagggggugaccggcaccaacuccuacagcuucaugaagcacggguccggcagcuucgccaucaucgacgaccccuacucccccgagccccggaagggguuccucggcgaggugcgcugcccgaccgaggagacggcgaugcgggccagccccuccugcaagauggcccccaaccugaucgaguaccagcccgagauggacaccgccgagugcaccaccaacaugaucgacccgauggccaucuucaaccgcggcagccugccccagguccgggacgggaugacguucacccaguccaucgagaagaacaccgugcaggcgcucaccacgggcgaggugaaggccagcauccgccugacccuggacgacuacgacgucguguaccagaacucccagagcgacugcuccgccaccuucaagaaccucaccgggugcuacagcugcgacgagggcagccggcugugcuaccaggugaaggccgagggggagacgaucuuccacuucaucaacgaggaggaguccaucaacgucaucaacaaggugagccccggcgucuccgacuacugcaccgugcugcacuucagccgccccgugaucuccaucgagggcaccuacgacugcgggcucagcaagcggccgauggucaucaagggcacccugaucgccaccgcgccccacgacgaccgcaagcacgagggcggcuccagccugguggugaaccccaagggcggguccgucgacuucuucggcuggcucagcgggcugacguccuggcugggcgggccccucaagaccuuccugaccauccugggcuuccucgccgugggccugcugcucguggucaucaucaucaucaucauccggaccgggaugcagcaggcccugaagaagaagaucaaguga

SEQ ID NO: 13075 - RNA, 4020 nt, Artificial Sequence
  derived and/or modified CDS sequence (opt1) from TOSV(Nice/113)__KU204982.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugcggcaaggacaucaugagcaacuacguggccgagguccacuccaaccuccacggccugggggccaugaugcacaacuacggcgacgacaagcggguggagauccugaacgacgugauccccgacgagcucaacccggggcaccacaacugcagcgaccuggaccgcaagcccuucuggaccgaguucaucaacgucgcccggccccuguccgagaucgcccccaugagcgugaucccgccgcccguggucaagcuccagccgcccgcggagcccuccagcaagaagcacgugcccuucgacgugcugcuguccgaggccgagaaggagcucaaccagaccaagauccgccuggaggacgagcgcaagagcaacgccgaggagaccgccaaggagcgggcgcggaugaaggagaucgaggacgagcugcgccgggagugggagcucgagcgcaagcggaaggacgccauggccgacgaccuggccaaggagacggcccgccggcgcgagaucgagcggaaggcgcacgagcuggaccgcaugcucaagaagaaggagcgggagucccugaucgccaaggagaaggccgacgaggacaugcgcagccacguccacaagcccaacaccacccgggcccccgcccccaccaucaucacgacccugcucauggcgagcgccgcccuggccggcccccuggagaaccgcgagaccaaccaccuccugaaccgccccgggaacggcgccuacacccuguccgacuucgcggagagcacgugcacccucgccuacggcuccgagugcaagagcugggagcaccuccugaacgaggagcuguucccguucuuccacuccaaccuggacaaguacagcaugcuggaggccgccaccgagaccgugcccauccucaacaaguccagcgccgugugcacgaucucccccagcacccacuccagcaacgcgugcgggcgggaggccuccgucauccgcaagaagugcuacagcaacauguccgccuucuucuacaucaaccuggccggccagaucaccguggugaagugcgagaccaaccacguccugagcuccgacugcgggaacugcaucagcaagucccucagcggccagaagguguacacgcccgugcaggacgucuucugccagaagggcuggacccagagcaucccguccacccgguacagcaaggacaucugcuccaucgggcugcacaccgugaaggagugcaagaucggcacgaccagcuucgagcgcgugggguucaucgucgugggcgggcggaagauguacaucgagcagaugaagaugcgcucccggcaggaguacagcgaggaccaguuccugugcuacaaguccgagagcggcuccggcagcuccgucaagcucaagaaguucaagguggagagcugcaagggggugaccaccuccagcgcguccaagugcagcggcgacgaguacuucugcucccgcuaccccugcgagacggccaacgucgaggcccacugcauccugcggcgccacagcgccaucguggaggugaacgucaacgggguguggguggucccccggugcaucggcuacgaggaggugcuggugaagcgcaccagccucaaggucgaggacaccaccgagcgggagugcgacuccugccugugggagugcgggaagaacaagcugaucgugaagacgcacggccccaagguggucuacgccaccgcgugcagccacggcuccugcaagagcgugaugcagaagccggccaccuucguguaccugcccuaccccgggaacuccgagaucgucggcggggacaucggcauccacaugaccgaggagagcucccccagcaacauccaccucguggcccacugcccggcccgcgacuccugcgacgugagcgacugccuguucugcguccacgggcugcucaacuaccagugccacacccuguucuccgcccugcucaucagcacgaccgugauguccauccugacccugcuccugcugcucgugaagggcgcgaaggaccuggucaagaagcuguucuacuggcucaucacgccccugugcuggcugagcguguucugcugcugggugaucaaguccuggaagcggcgcgucggcagcgccaucucccggaccaacgacaccaucggguggcgcgagaaccggcgccacgcccaggacaucgagcgcgcccaguacaccggcggggcccccggcgcgaaguacagcuucuacggcgugaugauccucgggcugcuguccagcgcccagagcugcuccgagagcgugaucgccgacuccaagaucaugcagugcaccacgagcggcuccagcacccucugcaaggccuccgggaccgucaucaugcggcugggcccgaucgggagcgaguccugccugauccucaagggccugaaggacagcgagaagcaguucaucuccaucaagaccaucagcuccgagcugacgugccgcgagggcgagagcuucuggaccacccucuacacccccaucugccuguccagccggcgcugccaccugaugggggagugcguguccgaccggugccucaaguggaagacgaaccagaccagcgcggaguucaccggcaaggcccacggggacgugaugcacgagaaccgcugcuucgagcaguccggcgggaucggcuacggcugcuucaacgucaaccccagcugccuguacgugcacagcuaccugaaguccguguaccggaacggguucaaggucuuccgcugcguggccuggaaccaccggauccgccucgaggugaccacgcacagccggaaguuccccaugguccugauggccauguccacccagccgaccgacuggggcagcaucgggcugauccucgacuccgagggcaucaccgggacgaacagcuacuccuucaugaagcacggcagcggcuccuucgccaucaucgacgaccccuacagccccgagccccgcaagggguuccugggcgaggugcggugcccgaccgaggagaccgcgaugcgcgccucccccagcugcaagauggcccccaaccugaucgaguaccagcccgagauggacaccgccgagugcacgaccaacaugaucgacccgauggccaucuucaaccgggggucccucccccaggugcgcgacggcaugaccuucacccagagcaucgagaagaacacgguccaggcgcugaccaccggggaggugaaggccuccauccggcugacccucgacgacuacgacguggucuaccagaacagccaguccgacugcagcgccacguucaagaaccugaccggcugcuacuccugcgacgagggcagccgccugugcuaccaggugaaggccgagggggagaccaucuuccacuucaucaacgaggaggagagcaucaacgugaucaacaaggucucccccgaggugagcaacuacugcaccgugcuccacuucucccggcccgucaucagcaucgagggcaccuacgacugcgggcuguccaagcgcccgauggugaucaagggcacgcugaucgccaccgcgccccacgacgaccggaagcacgagggcgggagcucccucgucgugaaccccaagggcgggagcguggacuucuucggcuggcuguccgggcugaccagcuggcucggcggcccccugaagaccuuccugacgauccucggguuccuggccgucggccugcuccugguggugaucaucaucaucaucauccgcaccgggaugcagcaggcccugaagaagaagaucaaguga

SEQ ID NO: 13076 - RNA, 4020 nt, Artificial Sequence
  derived and/or modified CDS sequence (opt1) from TOSV(P233)__KU204976.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagaucgugcccaugagcgugaucccgccgcccgucgugaagccccagccgcccgccgagcccuccagcaagaagcacgugcccuucgacguccuccuguccgaggcggagaaggagcugaaccagaccaagauccgccucgaggacgagcgcaagagcaacgccgaggagaccgccaaggagcgggcccggaugaaggagaucgaggacgagcugcgccgggagugggagcuggagcgcaagcggaaggacgcgauggccgacgaccucgccaaggagacggcccgccggcgcgagaucgagcggaaggcccacgagcuggacaagaugcugaagaagaaggagcgcgagucccucaucgcgaaggagaaggccgacgaggacaugcggagccacgugcacaagcccaacaccacccgcgcccccgcccccaccaucaucacgacccugcugauggccagcgcggcccucgccgggccccuggagaaccgggagaccaaccaccuccugaaccgcccgggcaacggggccuacacccuguccgacuucgccgagagcacgugcacccuggcguacggcuccgagugcaagagcugggagcaccuccugaacgaggagcuguuccccuucuuccacuccaaccucgacaaguacagcaugcuggaggccgccaccgagaccgugcccauccugaacaaguccagcgccgucugcacgaucucccccagcacccacuccagcaacgccugcggccgcgaggcguccgugauccggaagaagugcuacagcaacauguccgccuucuucuacaucaaccucgccgggcagaucaccgugaucaagugcgagaccaaccacguccugagcuccgacugcggcaacugcaucagcaagucccugagcgggcagaagguguacacgccggugcaggacgucuucugccagaagggcuggacccagagcauccccuccacccgcuacagcaaggacaucugcuccaucggccuccacaccgugaaggagugcaagaucgggacgaccagcuucgagcgggugggcuucaucgucgugaaggggcgcaagauguacaucgagcagaugaagaugcggucccgccaggaguacagcgaggaccaguuccugugcuacaaguccgagagcggcuccgggagcuccgucaagcugaagaaguucaaggucaagagcugcaagggcgugaccaccuccagcgccuccaagugcagcggcgacgaguacuucugcucccgguaccccugcgagacggcgaacguggaggcccacugcauccuccgccggcacagcgccaucguggaggugaacgucaacgggguguggguggucccccgcugcaucggcuacgaggaggugcuggugaagcggaccagccugaaggucgaggacaccaccgggcgcgagugcgacuccugccucugggagugcggcaagaacaagcugaucgugaagacgcacgggccgaagguggucuacgccaccgccugcagccacggcuccugcaagagcgugaugcagaagcccgcgaccuucguguaccugcccuaccccggcaacuccgagaucgucgggggcgacaucgggauccacaugaccgaggagagcuccccgagcaacauccaccugguggcccacugccccgcccgggacuccugcgacgugagcgacugccucuucugcguccacggccugcugaacuaccagugccacacccucuucuccgcccugcugaucagcacgaccgugauguccauccucacccugcugcuccugcuggugaagggggccaaggaccucgucaagaagcuguuccacuggcugaucacgccccucugcuggcugagcguguucugcugcuggguggucaaguccuggaagcgccgggugggcagcgcgaucucccgcaccaacgacaccaucggcuggcgggagaaccgccggcacgcccaggacaucgagcgcgcccaguacaccgggggcgccccgggggccaaguacagcuucuacggcgugaugauccugggccuccuguccagcgcgcagagcugcuccgagagcgucaucgccgacuccaagaucaugcagugcaccacgagcggguccagcacccugugcaaggccuccggcaccgugaucaugcgccucgggcccaucggcagcgaguccugccugauccugaaggggcucaaggacagcgagaagcaguucaucuccaucaagaccaucagcuccgagcugacgugccgggagggcgagagcuucuggaccacccuguacacccccaucugccucuccagccgccggugccaccugaugggcgagugcguguccgaccgcugccugaaguggaagacgaaccagaccagcgccgaguucaccgggaaggcgcacggcgacgucaugcacgagaaccggugcuucgagcaguccgggggcaucggguacggcugcuucaacgugaaccccagcugccucuacgugcacagcuaccugaaguccgucuaccgcaacggcuucaagguguuccggugcguggccuggaaccaccgcauccggcuggaggucaccacgcacagccgcaaguucccgauggugcucauggccauguccacccagcccaccgacugggggagcaucggccugauccuggacuccgaggggaucaccggcacgaacagcuacuccuucaugaagcacgggagcggcuccuucgccaucaucgacgaccccuacagccccgagccgcggaagggcuuccucggggaggugcgcugccccaccgaggagaccgccaugcgggcgucccccagcugcaagauggcccccaaccugaucgaguaccagccggagauggacaccgccgagugcacgaccaacaugaucgaccccauggccaucuucaaccgcggcucccugccccagguccgggacgggaugaccuucacccagagcaucgagaagaacacggugcaggcccucaccaccggcgaggugaaggcguccauccgccugacccuggacgacuacgacgucguguaccagaacagccaguccgacugcagcgccacguucaagaaccucaccgggugcuacuccugcgacgagggcagccggcugugcuaccaggugaaggccgagggcgagaccaucuuccacuucaucaacgaggaggagagcaucaacgucaucaacaaggugucccccggggugagcgacuacugcaccguccugcacuucucccgcccggugaucagcaucgagggcaccuacgacugcgggcucuccaagcggcccauggucaucaagggcacgcugaucgccaccgcgccccacgacgaccgcaagcacgagggcgggagcucccugguggugaaccccaagggcgggagcgucgacuucuucggcuggcucuccgggcugaccagcuggcugggcggcccgcucaagaccuuccugacgauccugggguuccucgccgugggccugcugcucguggucaucaucaucaucaucauccggaccgggaugcagcaggcccugaagaagaagaucaaguga

SEQ ID NO: 13077 - RNA, 4020 nt, Artificial Sequence
  derived and/or modified CDS sequence (opt1) from TOSV(T152)__JX867535.1__GP
auguucaucgccaagcugcuccugaucagcugccuggugcagcaggccuaccucaaguacaccaucaucuccgagaucggcaacgggacccgcacgagcuccugcuacagcucccggaccagccugggcucccugcucgaggcgugggacaacaucaccgagagcaucgggcugaccuccggcacgugcaaggucgggagccuggagaaccgcgacugcaagcgggacaucauguccaacuacguggccgaggugcacagcaaccuccacggccugggcgccaugaugcacaacuacggggacgacaagcgcgucgaggugcugaacgacgugauccccgacgagcucaacccgggccggcacaacugcuccgaccuggaccgcaagcccuucuggaccgaguucaucaacgucgccaagcccaccaacaagaucgcccccaucagcgugaucccgccgcccaucgugaagcccauccccaucgcggagcccaccacgaagaagaacauccccuucgacaagcugcucuccgaggccgagaaggagcugaaccagaccaagauccggcuggagaccgagcgccggagcaacgccgaggaggccgcgaaggagcgcgcccggaugcgcgagaucgaggacaagcuccggaaggacugggagcuggagcgcgagcggaaggacgccgucgccgacgaccuggccaaggagaucgcgcgccggcgcgagaucgagcggaaggcccacgagcucgacaagaugcugaagaagaaggagcgcgaggaccugguggccaucgagaagguguccgaggacaugcggaaccacguccgccgccccaacaccacgaucgccccggcccccaccaucaucaccacccuccugcuggcgagcgccgugauggccgggccccucgagaaccgggagacgaaccaccuccugaaccgccccggcaacggggccuacacccucuccgacuucgccgagagcacgugcacccuggcguacggcagcgagugcaaguccugggagcaccagcuggacgagcucagcuucccguucuuccacuccaaccuggacaaguacagcaugcuggaggccgccaccgagaccauccccauccucaacaaguccagcgccgugugcaccaucucccccagcacccacuccagcaacgccugcggccgggaggcgucccugaucaagaagaagugcgggagcaacauguccgccuucuucuacgucaaccuggccggccagaucacgguggugaagugcgacaccaaccacguccucagcaacgacugcgggaacugcaucuccaagacccugagcggccagaagaucuacacccccgugcaggacauguucugccagaagggcuggacggaguccaucccgagcacccgcuacuccaaggaccugugcagcaucgggcuccacaccgugaaggagugcaagaccggcacgaccaacuucgagcgggucggguucaucgugguggagagccgcaagauguacaucgagcagaugaagaugcggucccgccaggaguucagcgaggaccaguuccugugcuacaaguccgagagcuccagcggcuccagcgucaagcugaagaaggugaaggucgaguccugcaagggggugaccaccagcuccgccagcaagugcuccggcgacgaguacuucugcagccgguaccccugcgagacggcgaacguggaggcccacugcauccuccgccggcacuccgccgucaucgaggugaacgugaacggcgucuggguggugccccgcugcaucggguacgaggagguccuggugcggcgcaccagccugaagguggaggacaccuccagccgggagugcgacacgugccucugggagugcggcaagaacaagcugaucgucaagacccacgggcccaagaucguguacgccaccgccugcagccacggcuccugcaagagcgugaugcagaagccggcgaccuucgucuuccugcccuaccccgggaacuccgagaucgugggcggcgacaucggggugcacaugaccgaggagagcucccccagcaacauccacauggucgcccacugcccggccaaggacuccugcgaggugagcuccugccuguucugcgugcacggccuccugaacuaccagugccacacccuguucagcgcccuccugaucuccacgaccgucaugagcauccugacccuccugcugcuccuggugaagggggccaaggaccuggugaagcgccucuucuacuggcugaucacgccccugugcuggcucuccgucuucugcagcuggaugaucaaguccuggcggaagcgcgugggcagcgcgaucucccggaccaacgacaccaucggguggcgcgacaaccgccgguacggccaggacguggagcgcgcccaguacaccggcggggcccccggcaccaaguacagcuucuacggggucaugauccugggccugcucggcaacgugcacuccugcagcgagagcgugaucgccgacuccaaggucaugcagugcacgaccagcggguccagcacccugugcaaggccuccggcaccgugaucaugaagcuggggccgaucggcagcgaguccugccucauccugaaggggcugaaggacagcgagaagcaguucaucuccaucaagacgaucagcuccgagcugaccugccgggagggcgagagcuucuggaccacccuguacacgcccgugugccuguccagccgccggugccaccucaugggcgagugcgucuccgaccgcugccugaaguggaagaccaacgagaccagcgcggaguucaccgggaaggcccacggcgaggugaugcacgagaacaagugcuucgagcaguccgggggcaucggguacggcugcuucaacgugaaccccagcugccuguacguccacuccuaccucaagagcguguacaagaacggcuucaagaucuuccggugcguggccuggaaccaccgcauccggcuggaggucacgacccacagccgcaaguuccccauggugcugauggccauguccacccagccgaccgacugggggagcaucggccucauccuggacuccgaggggaucacgggcaccaacgcguacagcuucaugaagcacggguccggcagcuucgccaucaucgacgaccccuacucccccgagccccggaagggcuuccugggggaggugcgcugcccgaccgaggagaccgccauccgggccagccccuccugcaagauggcccccaaccucaucgaguaccagcccgagauggacacggcggagugcaccaccaacaugaucgacccgauggccaucuucaaccgcggcagccugccccagguccgggacgggaugaccuucacgcaguccaucgagaagaacaccgugcaggcccugaccaccggcgaggugcgcgccagcauccggcucacccuggacgacuacgacgucguguaccagaacucccagagcgacugcuccgccacguucaagaaccugaccgggugcuacagcugcgacgagggcucccgcaugugcuaccaggugaaggcggagggcgagaccaucuuccacuucgucaacgaggacgagagcaucaacgugaucaacaaggugucccccgacgucagcgacuacugcaccgugcuccacuucagccggcccgucaucuccaucgaggggcgcuacgacugcggccugagcaagcggccgauggugaucaaggggacgcugaucgccaccgcgccccacgacgaccgcaagcacgagggcggcuccagccucguggucaaccccaagggcgggaccguggacuucuucggguggguguccggccugaccagcuggcucgggggcccccugaagacguuccugaccauccugggcuuccucgcccuggggcugcuccuggucguggugaucaucaucaucgcccgcaccggcguccagcaggcccugaagaagaagaacaaguga

SEQ ID NO: 13078 - RNA, 4020 nt, Artificial Sequence
  derived and/or modified CDS sequence (opt1) from TOSV(TOSV/P51)__KU204979.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagaucgugcccaugagcgugaucccgccgcccgucgugaagcuccagccgcccgccgagcccuccagcaagaagcacgugcccuucgacguccugcuguccgaggcggagaaggagcucaaccagaccaagauccgccuggaggacgagcgcaagagcaacgccgaggagaccgccaaggagcgggcccggaugaaggagaucgaggacgagcugcgccgggagugggagcucgagcgcaagcggaaggacgcgauggccgacgaccuggccaaggagacggcccgccggcgcgagaucgaccggaaggcccacgagcuggaccgcaugcucaagaagaaggagcgggagucccugaucgcgaaggagaaggccgacgagaacaugcgcagccacgugcacgagcccaacaccacccgggcccccgcccccaccaucaucacgacccugcucauggccagcgcggcccuggccgggccccuggagaaccgcgagaccaaccaccuccugaaccgccccggcaacggggccuacacccuguccgacuucgccgagagcacgugcacccucgcguacggcuccgagugcaagagcugggagcaccuccugaacgaggagcuguucccguucuuccacuccaaccuggacaaguacagcaugcuggaggccgccaccgagaccgugcccauccucaacaaguccagcgccgucugcacgaucucccccagcacccacuccagcaacgccugcggccgggaggcguccgugauccgcaagaagugcuacagcaacauguccgccuucuucuacaucaaccuggccgggcagaucaccguggucaagugcgagaccaaccacgugcugagcuccgacugcggcaacugcaucagcaagucccucagcgggcagaagguguacacgcccguccaggacguguucugccagaagggcuggacccagagcaucccguccacccgguacagcaaggacaucugcuccaucggccugcacaccgugaaggagugcaagaucgggacgaccagcuucgagcgcgucggcuucaucguggucaaggggcggaagauguacaucgagcagaugaagaugcgcucccggcaggaguacagcgaggaccaguuccugugcuacaaguccgagagcggcuccgggagcuccgugaagcucaagaaguucaagguggagagcugcaagggcgucaccaccuccagcgccuccaagugcagcggcgacgaguacuucugcucccgcuaccccugcgagacggcgaacguggaggcccacugcauccugcggcgccacagcgccaucguggaggucaacgugaacggggugugggucgugccccggugcaucggcuacgaggaggugcuggucaagcgcaccagccucaagguggaggacaccaccgggcgggagugcgacuccugccugugggagugcggcaagaacaagcugaucgugaagacgcacgggcccaaggucguguacgccaccgccugcagccacggcuccugcaagagcgugaugcagaagccggcgaccuucgucuaccugcccuaccccggcaacuccgagaucgucgggggcgacaucgggauccacaugaccgaggagagcucccccagcaacauccaccucguggcccacugcccggcccgcgacuccugcgacgugagcgacugccuguucugcgugcacggccugcucaacuaccagugccacacccuguucuccgcccugcucaucagcacgaccgugauguccauccugacccugcuccugcugcucgucaagggggccaaggaccuggugaagaagcuguucuacuggcucaucacgccccugugcuggcugagcguguucugcugcugggucgugaaguccuggaagcggcgcgugggcagcgcgaucucccggaccaacgacaccaucggcuggcgcgagaaccggcgccacgcccaggacaucgagcgcgcccaguacaccgggggcgcccccggggccaaguacagcuucuacggcgucaugauccucggccugcuguccagcgcgcagagcugcuccgagagcgugaucgccgacuccaagaucaugcagugcaccacgagcggguccagcacccucugcaaggccuccggcaccgugaucaugcggcuggggccgaucggcagcgaguccugccugauccucaaggggcugaaggacagcgagaagcaguucaucuccaucaagaccaucagcuccgagcugacgugccgcgagggcgagagcuucuggaccacccucuacacccccaucugccuguccagccggcgcugccaccugaugggcgagugcgucuccgaccggugccucaaguggaagacgaaccagaccagcgccgaguucaccgggaaggcgcacggcgacgugaugcacgagaaccgcugcuucgagcaguccgggggcaucggguacggcugcuucaacgugaaccccagcugccuguacguccacagcuaccugaaguccguguaccggaacggcuucaagguguuccgcugcgucgccuggaaccaccggauccgccucgaggugaccacgcacagccggaaguuccccauggugcugauggccauguccacccagccgaccgacugggggagcaucggccugauccucgacuccgaggggaucaccggcacgaacagcuacuccuucaugaagcacgggagcggcuccuucgccaucaucgacgaccccuacagccccgagccccgcaagggcuuccugggggagguccggugcccgaccgaggagaccgccaugcgcgcgucccccagcugcaagauggcccccaaccugguggaguaccagcccgagauggacaccgccgagugcacgaccaacaugaucgacccgauggccaucuucaaccggggcucccucccccaggugcgcgacgggaugaccuucacccagagcaucgagaagaacacgguccaggcccugaccaccggcgaggugaaggcguccauccggcugacccucgacgacuacgacguggucuaccagaacagccaguccgacugcagcgccacguucaagaaccugaccgggugcuacuccugcgacgagggcagccgccugugcuaccaggugaaggccgagggcgagaccaucuuccacuucaucaacgaggaggagagcaucaacgugaucaacaaggucagcccccggguguccgacuacugcaccguccuccacuucucccgccccgugaucagcaucgaggggaccuacgacugcggccuguccaagcggccgauggugaucaaggggacgcugaucgccaccgcgccccacgacgaccgcaagcacgagggcggcagcucccucgucgugaaccccaagggcgggagcguggacuucuucggguggcuguccggccugaccagcuggcucgggggcccccugaagaccuuccugacgauccucggcuuccuggccgucgggcugcuccugguggugaucaucaucaucaucauccgcaccggcaugcagcaggcccugaagaagaagaucaaguga

SEQ ID NO: 13079 - RNA, 4020 nt, Artificial Sequence
  derived and/or modified CDS sequence (opt1) from TOSV(TOSV_Italy/BB8/2014/human)__KY626661.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacaucaccgaguccaucgggcugaccagcggcacgugcaaggucgggucccuggagaaccgcgacugcaagcgggacaucaugagcaacuacguggccgaggugcacuccaaccuccacggccugggcgccaugaugcacaacuacggggacgacaagcgcgucgaggugcugaacgacgugauccccgacgagcucaacccgggccggcacaacugcagcgaccuggaccgcaagcccuucuggaccgaguucaucgacgucgccaagcccaccaacaagaucgcccccauguccgugaucccgccgcccaucgugaagcccauccccgucgcggagagcaccaucaagaaguccauccccuucgacaagcugcucagcgaggccgagaaggagcugaaccagacgaagauccggcuggagaccgagcgccgguccaacgccgaggaggccgcgaaggagcgcgcccggaugcgcgagaucgaggacaagcuccggaaggacugggagcuggagcgcgagcggaaggacgccguggccgacgaccuggccaaggagaucgcgcgccggcgcgagaucgagcggaaggcccacgagcucgacaagaugcugaagaagaaggagcgcgaggaccugguggcccgggagcgcgucagcgaggacaugcgcaaccacgugugcaagcccaacaccaccaucgcccccgccccgacgaucaucaccacccuccugauggcguccgccgugauggccgggccccuggagaaccgggagaccaaccaccuccugaaccgccccggcaacggggccuacacgcugagcgacuucgccgagagcacgugcacccucgcguacggcuccgagugcaagagcugggagcaccagcuggacgagcuguccuuccccuucuuccacagcaaccucgacaaguacuccaugcuggaggccgccaccgagacgaucccgauccugaacaagagcuccgccgucugcaccaucagccccuccacccacagcuccaacgccugcggccgggaggcgagccucaucaagaagaagugcggguccaacaugagcgccuucuucuacgugaaccuggccggccagaucaccguggucaagugcgacacgaaccacgugcuguccaacgacugcgggaacugcaucagcaagacccucuccggccagaagaucuacacccccgugcaggacauguucugccagaagggcuggaccgagagcauccccaacacgcgcuacuccaaggaccugugcagcaucgggcugcacagcgucaaggagugcaagaccggcaccaccaacuucgagcgggugggguucaucguggucaagggccgcaagauguacaucgagcagaugaagaugcggucccgccaggaguucagcgaggaccaguuccucugcuacaaguccgagagcuccagcggguccagcgugaagcugaagaaggucaagguggaguccugcaagggcgugacgaccagcuccgccagcaagugcuccggcgacgaguacuucugcagccgguacccgugcgagaccgcgaacgucgaggcccacugcauccugcgccggcacuccgccgugaucgaggugaacgucaacgggguguggaucgugccccgcugcaucggcuacgaggagguccucgugcggcgcaccagccugaagguggaggacacguccagccgggagugcgacacgugccugugggagugcgggaaggacaagcucaucgucaagacccacggccccaagaucguguacgccaccgccugcagccacggguccugcaagagcgugaugcagaagcccgcgaccuucgucuaccugccguaccccggcaacuccgagaucgugggcggggacaucggcgugcacaugaccgaggagagcucccccagcaacauccacauggucgcccacugccccgccaaggacuccugcgaggugagcuccugccuguucugcgugcacgggcugcucaacuaccagugccacacccuguucagcgcccugcucaucuccaccaccgucaugagcauccugacgcugcuccugcugcucaugaagggcgccaaggaccuggugaagcgccuguucuacuggcucaucaccccgcugugcuggcuguccguguucugcgggugggucaucaagagcuggaagaagcgggugggcuccgcgaucagccgcaccaacgacaccaucggcuggcgggacaaccgccgcuaccggcaggacguggagcgcgcccaguacaccgggggcgcccccggggccaaguacuccuucuacggcgucauggugcucggccugcuggggaacgugcacagcugcuccgagagcgucaucgccgacagcaagaucaugcagugcaccaccuccggcagcuccacccucugcaaggcgagcgggacggugaucaugaagcugggccccaucggguccgagagcugccugauccucaagggccugaaggacuccgagaagcaguucaucagcaucaagaccaucuccagcgagcugaccugccgggagggcgaguccuucuggaccacgcucuacaccccggugugccugagcucccgccggugccaccugaugggggagugcgucagcgaccgcugccucaaguggaagaccaacgagaccuccgccgaguucacgggcaaggcccacggggaggugaugcacgagaaccggugcuucgagcagagcggcgggaucggcuacggcugcuucaacgugaaccccuccugccuguacguccacagcuaccugaaguccguguacaagaacggguucaagaccuuccgcugcguggccuggaaccaccggauccgccucgaggucaccacccacagccggaaguuccccauggugcugauggcgaugagcacgcagcccaccgacuggggcuccaucgggcugauccucgacagcgagggcaucaccgggaccaacgccuacuccuucaugcgccacggcagcggcuccuucgccaucaucgacgacccguacagccccgagccccggaagggguuccugggcgaggugcgcugccccacggaggagaccgccauccgggccuccccgagcugcaagauggcgcccaaccugaucgaguaccagcccgagauggacaccgccgagugcaccacgaacaugaucgaccccauggccaucuucaaccgcgggucccucccgcagguccgggacggcaugaccuucacccagagcaucgagaagaacaccgugcaggcccugacgaccggggaggugcgcgccuccauccggcugacccucgacgacuacgacgucguguaccagaacagccaguccgacugcagcgcgaccuucaagaaccugaccggcugcuacuccugcgacgagggcagccgcaugugcuaccaggugaaggccgagggggagacgaucuuccacuucaucaacgaggacgaguccaucaacgucaucagcaaggugaaccccgacguguccgacuacugcaccguccugcacuucagccggcccgugaucagcaucgagggccgcuacgacugcgggcucuccaagcgccccauggucaucaagggcacccugaucgccaccgccccgcacgacgaccggaagcacgagggcgggagcucccugaucgugaaccccaagggcgggacgguggacuucuucggcugggucagcgggcucaccuccuggcugggcggcccccugaagaccuuccucaccauccugggguuccuggcccucggccugcugcucguggugaucaucaucaucaucgcgcgcacggggguccagcaggcccugaagaagaagaacaaguga

SEQ ID NO: 13080 - RNA, 4020 nt, Artificial Sequence
  derived and/or modified CDS sequence (opt1) from TOSV(TOSV-54441132704)__KX010933.1__GP
auguucaucgccaagcugcuccugaucagcugccuggugcagcaggccuaccucaaguacaccaucaucuccgagaucggcaacgggacccgcacgagcuucugcuacuccagccggaccucccugggcagccugcucgaggcgugggacaacgucaccgaguccaucgggcugaccagcggcacgugcaagguggggucccuggagaaccgcgacugccggaaggacaucaugagcaacuacguggccgagguccacuccaaccuccacggccugggcgccaugaugcacaacuacggggacgacaagcgcguggagauccugaacgacgugauccccgacgagcucaacccgggccaccacaacugcagcgaccuggaccggaagcccuucuggaccgaguucaucaacgucgccaagccccuguccgagaucgugcccaugagcgugaucccgccgcccgucgugaagcuccagccgcccgccgagcccuccagcaagaagcacgugcccuucgacguccugcuguccgaggcggagaaggagcucaaccagaccaagauccgccuggaggacgagcgcaagagcaacgccgaggagaccgccaaggagcgggcccggaugaaggagaucgaggacgagcugcgccgggagugggagcucgagcgcaagcggaaggacgcgauggccgacgaccuggccaaggagacggcccgccggcgcgagaucgagcggaaggcccacgagcuggacaagaugcucaagaagaaggagcgcaagucccugaucgcgaaggagaaggccgacguggacaugcggagccacgugcacaagcccaacaccacccgcgcccccgcccccaccaucaucacgacccugcucauggccagcgcggcccuggccgggccccuggagaaccgggagaccaaccaccuccugaaccgccccggcaacggggccuacacccuguccgacuucgccgagagcacgugcacccucgcguacggcuccgagugcaagagcugggagcaccuccugaacgaggagcuguucccguucuuccacuccaaccuggacaaguacagcaugcuggaggccgccaccgagaccguccccauccucaacaaguccagcgccgugugcacgaucucccccagcacccacuccagcaacgccugcggccgcgaggcguccgugauccggaagaagugcuacagcaacauguccgccuucuucuacaucaaccuggccgggcagaucaccgucaucaagugcgagaccaaccacgugcugagcuccgacugcggcaacugcaucagcaagucccucagcgggcagaagguguacacgcccguccaggacguguucugccagaagggcuggacccagagcaucccguccacccgcuacagcaaggacaucugcuccaucggccugcacaccgugaaggagugcaagaucgggacgaccagcuucgagcgggucggcuucaucguggucaaggggcgcaagauguacaucgagcagaugaagaugcggucccgccaggaguacagcgaggaccaguuccugugcuacaaguccgagagcggcuccgggagcuccgugaagcucaagaaguucaagguggagagcugcaagggcgucaccaccuccagcgccuccaagugcagcggcgacgaguacuucugcucccgguaccccugcgagacggcgaacguggaggcccacugcauccugcgccggcacagcgccaucguggaggucaacgugaacggggugugggucgugccccgcugcaucggcuacgaggaggugcuggucaagcggaccagccucaagguggaggacaccaccgggcgcgagugcgacuccugccugugggagugcggcaagaacaagcugaucgugaagacgcacgggcccaaggucguguacgccaccgccugcagccacggcuccugcaagagcgugaugcagaagccggcgaccuucgucuaccugcccuaccccggcaacuccgagaucgucgggggcgacaucgggauccacaugaccgaggagagcucccccagcaacauccaccucguggcccacugcccggcccgggacuccugcgacgugagcgacugccuguucugcgugcacggccugcucaacuaccagugccacacccuguucuccgcccugcucaucagcacgaccgugauguccauccugacccugcuccugcugcucgucaagggggccaaggaccuggugaagaagcuguucuacuggcucaucacgccccugugcuggcugagcguguucugcugcugggucgugaaguccuggaagcgccgggugggcagcgcgaucucccgcaccaacgacaccaucggcuggcgggagaaccgccggcacgcccaggacaucgagcgcgcccaguacaccgggggcgcccccggggccaaguacagcuucuacggcgucaugauccucggccugcuguccagcgcgcagagcugcuccgagagcgugaucgccgacuccaagaucaugcagugcaccacgagcggguccagcacccucugcaaggccuccggcaccgugaucaugcgccuggggccgaucggcagcgaguccugccugauccucaaggggcugaaggacagcgagaagcaguucaucuccaucaagaccaucagcuccgagcugacgugccgggagggcgagagcuucuggaccacccucuacacccccaucugccuguccagccgccggugccaccugaugggcgagugcgucuccgaccgcugccucaaguggaagacgaaccagaccagcgccgaguucaccgggaaggcgcacggcgacgugaugcacgagaaccggugcuucgagcaguccgggggcaucggguacggcugcuucaacgugaaccccagcugccuguacguccacagcuaccugaaguccguguaccgcaacggcuucaagguguuccggugcgucgccuggaaccaccgcauccggcucgaggugaccacgcacagccgcaaguuccccauggugcugauggccauguccacccagccgaccgacugggggagcaucggccugauccucgacuccgaggggaucaccggcacgaacagcuacuccuucaugaagcacgggagcggcuccuucgccaucaucgacgaccccuacagccccgagccccggaagggcuuccugggggagguccgcugcccgaccgaggagaccgccaugcgggcgucccccagcugcaagauggcccccaaccugaucgaguaccagcccgagauggacaccgccgagugcacgaccaacaugaucgacccgauggccaucuucaaccgcggcucccucccccaggugcgggacgggaugaccuucacccagagcaucgagaagaacacggugcaggcccugaccaccggcgaggucaaggcguccauccgccugauccucgacgacuacgacgugguguaccagaacagccaguccgacugcagcgccaccuucaagaaccugacggggugcuacuccugcgacgagggcagccggcugugcuaccaggucaaggccgagggcgagaccaucuuccacuucaucaacgaggaggagagcaucaacgugaucaacaaggugucccccggggucagcgacuacugcaccgugcuccacuucucccgccccgucaucagcaucgagggcaccuacgacugcgggcuguccaagcggccgauggugaucaagggcacccugaucgccacggcgccccacgacgaccgcaagcacgagggcgggagcucccucguggucaaccccaagggcgggagcguggacuucuucggcuggcuguccgggcugaccagcuggcucggcggcccccugaagaccuuccugaccauccucggguuccuggccgugggccugcuccuggucgugaucaucaucaucaucauccggacggggaugcagcaggcccugaagaagaagaucaaguga

SEQ ID NO: 13081 - RNA, 3222 nt, Artificial Sequence
  derived and/or modified CDS sequence (opt1) from SFTSV(HB29)__NC_018138.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcacccggguccgcccgaagugcuacggguucagccggaugauggcgacccuggaggugaacccgcccgagcagcgcaucggccagugcacggggugccaccucgagugcaucaacggcggggugcggcugaucacccugaccuccgagcuccgcagcgccaccgucugcgccucccacuucugcagcuccgccagcuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcaucacgaccggccgcgcccugcugcccgccgugaaccccgggcaggaggccugccuccacuucaccgcccccggcagcccggacagcaagugccugaagaucaaggugaagcggaucaaccugaagugcaagaaguccagcuccuacuucguccccgacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcugaccaugcccuccggcgagguccggaccuuccaccccaugagcgggauccccacccagguguucaagggcguguccgucacguaccuggggagcgacauggagguguccggccucaccgaccugugcgagaucgaggagcucaagagcaagaagcuggcccuggccccgugcaaccaggccggcauggggguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgauccccacgaccaucggcggccuccgcuucgagcggagccacgacucccaggggaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacagcuacaucgugcggcuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgcuggauccucggggucaucggcgugcugcugggcgggcucgcgcuguucuuccugaucauguuccuccugaagcugggcaccaagcaggucuuccggucccgcaccaagcucgccuga

SEQ ID NO: 13082 - RNA, 3222 nt, Artificial Sequence
  derived and/or modified CDS sequence (opt1) from SFTSV(Jilin)__KT890281.1__GP
augaugaaggugaucugguucagcucccugaucugccucgucauccagugcggcggggacaccggccccaucaucugcgccgggccgauccacagcaacaaguccgccaacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggcgccccuggaggugaacccgcccgagcagcgcaucgggcagugcacgggcugccaccucgagugcaucaacgggggcgugcggcugaucacccugaccagcgagcucaagagcgccaccgucugcgccuaccacuucugcuccugcgccacgagcggcaagaaguccaccgagauccaguuccacagcgggucccuggugggcaagaccgccauccacgucaagggggcccugguggacggcaccgaguucacguucgagggccgcugcauguuccccgacgggugcgacgcgguggacugcaccuucugccgggaguuccucaagaacccccagugcuaccccgcccagaaguggcuguucaucaucaucgucauccugcucggcuacgccgggcugaugcugcucaccaacgugcugaaggccaugggcgugugggggagcugggucaucgcccccgugaagcugguguucgcgaucaucaagaagcucaugcgcgccgucuccugccugaugggcaagcugauggaccggggccgccaggugauccacgaggagaucggggagaaccgggagggcaaccaggacgacgugcgcaucgagauggcccgcccgcggcgcguccggcacuggauguacagccccgugauccagaccaucguggccaucgggcucgccgagggcugcgacgagaugguccacgcggacuccaagcuggugagcugccgccagggguccggcaacaugaaggagugcgugacgaccggccgggcccugcuccccgccgucaaccccgggcaggaggccugccugcacuucaccgccccgggcagccccgacuccaagugccugaagauccgcgugaagcggaucaaccucaagugcaagaaguccuccagcuacuucgugcccgacgcgcgcucccggugcaccagcguccgccggugccgcugggccggggacugccagagcggcugcccgccccacuucacguccaacagcuucuccgacgacugggccgggaagauggaccgggccggccugggcuucagcgggugcuccgacggcugcgggggcgcggccugcgggugcuucaacgccgcccccagcugcaucuucuggcgcaaguggguggagaacccccacggcaucaucuggaagguguccccgugcgccgcguggguccccagcgccgugaucgagcugaccaugcccuccggcgaggugcggaccuuccaccccaugagcgggaucccgacccaggucuucaagggcguguccgugacguaccucgggagcgacauggaggucuccggccugaccgaccugugcgagaucgaggagcucaagagcaagaagcuggcccuggcccccugcaaccaggccggcauggggguggugggcaaggucggggagauccagugcuccagcgaggaguccgcgcgcaccaucaagaaggacggcugcaucuggaacgccgaccugguggggaucgagcuccggguggacgacgccgucugcuacagcaagaucaccuccguggaggccguggccaacuacagcgcgauccccacgaccaucggcggccugcgcuucgagcggagccacgacucccaggggaagaucagcggcagcccccuggacaucaccgccauccgcgggagcuucuccgucaacuaccgcggccuccggcugagccuguccgagaucaccgccacgugcaccggggaggugaccaacgugagcggcugcuacuccugcaugaccggcgccaaggucagcaucaagcuccacuccagcaagaacuccaccgcgcacgugcgcugcaagggggacgagacggccuucagcgugcuggagggcguccacuccuacagcgugucccugagcuucgaccacgccguggucgacgagcagugccagcucaacugcgggggccacgagucccaggugacccugcgggggaaccugaucuuccucgacgugccgaaguucgucgacggcagcuacaugcagaccuaccacagcaccgugcccacgggcgccaacauccccucccccaccgacuggcugaacgcccuguucgggaacggccucagccgcuggauccugggggucaucggcgugcugcucggcgggcuggcgcuguucuuccucaucaugucccuguucaagcugggcaccaagcagaucuuccggagccgcaccaagcucgccuga

SEQ ID NO: 13083 - RNA, 3222 nt, Artificial Sequence
  derived and/or modified CDS sequence (opt1) from SFTSV(05-Lu'an(CHN)-2015)__KX302597.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcggggccaagugccgcugcucccucgugcacaagcccggcgaggucguggugagcuacggcgggaugcggguccgcccgaagugcuacggcuucagccggaugauggccacccuggaggugaaccagcccgagcagcgcaucgggcagugcacgggcugccaccuggagugcaucaacgggggcgugcggcucaucacccugaccuccgagcucaagagcgcgaccgucugcgccucccacuucugcagcuccgccacgagcggcaagaaguccaccgagauccaguuccacagcgggucccucgugggcaagaccgccauccacgucaagggggcccugguggacggcaccgaguucacguucgagggcagcugcauguuccccgacgggugcgacgcgguggacugcaccuucugccgcgaguuccugaagaacccccagugcuacccggccaagaaguggcuguucaucaucaucgucauccugcugggcuacgccgggcucaugcugcugaccaacgugcucaaggccaucggcaucuggggguccugggugaucgcccccgucaagcugauguucgcgaucaucaagaagcugaugcggaccgugagcuaccucaugggcaagcugauggaccgcggccgccaggugauccacgaggagaucggggagaaccgggagggcaaccaggacgacguccggaucgagauggcccgcccccgccgggugcgccacuggauguacucccccgugauccugacgauccucgccaucgggcuggccgagagcugcgacgagaugguccacgccgacuccaagcuggugagcugccggcagggcuccgggaacaugaaggagugcgugaccaccggccgcgcgcuccugccggccgucaaccccggccaggaggccugccugcacuucaccgcccccgggagccccgacagcaagugccucaagaucaaggugaagcggaucaaccugaagugcaagaaguccagcuccuacuucgugccggacgcccgcagccggugcacguccguccgccggugccgcugggcgggcgacugccagagcgggugcccgccccacuucaccuccaacagcuucuccgacgacugggccggcaagauggaccgggccgggcugggcuucagcggcugcuccgacgggugcggcggggccgcgugcggcugcuucaacgccgcccccagcugcaucuucuggcgcaaguggguggagaacccccacgggaucaucuggaaggugucccccugcgccgccuggguccccagcgcggugaucgagcucaccaugccguccggcgaggugcggaccuuccaccccaugagcggcauccccacgcaggucuucaaggggguguccgugaccuaccugggcagcgacauggaggucuccgggcugaccgaccucugcgagaucgaggagcucaagagcaagaagcuggcccuggcccccugcaaccaggccggcaugggcgugguggggaaggucggcgagauccagugcagcuccgaggagagcgcccgcaccaucaagaaggacgggugcaucuggaacgcggaccuggugggcaucgagcugcggguggacgacgccgucugcuacuccaagaucacgagcguggaggccguggccaacuacuccgccaucccgaccaccaucgggggccugcgcuucgagcggagccacgacucccagggcaagaucagcgggagcccccucgacaucaccgcgauccgcggcagcuucuccgucaacuaccgggggcugcgccugagccucuccgagaucacggcgaccugcaccggcgaggugaccaacgugagcgggugcuacuccugcaugaccggcgccaaggucagcaucaagcugcacuccagcaagaacuccacggcccacgugcgcugcaagggcgacgagaccgccuucagcgugcuggaggggguccacagcuacaccgugucccucagcuucgaccacgccguggucgacgagcagugccagcugaacugcggcgggcacgagucccaggugacccugaagggcaaccucaucuuccuggacgugcccaaguucgucgacgggagcuacaugcagacguaccacuccaccgugcccaccggcgccaacaucccgagccccaccgacuggcugaacgcccucuucggcaacgggcugucccgguggauccugggcgugaucgggguccuccugggcggccuggcccucuucuucaugaucaugagccuguucaagcuggggacgaagcaggucuuccgcucccggaccaagcucgcguga

SEQ ID NO: 13084 - RNA, 3222 nt, Artificial Sequence
  derived and/or modified CDS sequence (opt1) from SFTSV(07-Lu'an(CHN)-2015)__KX302598.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccaccagcggcaagaaguccacggagauccacuuccacagcggcucccugguggggaagaccgccauccacgucaagggcgcgcugguggacgggaccgaguucaccuucgagggcagcugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcuccugggucaucgcgcccgugaagcugauguucgccaucaucaagaagcucaugcgcaccgugagcugccuggucgggaagcugauggaccggggccgccaggugauccacgaggagaucggcgagaacggggagggcaaccaggacgacgugcggaucgagauggcccgcccccgccggguccgccacuggauguacuccccggugauccucaccauccuggccaucgggcuggccgagggcugcgacgagauggugcacgcggacagcaagcucgucuccugccggcaggggagcggcaacaugaaggagugcaucacgaccggccgcgcccugcugcccgccgugaaccccgggcaggaggccugccuccacuucaccgcccccggcuccccggacagcaagugccugaagaucaaggugaagcggaucaaccugaagugcaagaaguccagcagcuacuucguccccgacgcgcgcucccggugcaccagcgugcgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaaguggguggagaacccccacggcaucaucuggaaggucagccccugcgccgcgugggugccguccgccgugaucgagcugaccaugcccagcggcgagguccggaccuuccaccccauguccgggauccccacccagguguucaagggcgugagcgucacguaccugggguccgacauggaggugagcggccucaccgaccugugcgagaucgaggagcugaaguccaagaagcuggcccucgccccgugcaaccaggccggcauggggguggucggcaaggugggggagauccagugcagcagcgaggaguccgcgcgcaccaucaagaaggacggcugcaucuggaacgccgaccugguggggaucgagcugcgggucgacgacgccgugugcuacagcaagaucaccuccguggaggccgucgccaacuacagcgcgauccccacgaccaucggcggccuccgcuucgagcggucccacgacagccaggggaagaucuccggcagcccccuggacaucaccgccauccgcggguccuucagcgugaacuaccggggccugcgccucucccugagcgagaucaccgccacgugcaccggggaggugaccaacgucuccggcugcuacagcugcaugaccggcgccaagguguccaucaagcugcacagcuccaagaacagcaccgcgcacgugcgcugcaagggggacgagacggccuucuccguccucgagggcgugcacagcuacaucgugagccuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgguggauccucggggucaucggcgugcugcugggcgggcucgcgcuguucuuccugaucauguuccuccugaagcugggcaccaagcaggucuuccgcucccggaccaagcucgccuga

SEQ ID NO: 13085 - RNA, 3222 nt, Artificial Sequence
  derived and/or modified CDS sequence (opt1) from SFTSV(12-Lu'an(CHN)-2014)__KX302595.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagguggacgggaucgucuucaaccagugcgacagcgagucccucccgcagcccaucgacguggccuggauggacgugggccacagccacaagaucaucaugcgcgagcacaagacgaaguggguccaggaguccagcuccaaggacuucgugugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccugguccacaagcccggcgaggugguggucagcuacgggggcaugcgggugcgcccgaagugcuacggcuucagccggaugauggccacgcuggaggugaacccgcccgagcagcgcaucgggcagugcaccggcugccaccucgagugcaucaacgggggcguccggcugaucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugauggcgcccgugaagcugauguucgccaucaugaagaagcucaugcggagcgucuccugccugaugggcaagcugauggaccgcgggcgccaggugauccacgaggagaucggcgagaaccgggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcgugacgaccgggcgcgcccugcugcccgccgugaaccccggccaggaggccugccuccacuucaccgcccccggcagcccggacagcaagugccugaagaucaaggucaagcggaucaaccugaagugcaagaaguccagcuccuacuucgugcccgacgcgcgcagccggugcaccuccgugcgccggugccgcugggccggggacugccagagcggcugccccuccuacuucacgagcaacuccuucagcgacgacugggccgggaagauggaccgggccggccucggguucuccggcugcagcgacggcugcgggggcgcggccugcgggugcuucaacgccgccccguccugcaucuucuggcgcaagugggucgagaacccccacggcaucaucuggaaggugagccccugcgccgcgugggugcccuccgccgucaucgagcugaccaugccgagcggggaggugcggaccuuccaccccauguccggcauccccacccagguguucaagggcgucagcgugacguaccugggguccgacauggaggugagcggccucaccgaccugugcgagaucgaggagcucaagagcaagaagcuggcccuggcccccugcaaccaggccgggaugggcgucgugggcaaggugggggagauccagugcuccagcgaggaguccgcgcgcaccaucaagaaggacggcugcaucuggaacgccgaccuggucgggaucgagcugcggguggacgacgccgugugcuacagcaagaucaccuccgucgaggccguggccaacuacagcgcgaucccgacgaccaucggcgggcuccgcuucgagcggucccacgacagccagggcaagaucuccggcagcccccuggacaucaccgccauccgcggguccuucagcgugaacuaccggggccugcgccucucccugagcgagaucaccgccacgugcaccggggaggucaccaacguguccggcugcuacagcugcaugaccggggccaagguguccaucaagcugcacagcuccaagaacagcaccgcgcacguccgcugccggggcgacgagacggccuucagcgugcucgagggcgugcacuccuacaccgucagccuguccuucgaccacgccgugguggacgagcagugccagcugaacugcgggggccacgagagccaggucacccucaaggggaaccugaucuuccuggacgugcccaaguucguggacggcuccuacaugcagaccuaccacagcuccguccccacgggggccaacaucccgagccccaccgacuggcucaacgcccuguucggcaacggccugucccgcuggauccucggggugaucggcguccugcugggggugcucgcgcuguucuuccugaucaugagccucuucaagcugggcaccaagcaggucauccggucccgcaccaagcuggccuga

SEQ ID NO: 13086 - RNA, 3222 nt, Artificial Sequence
  derived and/or modified CDS sequence (opt1) from SFTSV(14-Lu'an(CHN)-2014)__KX302596.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagguggacgggaucgucuucaaccagugcgacagcgagucccucccgcagcccaucgacguggccuggauggacgugggccacagccacaagaucaucaugcgcgagcacaagacgaaguggguccaggaguccagcuccaaggacuucgugugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccugguccacaagcccggcgaggugguggucagcuacgggggcaugcgggugcgcccgaagugcuacggcuucagccggaugauggccacgcuggaggugaacccgcccgagcagcgcaucgggcagugcaccggcugccaccucgagugcaucaacgggggcguccggcugaucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugauggcgcccgugaagcugauguucgccaucaugaagaagcucaugcggagcgucuccugccugaugggcaagcugauggaccgcgggcgccaggugauccacgaggagaucggcgagaaccgggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcgugacgaccgggcgcgcccugcugcccgccgugaaccccggccaggaggccugccuccacuucaccgcccccggcagcccggacagcaagugccugaagaucaaggucaagcggaucaaccugaagugcaagaaguccagcuccuacuucgugcccgacgcgcgcagccggugcaccuccgugcgccggugccgcugggccggggacugccagagcggcugccccucccacuucacgagcaacuccuucagcgacgacugggccgggaagauggaccgggccggccucggguucuccggcugcagcgacggcugcgggggcgcggccugcgggugcuucaacgccgccccguccugcaucuucuggcgcaagugggucgagaacccccacggcaucaucuggaaggugagccccugcgccgcgugggugcccuccgccgucaucgagcugaccaugccgagcggggaggugcggaccuuccaccccauguccggcauccccacccagguguucaagggcgucagcgugacguaccugggguccgacauggaggugagcggccucaccgaccugugcgagaucgaggagcucaagagcaagaagcuggcccuggcccccugcaaccaggccgggaugggcgucgugggcaaggugggggagauccagugcuccagcgaggaguccgcgcgcaccaucaagaaggacggcugcaucuggaacgccgaccuggucgggaucgagcugcggguggacgacgccgugugcuacagcaagaucaccuccgucgaggccguggccaacuacagcgcgaucccgacgaccaucggcgggcuccgcuucgagcggucccacgacagccagggcaagaucuccggcagcccccuggacaucaccgccauccgcggguccuucagcgugaacuaccggggccugcgccucucccugagcgagaucaccgccacgugcaccggggaggucaccaacguguccggcugcuacagcugcaugaccggggccaagguguccaucaagcugcacagcuccaagaacagcaccgcgcacguccgcugccggggcgacgagacggccuucagcgugcucgagggcgugcacuccuacaccgucagccuguccuucgaccacgccgugguggacgagcagugccagcugaacugcgggggccacgagagccaggucacccucaaggggaaccugaucuuccuggacgugcccaaguucguggacggcuccuacaugcagaccuaccacagcuccguccccacgggggccaacaucccgagccccaccgacuggcucaacgcccuguucggcaacggccugucccgcuggauccucggggugaucggcguccugcugggggugcucgcgcuguucuuccugaucaugagccucuucaagcugggcaccaagcaggucuuccggucccgcaccaagcuggccuga

SEQ ID NO: 13087 - RNA, 3222 nt, Artificial Sequence
  derived and/or modified CDS sequence (opt1) from SFTSV(18-Lu'an(CHN)-2015)__KX302599.1__GP
augaugaaggugaucugguucuucagccugaucugcuucgucauccagugcuccggcgacagcgggcccaucaucugcgccggcccgauccacuccaacaagagcgccgacaucccccaccuccugggguacuccgagaagaucugccagaucgaccgccugauccacgugagcuccuggcuccggaaccacagccaguuccagggcuacguggggcagcgcggcggccggucccaggucagcuacuaccccgcggagaacuccuacagccgcugguccgggcugcugagccccugcgacgccgacuggcucggcaugcugguggugaagaaggccaagggguccgacaugaucgucccgggccccagcuacaaggggaagguguucuucgagcggcccaccuucgacggcuacgugggcugggggugcggcuccggcaagagccgcaccgaguccggggagcugugcagcagcgacuccggcacgagcuccgggcuccugcccagcgaccggguccuguggaucggcgacguggccugccagccgaugacccccauccccgaggagaccuuccucgagcugaaguccuucagccaguccgaguuccccgacaucugcaagaucgacgggaucguguucaaccagugcgagggcgagagccugccgcagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaagaccugcaagaccuccgggagcugccggggcgacaugcaguucugcaagguggcggggugcgagcacggcgaggaggccuccgaggccaagugccgcugcagccucgugcacaagcccggggaggucgugguguccuaccggggcaugcgcauccggccgaagugcuacggcuucagccgcaugauggccacccuggaggucaaccagcccgagcagcggaucgggcagugcacgggcugccaccuggagugcaucaacgggggcgugcgccucaucacccugaccagcgagcugaaguccgcgaccgugugcgccagccacuucugcuccagcgccacguccgggaagaaguccaccgagauccaguuccacuccggcagccucgucggcaagaccgccauccacgugaagggggcccuggucgacggcaccgaguucacguucgagggguccugcauguuccccgacggcugcgacgcgguggacugcaccuucugccgggaguuccugaagaacccccagugcuacccggccaagaaguggcuguucaucaucaucgugauccugcugggcuacgccgggcucaugcugcugaccaacguccucaaggccaucggcaucugggggagcugggugaucgcccccgugaagcugaucuucgcgaucaucaagaagcugaugcgcaccgucuccugccucaugggcaagcugauggaccgggggcgccaggugauccacgaggagaucggcgagaaccgggagggcaaccaggacgacgugcgcaucgagauggcccgcccccggcgcguccggcacuggauguacagccccgugauccugacgauccucgccaucgggcuggccgagggcugcgacgagauggugcacgccgacuccaagcuggucagcugccgccagggguccggcaacgugaaggagugcgugaccaccgggcgggcgcuccugccggccgucaaccccggccaggaggccugccugcacuucaccgcccccggcagccccgacuccaagugccucaagauccgcgugaagcggaucaaccugaagugcaagaaguccagcagcuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccaucaccuaccuggggagcgacauggagguguccggccugaccgaccucugcgagaucgaggagcucaagagcaagaagcuggcccuggcccccugcaaccaggccgggaugggcgucgugggcaaggugggggagauccagugcuccagcgaggagagcgcccgcaccaucaagaaggacggcugcaucuggaacgcggaccucgucgggaucgagcugcggguggacgacgccgugugcuacuccaagaucacgagcgucgaggccguggccaacuacuccgccaucccgaccaccaucggcgggcugcgcuucgagcggagccacgacucccagggcaagaucagcggcagcccccucgacaucaccgcgauccgcgggagcuucuccgugaacuaccgcggccugcggcugagccucuccgagaucacggcgaccugcaccggggaggucaccaacgugagcggcugcuacuccugcaugaccggggccaaggugagcaucaagcugcacuccaacaagaacagcacggcccacguccgcugcaagggcgacgagaccgccuucuccgugcuggagggcgugcacagcuacaccgucucccucagcuucgaccacgccgugguggacgagcagugccagcugaacugcgggggccacgagagccaggucacccugaaggggaaccucaucuuccuggacgugcccaaguucguggacggcuccuacaugcagacguaccacagcaccguccccaccggggccaacaucccgucccccaccgacuggcugaacgcccucuucggcaacggccugagccgguggauccugggggugaucggcgugcuccucgggggccuggcccuguucuucaugaucaugucccuguucaagcugggcacgaagcaggucuuccgcagccggaccaagcucgcguga

SEQ ID NO: 13088 - RNA, 3222 nt, Artificial Sequence
  derived and/or modified CDS sequence (opt1) from SFTSV(27-Lu'an(CHN)-2015)__KX302600.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgcaucggccagugcacggggugccaccuggagugcaucaacggcggggugcggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccuggucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugaucuucgcgaucaucaagaagcugaugcggaccgucagcugccucauggggaagcugauggaccgcggccgccaggugauccacgaggagaucggcgagaaccgggaggggaaccaggacgacgugcggaucgagauggcccgcccccgccggguccgccacuggauguacucccccgugauccugacgauccucgccaucggccuggccgagagcugcgacgagauggugcacgccgacuccaagcuggucagcugccggcagggguccggcaacaugaaggagugcgugaccaccgggcgcgcgcuccugccggccgugaaccccggccaggaggccugccugcacuucaccgcccccggcagccccgacagcaagugccucaagaucaaggucaagcggaucaaccugaagugcaagaaguccagcuccuacuucgugccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaagugggucgagaacccccacggcaucaucuggaaggugucccccugcgccgccugggugcccagcgcggucaucgagcucaccaugccguccggggaggugcggaccuuccaccccaugagcggcauccccacccagguguucaagggcgucuccgugaccuaccuggggagcgacauggagguguccggccugaccgaccucugcgagaucgaggagcucaagagcaagaagcuggcccuggcccccugcaaccaggccgggaugggcgucgugggcaaggugggggagauccagugcagcuccgaggagagcgcccgcaccaucaagaaggacggcugcaucuggaacgcggaccuggucgggaucgagcugcggguggacgacgccgugugcuacuccaagaucacgagcgucgaggccguggccaacuacuccgccaucccgaccaccaucggcgggcugcgcuucgagcggagccacgacucccagggcaagaucagcggcagcccccucgacaucaccgcgauccgcgggagcuucuccgugaacuaccggggccugcgccugagccucuccgagaucacggccacgugcaccggggaggucaccaacgugagcggcugcuacuccugcaugaccggggccaaggugagcaucaagcugcacuccagcaagaacuccacggcccacguccgcugcaagggcgacgagaccgcguucagcgugcuggagggcgugcacagcuacaccgucucccucagcuucgaccacgccgugguggacgagcagugccagcugaacugcgggggccacgagucccaggucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgguggauccugggggugaucggcgugcuccucgggggccuggcccuguucuucaugaucaugagccuguucaagcugggcacgaagcaggucuuccgcucccggaccaagcucgcguga

SEQ ID NO: 13089 - RNA, 3222 nt, Artificial Sequence
  derived and/or modified CDS sequence (opt1) from SFTSV(36-Lu'an(CHN)-2015)__KX302601.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugauguucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugguccugacgauccucgccaucggccuggccgagagcugcgacgagauggugcacgccgacuccaagcuggugagcugccggcagggguccggcaacaugaaggagugcgucaccaccgggcgcgcgcuccugccggccgugaaccccggccaggaggccugccugcacuucaccgcccccggcagccccgacagcaagugccucaagaucaaggugaagcggaucaaccugaagugcaagaaguccagcuccuacuucgucccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggucucccccugcgccgccugggugcccagcgcggugaucgagcucaccaugccguccggggagguccggaccuuccaccccaugagcggcauccccacccagguguucaagggcguguccgucaccuaccuggggagcgacauggagguguccggccugaccgaccucugcgagaucgaggagcucaagagcaagaagcuggcccuggcccccugcaaccaggccgggaugggcguggucggcaaggugggggagauccagugcagcuccgaggagagcgcccgcaccaucaagaaggacggcugcaucuggaacgcggaccugguggggaucgagcugcgggucgacgacgccgugugcuacuccaagaucacgagcguggaggccgucgccaacuacuccgccaucccgaccaccaucggcgggcugcgcuucgagcggagccacgacucccagggcaagaucagcggcagcccccucgacaucaccgcgauccgcgggagcuucuccgugaacuaccggggccugcgccugagccucuccgagaucacggccacgugcaccggggaggugaccaacgucagcggcugcuacuccugcaugaccggggccaaggugagcaucaagcugcacuccagcaagaacuccacggcccacgugcgcugcaagggcgacgagaccgcguucagcguccuggagggcgugcacagcuacaccgugucccucagcuucgaccacgccgucguggacgagcagugccagcugaacugcgggggccacgagucccaggugacccugaaggggaaccucaucuuccuggacguccccaaguucguggacggcagcuacaugcagacguaccacuccaccgugcccaccggggccaacaucccgagccccaccgacuggcugaacgcccucuucggcaacggccugucccgguggauccugggggucaucggcgugcuccucgggggccuggcccuguucuucaugaucaugagccuguucaagcugggcacgaagcaggucuuccgcucccggaccaagcucgcguga

SEQ ID NO: 13090 - RNA, 3222 nt, Artificial Sequence
  derived and/or modified CDS sequence (opt1) from SFTSV(42-Lu'an(CHN)-2015)__KX302602.1__GP
augaugaaggugaucugguucagcucccugaucugcuucgugauccagugcagcggcgacuccgggcccaucaucugcgccggcccgauccacagcaacaaguccgccgacaucccccaccuccugggguucagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggccggaugcgcguccggccgaagugcuacggcuucagccgcaugauggccacccuggaggugaaccagcccgagcagcggaucgggcagugcacgggcugccaccuggagugcaucaacgggggcgugcgccucaucacccugaccuccgagcucaagagcgcgaccgucugcgccucccacuucugcagcuccgccacgagcgggaagaaguccaccgagauccaguuccacagcggcucccuggugggcaagaccgccauccacgucaagggggcccugguggacggcaccgaguucacguucgaggggagcugcauguuccccgacggcugcgacgcgguggacugcaccuucugccgggaguuccugaagaacccccagugcuacccggccaagaaguggcuguucaucaucaucgucauccugcugggcuacgccgggcucaugcugcugaccaacgugcucaaggccaucggcaucuggggguccugggugaucgcccccgucaagcugaucuucgcgaucaucaagaagcugaugcgcaccgugagcugccucaugggcaagcugauggaccgggggcgccaggugauccacgaggagaucggcgagaaccgggagggcaaccaggacgacguccgcaucgagauggcccgcccccggcgcgugcggcacuggauguacucccccgugauccugacgauccucgccaucgggcuggccgagagcugcgacgagaugguccacgccgacuccaagcuggugagcugccgccagggcuccgggaacaugaaggagugcgugaccaccggccgggcgcuccugccggccgucaaccccgggcaggaggccugccugcacuucaccgcccccggcagccccgacagcaagugccucaagaucaaggugaagcgcaucaaccugaagugcaagaaguccagcuccuacuucgugccggacgcccggagccgcugcacguccguccggcgcugccggugggcgggcgacugccagagcgggugcccgccccacuucaccuccaacagcuucuccgacgacugggccggcaagauggaccgcgccgggcugggcuucagcgggugcuccgacggcugcggcggggccgcgugcggcugcuucaacgccgcccccagcugcaucuucuggcggaaguggguggagaacccccacgggaucaucuggaaggugucccccugcgccgccuggguccccagcgcggugaucgagcucaccaugccguccggcgaggugcgcaccuuccaccccaugagcgggauccccacgcaggucuucaagggcguguccgugaccuaccugggcagcgacauggaggucuccgggcugaccgaccucugcgagaucgaggagcucaagagcaagaagcuggcccuggcccccugcaaccaggccggcauggggguggugggcaaggucggcgagauccagugcagcuccgaggagagcgcccggaccaucaagaaggacgggugcaucuggaacgcggaccuggugggcaucgagcugcgcguggacgacgccgucugcuacuccaagaucacgagcguggaggccguguccaacuacagcgccaucccgaccaccaucgggggccugcgguucgagcgcucccacgacagccaggggaagaucuccggcagcccccucgacaucaccgccauccggggcuccuucagcgucaacuaccgcgggcugcgccugucccucagcgagaucacggcgaccugcaccggcgaggugaccaacguguccgggugcuacagcugcaugaccggcgccaaggucuccaucaagcugcacagcuccaagaacagcacggcccacgugcggugcaagggggacgagaccgccuucagcgugcuggagggcguccacuccuacaccgugagccucuccuucgaccacgcgguggucgacgagcagugccagcugaacugcggcgggcacgagagccaggugacccugaagggcaaccucaucuuccuggacgugcccaaguucgucgacggguccuacaugcagacguaccacagcaccgugcccaccggcgccaacaucccgucccccaccgacuggcugaacgcccucuucgggaacggccugagccgcuggauccugggcgugaucgggguccuccugggcgggcuggcccucuucuucaugaucaugucccuguucaagcugggcacgaagcaggucuuccggagccgcaccaagcucgccuga

SEQ ID NO: 13091 - RNA, 3222 nt, Artificial Sequence
  derived and/or modified CDS sequence (opt1) from SFTSV(44-Lu'an(CHN)-2015)__KX302603.1__GP
augaugaaggugaucugguucagcucccugaucugcuucgugauccagugcagcggcgacuccgggcccaucaucugcgccggcccgauccacagcaacaaguccgccgacaucccccaccuccugggguucagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguguccaacuacagcgccaucccgaccaccaucggcgggcugcgcuucgagcggucccacgacagccagggcaagaucuccggcagcccccucgacaucaccgccauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcuggagggcguccacuccuacaccgugagccucuccuucgaccacgcgguggucgacgagcagugccagcugaacugcgggggccacgagagccaggugacccugaaggggaaccucaucuuccuggacgugcccaaguucgucgacggcuccuacaugcagacguaccacagcaccgugcccaccggggccaacaucccgucccccaccgacuggcugaacgcccucuucggcaacggccugagccgguggauccugggggugaucggcguccuccucgggggccuggcccuguucuucaugaucaugucccuguucaagcugggcacgaagcaggucuuccgcagccggaccaagcucgccuga

SEQ ID NO: 13092 - RNA, 3222 nt, Artificial Sequence
  derived and/or modified CDS sequence (opt1) from SFTSV(52-Lu'an(CHN)-2015)__KX302604.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagcgcuccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcugcgcguggacgacgccgucugcuacuccaagaucacgagcguggaggccguggccaacuacuccgccaucccgaccaccaucggcgggcugcgguucgagcgcagccacgacucccagggcaagaucagcggcagcccccucgacaucaccgcgauccgggggagcuucuccgucaacuaccgcggccugcgccugagccucuccgagaucacggcgaccugcaccggggaggugaccaacgugagcggcugcuacuccugcaugaccggggccaaggucagcaucaagcugcacuccagcaagaacuccacggcccacgugcggugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgcuggauccugggggugaucggcguccuccucgggggccuggcccuguucuucaugaucaugagccuguucaagcugggcacgaagcaggucuuccggucccgcaccaagcucgcguga

SEQ ID NO: 13093 - RNA, 3222 nt, Artificial Sequence
  derived and/or modified CDS sequence (opt1) from SFTSV(HL/Injected)__KF791953.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugagccagcccgagcagcgcaucgggcagugcaccggcugccaccucgagugcaucaacgggggcgugcggcugaucacccugaccagcgagcucaaguccgcgacggucugcgccagccacuucugcuccagcgccaccuccggcaagaaguccaccgagauccaguuccacuccgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugguguucgcgaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucacgauccuggccaucgggcuggccgagggcugcgacgagauggugcacgcggacuccaagcucgucagcugccggcagggguccggcaacaugaaggagugcgugaccaccggccgcgcccugcugccggccgugaaccccgggcaggaggccugccuccacuucaccgcccccggcagccccgacuccaagugccugaagaucaaggucaagcggaucaaccugaagugcaagaaguccagcagcuacuucgugccggacgcgcgcagccggugcacguccgugcgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugcccagcgccgucaucgagcugaccaugccguccggcgaggugcggaccuuccaccccaugagcgggauccccacccagguguucaagggcgucuccgugaccuaccuggggagcgacauggagguguccggccucaccgaccugugcgagaucgaggagcucaagagcaagaagcuggcccuggcccccugcaaccaggccggcaugggggucgugggcaaggugggggagauccagugcuccagcgaggagagcgcgcgcaccaucaagaaggacggcugcaucuggaacgccgaccuggucgggaucgagcugcggguggacgacgccgugugcuacuccaagaucacgagcgucgaggccguggccaacuacuccgcgaucccgaccaccaucggcggccuccgcuucgagcggagccacgacucccaggggaagaucagcggcagcccccuggacaucaccgccauccgcgggagcuucuccgugaacuaccggggccugcgccucagccuguccgagaucacggccacgugcaccggggaggucaccaacgugagcggcugcuacuccugcaugaccggcgccaaggugagcaucaagcugcacuccagcaagaacuccacggcgcacguccgcugcaagggggacgagaccgccuucagcgugcucgagggcgugcacuccuacagcgucagccuguccuucgaccacgccgugguggacgagcagugccagcugaacugcgggggccacgagagccaggucacccuccgggggaaccugaucuuccuggacgugcccaaguucguggacggcuccuacaugcagaccuaccacagcacgguccccaccggcgccaacaucccgucccccaccgacuggcucaacgcccuguucgggaacggccugagccgcuggauccucggggugaucggcguccugcugggcgggcucgcgcuguucuuccugaucaugucccucuucaagcugggcaccaagcagaucuuccggagccgcacgaagcuggccuga

SEQ ID NO: 13094 - RNA, 3222 nt, Artificial Sequence
  derived and/or modified CDS sequence (opt1) from SFTSV(HL/Larvae/G2)__KF791955.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagccggaccuccagcgggcugcugcccuccgaccgcguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgggagcacaagacgaagugggugcaggaguccagcuccaaggacuucgucugcuacaaggagggcaccggccccugcagcgaguccgaggagaagaccugcaagaccagcggguccugccgcggcgacaugcaguucugcaagguggcggggugcgagcacggcgaggaggccagcgaggccaagugccggugcucccuggugcacaagcccggggaggucguggugagcuacggcggcaugcgcguccggccgaagugcuacggguucucccgcaugauggccacgcuggaggugagccagcccgagcagcggaucggccagugcaccgggugccaccucgagugcaucaacggcggggugcgccugaucacccugaccagcgagcucaaguccgcgacggucugcgccagccacuucugcuccagcgccaccuccggcaagaaguccaccgagauccaguuccacuccggcagccugguggggaagaccgccauccacgucaagggcgcccugguggacgggacggaguucaccuucgagggcuccugcauguuccccgacggcugcgacgcgguggacugcaccuucugccgggaguuccucaagaacccccagugcuacccggccaagaaguggcuguucaucaucaucgucauccugcucggguacgccggccugaugcugcucaccaacgugcugaaggccaucgggguguggggcagcugggucaucgcccccgugaagcugguguucgcgaucaucaagaagcucaugcgcgccgucuccugccugauggggaagcugauggaccggggccgccaggugauccacgaggagaucggcgagaaccgggaggggaaccaggacgacgugcgcaucgagauggcccgcccccggcgcguccggcacuggauguacagccccgugauccucacgauccuggccaucggccuggccgaggggugcgacgagauggugcacgcggacuccaagcucgucagcugccgccagggcuccgggaacaugaaggagugcgugaccaccggccgggcccugcugccggccgugaaccccggccaggaggccugccuccacuucaccgcccccgggagccccgacuccaagugccugaagaucaaggucaagcgcaucaaccugaagugcaagaaguccagcagcuacuucgugccggacgcgcggagccgcugcacguccgugcggcgcugccggugggccggcgacugccagagcgggugcccgccccacuucaccuccaacagcuucuccgacgacugggccggcaagauggaccgcgccgggcucggcuucagcggcugcuccgacgggugcggcggggcggccugcggcugcuucaacgccgcccccagcugcaucuucuggcggaagugggucgagaacccccacgggaucaucuggaaggugucccccugcgccgcgugggugcccagcgccgucaucgagcugaccaugccguccggcgaggugcgcaccuuccaccccaugagcggcauccccacccagguguucaagggggucuccgugaccuaccugggcagcgacauggagguguccgggcucaccgaccugugcgagaucgaggagcucaagagcaagaagcuggcccuggcccccugcaaccaggccggcaugggcgucguggggaaggugggcgagauccagugcuccagcgaggagagcgcgcggaccaucaagaaggacgggugcaucuggaacgccgaccuggucggcaucgagcugcgcguggacgacgccgugugcuacuccaagaucacgagcgucgaggccguggccaacuacuccgcgaucccgaccaccaucgggggccuccgguucgagcgcagccacgacucccagggcaagaucagcgggagcccccuggacaucaccgccauccggggcagcuucuccgugaacuaccgcgggcugcgccucagccuguccgagaucacggccacgugcaccggcgaggucaccaacgugagcgggugcuacuccugcaugaccggcgccaaggugagcaucaagcugcacuccagcaagaacuccacggcgcacguccggugcaagggcgacgagaccgccuucagcgugcucgagggggugcacuccuacagcgucagccuguccuucgaccacgccgugguggacgagcagugccagcugaacugcggcgggcacgagagccaggucacccuccgcggcaaccugaucuuccuggacgugcccaaguucguggacggguccuacaugcagaccuaccacagcacgguccccaccggcgccaacaucccgucccccaccgacuggcucaacgcccuguucggcaacgggcugagccgguggauccucggcgugaucgggguccugcugggcggccucgcgcuguucuuccugaucaugucccucuucaagcuggggaccaagcagaucuuccgcagccggacgaagcuggccuga

SEQ ID NO: 13095 - RNA, 3222 nt, Artificial Sequence
  derived and/or modified CDS sequence (opt1) from SFTSV(JS2011-004)__KC505124.1__GP
augaugaaggugaucugguucagcucccugaucugccucgugauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgggggcgagucccugccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggcgaggucguggugagcuacgggggcaugcggguccgcccgaagugcuacggguucucccggaugauggccacgcuggaggugaaccagcccgagcagcgcaucggccagugcaccgggugccaccucgagugcaucaacggcggcgugcggcugaucacccugaccagcgagcucaagagcgcgacggucugcgccucccacuucugcagcuccgccaccagcgggaagaaguccaccgagauccaguuccacagcggcucccugguggggaagaccgccauccacgucaagggcgcccugguggacggcacggaguucaccuucgaggggagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggguguggggcuccugggucaucgcccccgugaagcugguguucgcgaucaugaagaagcucaugcgggccgucagcugccugaugggcaagcugauggaccgcgggcgccaggugauccacgaggagaucggcgagaaccgggaggggaaccaggacgacgugcggaucgagauggcccgcccccgccggguccgccacuggauguacucccccgugauccucacgauccuggccaucggccuggccgaggggugcgacgagauggugcacgcggacagcaagcucgucuccugccggcagggcagcggcaacaugaaggagugcgugaccaccgggcgcgcccugcugccggccgugaaccccggccaggaggccugccuccacuucaccgcccccgggucccccgacagcaagugccugaagaucaaggucaagcggaucaaccugaagugcaagaaguccagcagcuacuucgugccggacgcgcgcucccggugcacgagcgugcgccggugccgcugggccggcgacugccaguccgggugcccgccccacuucaccagcaacuccuucagcgacgacugggccggcaagauggaccgggccggccucggguucuccggcugcagcgacgggugcggcggggcggccugcggcugcuucaacgccgcccccuccugcaucuucuggcgcaagugggucgagaacccccacggcaucaucuggaaggugagccccugcgccgcgugggugcccuccgccgucaucgagcugaccaugccgagcggggaggugcggaccuuccaccccauguccggcauccccacccagguguucaagggggucagcgugaccuaccugggcuccgacauggaggugagcggccucaccgaccugugcgagaucgaggagcugaaguccaagaagcuggcccucgcccccugcaaccaggccgggaugggcgucguggggaaggugggcgagauccagugcagcuccgaggagagcgcgcgcaccaucaagaaggacgggugcaucuggaacgccgaccuggucggcaucgagcugcggguggacgacgccgugugcuacagcaagaucacguccgucgaggccguggccaacuacagcgcgaucccgaccaccaucggcgggcuccgcuucgagcggucccacgacagccagggcaagaucuccgggagcccccuggacaucaccgccauccgcggcuccuucagcgugaacuaccgggggcugcgccucucccugagcgagaucacggccacgugcaccggcgaggucaccaacguguccggcugcuacagcugcaugaccggggccaagguguccaucaagcugcacagcuccaagaacagcacggcgcacguccgcugcaagggcgacgagaccgccuucuccgugcucgagggggugcacagcuacuccgucagccugagcuucgaccacgccgugguggacgagcagugccagcugaacugcggcgggcacgagucccacgucacccucaagggcaaccugaucuuccuggacgugcccaaguucguggacggcagcuacaugcagaccuaccacuccacgguccccaccggggccaacaucccgagccccaccgacuggcucaacgcccuguucggcaacgggcugucccgguggauccucggcgugaucggcguccugcucgggggccuggcgcuguucuuccugaucaugagccucuucaagcuggggaccaagcaggucuuccgcucccggacgaagcuggccuga

SEQ ID NO: 13096 - RNA, 3222 nt, Artificial Sequence
  derived and/or modified CDS sequence (opt1) from SFTSV(JS2011-013-1)__KC505127.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgccugggccagugcacggggugccaccucgagugcaucaacggcggggugcggcugaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggaucuggggcuccugggugaucgcccccgucaagcugauguucgcgaucaucaagaagcucaugcggaccgugagcugccugaugcgcaagcugauggaccgggggcgccaggugauccacgaggagaucggcgagaaccgggagggcaaccaggacgacguccgcaucgagauggcccgcccccggcgcgugcggcacuggauguacucccccgugauccucacgauccuggccaucgggcuggccgagagcugcgacgagaugguccacgccgacuccaagcucgugagcugccgccagggcuccgggaacaugaaggagugcgugaccaccggccgggcgcugcugccggccgucaaccccgggcaggaggccugccuccacuucaccgcccccggcagccccgacagcaagugccugaagaucaaggugaagcgcaucaaccugaagugcaagaaguccagcuccuacuucgugccggacgcccggagccgcugcacguccguccggcgcugccggugggcgggcgacugccagagcgggugcccgccccacuucaccuccaacagcuucuccgacgacugggccggcaagauggaccgcgccgggcucggcuucagcgggugcuccgacggcugcggcggggccgcgugcggcugcuucaacgccgcccccagcugcaucuucuggcggaaguggguggagaacccccacgggaucaucuggaaggugucccccugcgccgccuggguccccagcgcggugaucgagcugaccaugccguccggcgaggugcgcaccuuccaccccaugagcgggauccccacgcaggucuucaagggcguguccgugaccuaccugggcagcgacauggaggucuccgggcucaccgaccugugcgagaucgaggagcucaagagcaagaagcuggcccuggcccccugcaaccaggccggcauggggguggugggcaaggucggcgagauccagugcagcuccgaggagagcgcccggaccaucaagaaggacgggugcaucuggaacgcggaccuggugggcaucgagcugcgcguggacgacgccgucugcuacuccaagaucacgagcguggaggccguggccaacuacuccgccaucccgaccaccaucgggggccuccgguucgagcgcagccacgacucccaggggaagaucagcggcagcccccuggacaucaccgcgauccggggcagcuucuccgucaaguaccgcgggcugcgccucagccuguccgagaucacggcgaccugcaccggcgaggugaccaacgugagcgggugcuacuccugcaugaccggcgccaaggucagcaucaagcugcacuccagcaagaacuccacggcccacgugcggugcaagggggacgagaccgccuucagcgugcucgagggcggccacagcuacaccgucucccugagcuucgaccacgccgugguggacgagcagugccagcugaacugcgggggccacgagucccaggucacccucaaggggaaccugaucuuccuggacgugcccaaguucguggacggcagcuacaugcagacguaccacuccaccguccccaccggggccaacaucccgagccccaccgacuggcucaacgcccuguucggcaacggccugucccgcuggauccucggggugaucggcgugcugcucgggggccuggcccuguucuucaugaucaugagccuguucaagcucggcacgaagcaggucuuccggucccgcaccaagcuggcguga

SEQ ID NO: 13097 - RNA, 3222 nt, Artificial Sequence
  derived and/or modified CDS sequence (opt1) from SFTSV(JS2011-027)__KC505130.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugaacgagcccgagcagcgcaucgggcagugcaccggcugccaccucgagugcaucagcgggggcgugcggcugaucacccugaccagcgagcucaaguccgcgacggucugcgccagccacuucugcuccagcgccaccuccggcaagaaguccaccgagauccaguuccacuccgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugguguucgcgaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucacgauccuggccauggggcuggccgagggcugcgacgagauggugcacgcggacuccaagcucgucagcugccggcagggguccggcaacaugaaggagugcgugaccaccggccgcgcccugcugccggccgugaaccccgggcaggaggccugccuccacuucaccgcccccggcagccccgacuccaagugccugaagaucaaggucaagcggaucaaccugaagugcaagaaguccagcagcuacuucgugccggacgcgcgcagccggugcacguccgugcgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugcccagcgccgucaucgagcugaccaugccguccggcgaggugcggaccuuccaccccaugagcgggauccccacccagguguucaagggcgucuccgugaccuaccuggggagcgacauggagguguccggccucaccgaccugugcgagaucgaggagcucaagagcaagaagcuggcccuggcccccugcaaccaggccggcaugggggucgugggcaaggugggggagauccagugcuccagcgaggagagcgcgcgcaccaucaagaaggacggcugcaucuggaacgccgaccuggucgggaucgagcugcggguggacgacgccgugugcuacuccaagaucacgagcgucgaggccguggccaacuacuccgcgaucccgaccaccaucggcggccuccgcuucgagcggagccacgacucccaggggaagaucagcggcagcccccuggacaucaccgccauccgcgggagcuucuccaucaacuaccggggccugcgccucagccuguccgagaucacggccacgugcaccggggaggugaccaacgucagcggcugcuacuccugcaugaccggcgccaaggugagcaucaagcugcacuccagcaagaacuccacggcgcacgugcgcugcaagggggacgagaccgccuucagcguccucgagggcgugcacuccuacagcgugagccuguccuucgaccacgccgucguggacgagcagugccagcugaacugcgggggccacgagagccaggugacccuccgggggaaccugaucuuccuggacguccccaaguucguggacggcuccuacaugcagaccuaccacagcacggugcccaccggcgccaacaucccgucccccaccgacuggcucaacgcccuguucgggaacggccugagccgcuggauccucggggucaucggcgugcugcugggcgggcucgcgcuguucuuccugaucaugucccucuucaagcugggcaccaagcaggucuuccggagccgcacgaagcuggccuga

SEQ ID NO: 13098 - RNA, 3222 nt, Artificial Sequence
  derived and/or modified CDS sequence (opt1) from SFTSV(JS2011-034)__KC505133.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgcaucggccagugcacggggugccaccuggagugcaucaacggcggggugcggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccuggucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugauguucgcgaucaucaagaagcugaugcggaccgucagcugccucauggggaagcugauggaccgcggccgccaggugauccacgaggagaucggcgagaaccgggaggggaaccaggacgacgugcggaucgagauggcccgcccccgccggguccgccacuggauguacucccccgugauccugacguuccucgccaucggccuggccgagagcugcgacgagauggugcacgccgacuccaagcuggucagcugccggcagggguccggcaacaugaaggagugcgugaccaccgggcgcgcgcuccugccggccgugaaccccggccaggaggccugccugcacuucaccgcccccggcagccccgacagcaagugccucaagaucaaggucaagcggaucaaccugaagugcaagaaguccagcuccuacuucgugccggacgcccgcagccggugcacguccgugcgccggugccgcugggcgggggacugccagagcggcugcccgccccacuucaccuccaacagcuucuccgacgacugggccgggaagauggaccgggccggccugggguucagcugcugcuccgacggcugcggcggggccgcgugcggcugcuucaacgccgcccccagcugcaucuucuggcgcaagugggucgagaacccccacgggaucaucuggaaggugucccccugcgccgccugggugcccagcgcggucaucgagcucaccaugccguccggcgaggugcggaccuuccaccccaugagcgggauccccacccagguguucaagggcgucuccgugaccuaccugggcagcgacauggagguguccgggcugaccgaccucugcgagaucgaggagcucaagagcaagaagcuggcccuggcccccugcaaccaggccggcaugggggucgugggcaaggugggcgagauccagugcagcuccgaggagagcgcccgcaccaucaagaaggacgggugcaucuggaacgcggaccuggucggcaucgagcugcggguggacgacgccgugugcuacuccaagaucacgagcgucgaggccguggccaacuacuccgccaucccgaccaccaucgggggccugcgcuucgagcggagccacgacucccaggggaagaucagcggcagcccccucgacaucaccgcgauccgcggcagcuucuccgugaacuaccgggggcugcgccugagccucuccgagaucacggccacgugcaccggcgaggucaccaacgugagcgggugcuacuccugcaugaccggcgccaaggugagcaucaagcugcacuccagcaagaacuccacggcccacguccgcugcaagggggacgagaccgcguucagcgugcuggagggcgugcacagcuacaccgucucccucagcuucgaccacgccgugguggacgagcagugccagcugaacugcggcgggcacgagucccaggucacccugaagggcaaccucaucuuccuggacgugcccaaguucguggacgggagcuacaugcagacguaccacuccaccguccccaccggcgccaacaucccgagccccaccgacuggcugaacgcccucuucgggaacggccugucccgguggauccugggcgugaucggggugcuccugggcgggcuggcccucuucuucaugaucaugagccugcugaagcucggcacgaagcaggucuaccgcucccggaccaagcuggcguga

SEQ ID NO: 13099 - RNA, 3222 nt, Artificial Sequence
  derived and/or modified CDS sequence (opt1) from SFTSV(JS2011-062)__KC505136.1__GP
augaugaaggugaucugguucagcucccugaucugccucgucauccagugcagcggcgacuccgggcccaucaucugcgccggcccgauccacagcaacaaguccgccgacaucccccaccuccugggguacagcgagaagaucugccagaucgaccgccugauccacguguccagcuggcugcggaaccacucccaguuccagggcuacguggggcagcgcggcggccggagccaggucuccuacuaccccgcggugaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccaaccgggugcucuggaucggcgacguggccugccagccgaugacccccauccccgaggagaccuuccuggagcucaagagcuucucccagagcgaguuccccgacaucugcaagaucgacgggaucgucuucaaccagugcgagggcgagucccugccgcagcccuucgacguggccuggauggacguggggcacagccacaagaucaucaugcgcgagcacaagaccaaguggguccaggaguccagcuccaaggacuucgugugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccugguccacaagcccggggaggugguggucagcuacggcggcaugcgggugcgcccgaagugcuacggguucagccggaugauggcgacccuggaggugaacccgcccgagcagcgcaucggccagugcaccgggugccaccucgagugcaucaacggcgggguccggcugaucacgcugaccuccgagcucaagagcgccaccgugugcgccucccacuucugcagcuccgccaccagcggcaagaaguccacggagauccaguuccacagcggcucccuggucgggaagaccgccauccacgugaagggcgcgcugguggacgggaccgaguucaccuucgagggcagcugcauguuccccgacggcugcgacgccgucgacugcacguucugccgcgaguuccucaagaacccccagugcuaccccgccaagaaguggcuguucaucaucaucgugauccugcucggguacgccggccugaugcugcucaccaacgugcugaaggccaucggggucuggggcuccugggugaucgcgcccgugaagcugauguucgccaucaugaagaagcucaugcggaccgucagcugccugauggggaagcugaucgaccgcggccgccaggugauccacgaggagaucggcgagaacggggagggcaaccgggacgacgugcggaucgagauggcccgcccccgccggguccgccacuggauguacuccccggugauccucaccauccuggccaucgggcuggccgagggcugcgacgagauggugcacgcggacagcaagcucgucuccugccggcaggggagcggcaacaugaaggagugcgugacgaccggccgcgcccugcugcccgccgugaaccccgggcaggaggccugccuccacuucaccgcccccggcuccccggacagcaagugccugaagaucaaggucaagcggaucaaccugaagugcaagaaguccagcagcuacuucgugcccgacgcgcgcucccggugcaccagcgugcgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaagugggucgagaacccccacggcaucaucuggaaggugagccccugcgccgcgugggugccguccgccgucaucgagcugaccaugcccagcggcgaggugcggaccuuccaccccauguccgggauccccacccagguguucaagggcgucagcgugacguaccugggguccgacauggaggugagcggccucaccgaccugugcgagaucgaggagcugaaguccaagaagcuggcccucgccccgugcaaccaggccggcaugggggucgugggcaaggugggggagauccagugcagcagcgaggaguccgcgcgcaccaucaagaaggacggcugcaucuggaacgccgaccuggucgggaucgagcugcggguggacgacgccgugugcuacagcaagaucaccuccgucgaggccguggccaacuacagcgcgauccccacgaccaucggcggccuccgcuucgagcggucccacgacagccaggggaagaucuccggcagcccccuggacaucaccgccauccgcggguccuucagcgugaacuaccggggccugcgccucucccugagcgagaucaccgccacgugcaccggggaggucaccaacguguccggcugcuacagcugcaugaccggcgccaagguguccaucaagcugcacagcuccaagaacagcaccgcgcacguccgcugcaagggggacgagacggccuucuccgugcucgagggcgugcacagcuacaccgucagccuguccuucgaccacgccgugguggacgagcagugccagcugaacugcgggggccacgagagccaggucacccucaaggggaaccugaucuuccuggacgugcccaaguucguggacggcuccuacaugcagaccuaccacagcacggucccgaccggcgccaacauccccucccccaccgacuggcucaacgcccuguucgggaacggccugagccgguggauccucgggcugaucggcgugcugcucggcgggcuggcgcuguucuuccucaucaugucccuguucaagcugggcaccaagcaggucuuccgcagccggacgaagcucgccuga

SEQ ID NO: 13100 - RNA, 3222 nt, Artificial Sequence
  derived and/or modified CDS sequence (opt1) from SFTSV(JS2011-109)__KC505139.1__GP
augaugaaggugaucugguucagcucccugaucugccucgugauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugaaccagcccgagcagcgcaucgggcagugcaccggcugccaccucgagugcaucaacgggggcgugcggcugaucacccugaccagcgagcucaagagcgcgacggucugcgccucccacuucugcagcuccgccaccagcggcaagaaguccaccgagauccaguuccacagcgggucccuggugggcaagaccgccauccacgucaagggggcccugguggacggcacggaguucaccuucgagggcagcugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcguguggggguccugggucaucgcccccgugaagcugguguucgcgaucaucaagaagcucaugcgggccgucagcugccugaugggcaagcugauggaccgcggccgccaggugauccacgaggagaucggggagaaccgggagggcaaccaggacgacgugcggaucgagauggcccgcccccgccggguccgccacuggauguacucccccgugauccucacgauccuggccaucgggcuggccgagggcugcgacgagauggugcacgcggacagcaagcucgucuccugccggcaggggagcggcaacaugaaggagugcgugaccaccggccgcgcccugcugccggccgugaaccccgggcaggaggccugccuccacuucaccgcccccggcucccccgacagcaagugccugaagaucaaggucaagcggaucaaccugaagugcaagaaguccagcagcuacuucgugccggacgcgcgcucccggugcacgagcgugcgccggugccgcugggccggggacugccaguccggcugcccgccccacuucaccagcaacuccuucagcgacgacugggccgggaagauggaccgggccggccucggcuucuccgggugcagcgacggcugcgggggcgcggccugcgggugcuucaacgccgcccccuccugcaucuucuggcgcaagugggucgagaacccccacggcaucaucuggaaggugagccccugcgccgcgugggugcccuccgccgucaucgagcugaccaugccgagcggcgaggugcggaccuuccaccccauguccgggauccccacccagguguucaagggcgucagcgugaccuaccugggguccgacauggaggugagcggccucaccgaccugugcgagaucgaggagcugaaguccaagaagcuggcccucgcccccugcaaccaggccggcaugggggucgugggcaaggugggggagauccagugcagcuccgaggagagcgcgcgcaccaucaagaaggacggcugcaucuggaacgccgaccuggucgggaucgagcugcggguggacgacgccgugugcuacagcaagaucacguccgucgaggccguggccaacuacagcgcgaucccgaccaccaucggcggccuccgcuucgagcggucccacgacagccaggggaagaucuccggcagcccccuggacaucaccgccauccgcggguccuucagcgugaacuaccggggccugcgccucucccugagcgagaucacggccacgugcaccggggaggucaccaacguguccggcugcuacagcugcaugaccggcgccaagguguccaucaagcugcacagcuccaagaacagcacggcgcacguccgcugcaagggggacgagaccgccuucuccgugcucgagggcgugcacagcuacuccgucagccugagcuucgaccacgccgugguggacgagcagugccagcugaacugcgggggccacgagucccacgucacccuccgggggaaccugaucuuccuggacgugcccaaguucguggacggcagcuacaugcagaccuaccacuccacgguccccaccggcgccaacaucccgagccccaccgacuggcucaacgcccuguucgggaacggccugucccgcuggauccucggggugaucggcguccugcugggcgggcucgcgcuguucuuccugaucaugagccucuucaagcugggcaccaagcaggucuuccggucccgcacgaagcuggccuga

SEQ ID NO: 13101 - RNA, 3222 nt, Artificial Sequence
  derived and/or modified CDS sequence (opt1) from SFTSV(JS2011-13-2)__KR230770.1__GP
augaugaaggugaucugguucagcucccugaucugccucgugauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugaaccagcccgagcagcgcaucgggcagugcaccggcugccaccucgagugcaucaacgggggcgugcggcugaucacccugaccagcgagcucaagagcgcgacggucugcgccucccacuucugcagcuccgccaccagcggcaagaaguccaccgagauccaguuccacagcgggucccuggugggcaagaccgccauccacgucaagggggcccugguggacggcacggaguucaccuucgagggcagcugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcguguggggguccugggucaucgcccccgugaagcugguguucgcgaucaucaagaagcucaugcgggccgucagcugccugaugggcaagcugauggaccgcggccgccaggugauccacgaggagaucggggagaaccgggagggcaaccaggacgacgugcggaucgagauggcccgcccccgccggguccgccacuggauguacucccccgugauccucacgauccuggccaucgggcuggccgagggcugcgacgagauggugcacgcggacagcaagcucgucuccugccggcaggggagcggcaacaugaaggagugcgugaccaccggccgcgcccugcugccggccgugaaccccgggcaggaggccugccuccacuucaccgcccccggcucccccgacagcaagugccugaagaucaaggucaagcggaucaaccugaagugcaagaaguccagcagcuacuucgugccggacgcgcgcucccggugcacgagcgugcgccggugccgcugggccggggacugccaguccggcugcccgccccacuucaccagcaacuccuucagcgacgacugggccgggaagauggaccgggccggccucggcuucuccgggugcagcgacggcugcgggggcgcggccugcgggugcuucaacgccgcccccuccugcaucuucuggcgcaagugggucgagaacccccacggcaucaucuggaaggugagccccugcgccgcgugggugcccuccgccgucaucgagcugaccaugccgagcggcgaggugcggaccuuccaccccauguccgggauccccacccagguguucaagggcgucagcgugaccuaccugggguccgacauggaggugagcggccucaccgaccugugcgagaucgaggagcugaaguccaagaagcuggcccucgcccccugcaaccaggccggcaugggggucgugggcaaggugggggagauccagugcagcuccgaggagagcgcgcgcaccaucaagaaggacggcugcaucuggaacgccgaccuggucgggaucgagcugcggguggacgacgccgugugcuacagcaagaucacguccgucgaggccguggccaacuacagcgcgaucccgaccaccaucggcggccuccgcuucgagcggucccacgacagccaggggaagaucuccggcagcccccuggacaucaccgccauccgcggguccuucagcgugaacuaccggggccugcgccucucccugagcgagaucacggccacgugcaccggggaggucaccaacguguccggcugcuacagcugcaugaccggcgccaagguguccaucaagcugcacagcuccaagaacagcacggcgcacguccgcugcaagggggacgagaccgccuucuccgugcucgagggcgugcacagcuacuccgucagccugagcuucgaccacgccgugguggacgagcagugccagcugaacugcgggggccacgagucccacgucacccucaaggggaaccugaucuuccuggacgugcccaaguucguggacggcagcuacaugcagaccuaccacuccacgguccccaccggcgccaacaucccgagccccaccgacuggcucaacgcccuguucgggaacggccugucccgguggauccucggggugaucggcguccugcugggcgggcucgcgcuguucuuccugaucaugagccucuucaagcugggcaccaagcaggucuuccgcucccggacgaagcuggccuga

SEQ ID NO: 13102 - RNA, 3222 nt, Artificial Sequence
  derived and/or modified CDS sequence (opt1) from SFTSV(JS2011-69)__KR230771.1__GP
augaugaaggugaucugguucagcucccuggucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacgucgggcagcgcggcggccggucccaggugagcuacuaccccgcggagaacuccuacagccgcugguccgggcugcucagccccugcgacgccgacuggcugggcaugcugguggucaagaaggccaagggguccgacaugaucgugccgggccccagcuacaaggggaagguguucuucgagcggcccaccuucgacggcuacgucggcugggggugcggcuccggcaagagccgcacggaguccggggagcucugcagcagcgacuccggcaccagcuccgggcugcugcccagcgaccgggugcucuggaucggcgacguggccugccagccgaugacccccauccccgaggagaccuuccuggagcugaaguccuucagccaguccgaguuccccgacaucugcaagaucgacgggaucgucuucaaccagugcgacagcgagucccucccgcagcccuucgacguggccuggauggacgugggccacagccacaagaucaucaugcgcgagcacaagacgaaguggguccaggaguccagcuccaaggacuucgugugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccugguccacaagcccggcgaggugguggucagcuacgggggcaugcgggugcgcccgaagugcuacggcuucagccggaugauggccacgcuggaggugaacccgcccgagcagcgcaucgggcagugcaccggcugccaccucgagugcaucaacgggggcguccggcugaucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugauggcgcccgugaagcugauguucgccaucaucaagaagcucaugcggagcgucuccugccugaugggcaagcugauggaccgcgggcgccaggugauccacgaggagaucggcgagaaccgggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcgugacgaccgggcgcgcccugcugcccgccgugaaccccggccaggaggccugccuccacuucaccgcccccggcagcccggacagcaagugccugaagaucaaggucaagcggaucaaccugaagugcaagaaguccagcuccuacuucgugcccgacgcgcgcagccggugcaccuccgugcgccggugccgcugggccggggacugccagagcggcugccccucccacuucacgagcaacuccuucagcgacgacugggccgggaagauggaccgggccggccucggguucuccggcugcagcgacggcugcgggggcgcggccugcgggugcuucaacgccgccccguccugcaucuucuggcgcaagugggucgagaacccccacggcaucaucuggaaggugagccccugcgccgcgugggugcccuccgccgucaucgagcugaccaugccgagcggggaggugcggaccuuccaccccauguccggcauccccacccagguguucaagggcgucagcgugacguaccugggguccgacauggaggugagcggccucaccgaccugugcgagaucgaggagcucaagagcaagaagcuggcccuggcccccugcaaccaggccgggaugggcgucgugggcaaggugggggagauccagugcuccagcgaggaguccgcgcgcaccaucaagaaggacggcugcaucuggaacgccgaccuggucgggaucgagcugcggguggacgacgccgugugcuacagcaagaucaccuccgucgaggccguggccaacuacagcgcgaucccgacgaccaucggcgggcuccgcuucgagcggucccacgacagccagggcaagaucuccggcagcccccuggacaucaccgccgugcgcggguccuucagcgucaacuaccggggccugcgccucucccugagcgagaucaccgccacgugcaccggggaggugaccaacguguccggcugcuacagcugcaugaccggggccaaggucuccaucaagcugcacagcuccaagaacagcaccgcgcacgugcgcugcaagggcgacgagacggccuucagcgugcucgagggcguccacuccuacaccgugagccuguccuucgaccacgccguggucgacgagcagugccagcugaacugcgggggccacgagagccaggugacccucaaggggaaccugaucuuccuggacgugcccaaguucgucgacggcuccuacaugcagaccuaccacagcuccgugcccacgggggccaacaucccgagccccaccgacuggcucaacgcccuguucggcaacggccugucccgguggauccucggggucaucggcgugcugcugggggugcucgcgcuguucuuccugaucaugagccucuucaagcugggcaccaagcaggucuuccgcucccggaccaagcuggccuga

SEQ ID NO: 13103 - RNA, 3222 nt, Artificial Sequence
  derived and/or modified CDS sequence (opt1) from SFTSV(JS2012-020)__KC505142.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcugaaguccuucucccagagcgaguuccccgacaucugcaagaucgacggcaucguguucaaccagugcgggggcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggcgaggucguggugagcuacgggggcaugcgggucgggccgaagugcuacggcuucucccgcaugauggccacgcuggaggugaaccagcccgagcagcggaucgggcagugcaccggcugccaccucgagugcaucaacggcggggugcgccugaucacccugaccagcgagcucaagagcgcgacggucugcgccucccacuucugcagcuccgccaccagcggcaagaaguccaccgagauccaguuccacagcgggucccuggugggcaagaccgccauccacgucaagggcgcccugguggacgggacggaguucaccuucgagggcagcugcauguuccccgacgggugcgacgcgguggacugcaccuucugccgggaguuccucaagaacccccagugcuacccggccaagaaguggcuguucaucaucaucaucauccugcucggcuacgccgggcugaugcugcucaccaacguccugaaggccaucggcguguggggcuccugggugaucgcccccgucaagcugguguucgcgaucaucaagaagcucaugcgcgccgugagcugccugauggggaagcugauggaccggggccgccaggucauccacgaggagaucggggagaaccgggagggcaaccaggacgacgugcgcaucgagauggcccggccccgccgcgugcggcacuggauguacucccccgucauccucacgauccuggccaucgggcuggccgagggcugcgacgagauggugcacgcggacagcaagcucguguccugccgccagggcagcgggaacaugaaggagugcgucaccaccggccgggcccugcugccggccgugaaccccgggcaggaggccugccuccacuucaccgcccccggcucccccgacagcaagugccugaagaucaaggugaagcgcaucaaccugaagugcaagaaguccagcagcuacuucgucccggacgcgcggucccgcugcacgagcgugcggcgcugccggugggccggggacugccaguccggcugcccgccccacuucaccagcaacuccuucagcgacgacugggccggcaagauggaccgcgccgggcucggcuucuccgggugcagcgacggcugcgggggcgcggccugcggcugcuucaacgccgcccccuccugcaucuucuggcggaaguggguggagaacccccacgggaucaucuggaaggucagccccugcgccgcgugggugcccuccgccgugaucgagcugaccaugccgagcggcgagguccgcaccuuccaccccauguccgggauccccacccagguguucaagggcgugagcgucuccuaccugggcagcgacauggagguguccgggcucacggaccugugcgagaucgaggagcucaagagcaagaagcuggcccuggcccccugcaaccaggccggcauggggguggucggcaaggugggggagauccagugcuccagcgaggagagcgcgcggaccaucaagaaggacggcugcaucuggaacgccgaccuggugggcaucgagcugcgcgucgacgacgccgugugcuacuccaagaucaccagcguggaggccgucgccaacuacuccgcgaucccgacgaccaucgggggccuccgguucgagcgcagccacgacucccaggggaagaucagcggcagcccccuggacaucaccgccauccgggggagcuucuccgugaacuaccgcggccugcggcucagccuguccgagaucaccgccacgugcaccggcgaggugaccaacgucagcgggugcuacuccugcaugaccggcgccaaggugagcaucaagcugcacuccagcaagaacuccaccgcgcacgugcgcugcaagggggacgagacggccuucagcguccucgagggcgugcacuccuacagcgugagccuguccuucgaccacgccgucguggacgagcagugccagcugaacugcgggggccacgagagccacgugacccucaagggcaaccugaucuuccuggacguccccaaguucguggacggguccuacaugcagaccuaccacagcaccgugcccacgggcgccaacaucccgucccccaccgacuggcucaacgcccuguucgggaacggccugagccgcuggauccucggcgucaucggggugcugcugggcgggcucgcgcuguucuuccugaucaugucccucuucaagcugggcaccaagcaggucuuccggagccgcaccaagcuggccuga

SEQ ID NO: 13104 - RNA, 3222 nt, Artificial Sequence
  derived and/or modified CDS sequence (opt1) from SFTSV(JS2012-035)__KC505145.1__GP
augaugaaggugaucugguucagcucccugaucugccucgugauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcugggggugaaccagcccgagcagcgcaucggccagugcaccgggugccaccucgagugcaucaacggcggcgugcggcugaucacccugaccagcgagcucaagagcgcgacggucugcgccucccacuucugcagcuccgccaccagcgggaagaaguccaccgagauccaguuccacagcggcucccugguggggaagaccgccauccacgucaagggcgcccugguggacggcacggaguucaccuucgaggggagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggguguggggcuccugggucaucgcccccgugaagcugguguucgcgaucaucaagaagcucaugcgggccgucagcugccugaugggcaagcugauggaccgcgggcgccaggugauccacgaggagaucggcgagaaccgggaggggaaccaggacgacgugcggaucgagauggcccgcccccgccggguccgccacuggauguacucccccgugauccucacgauccuggccaucggccuggccgaggggugcgacgagauggugcacgcggacagcaagcucgucuccugccggcagggcagcggcaacaugaaggagugcgugaccaccgggcgcgcccugcugccggccgugaaccccggccaggaggccugccuccacuucaccgcccccgggucccccgacagcaagugccugaagaucaaggucaagcggaucaaccugaagugcaagaaguccagcagcuacuucgugccggacgcgcgcucccggugcacgagcgugcgccggugccgcugggccggcgacugccaguccgggugcccgccccacuucaccagcaacuccuucagcgacgacugggccggcaagauggaccgggccggccucggguucuccggcugcagcgacgggugcggcggggcggccugcggcugcuucaacgccgcccccuccugcaucuucuggcgcaagugggucgagaacccccacggcaucaucuggaaggugagccccugcgccgcgugggugcccuccgccgucaucgagcugaccaugccgagcggggaggugcggaccuuccaccccauguccggcauccccacccagguguucaagggggucagcgugaccuaccugggcuccgacauggaggugagcggccucaccgaccugugcgagaucgaggagcugaaguccaagaagcuggcccucgcccccugcaaccaggccgggaugggcgucguggggaaggugggcgagauccagugcagcuccgaggagagcgcgcgcaccaucaagaaggacgggugcaucuggaacgccgaccuggucggcaucgagcugcggguggacgacgccgugugcuacagcaagaucacguccgucgaggccguggccaacuacagcgcgaucccgaccaccaucggcgggcuccgcuucgagcggucccacgacagccagggcaagaucuccgggagcccccuggacaucaccgccauccgcggcuccuucagcgugaacuaccgggggcugcgccucucccugagcgagaucacggccacgugcaccggcgaggucaccaacguguccggcugcuacagcugcaugaccggggccaagguguccaucaagcugcacagcuccaagaacagcacggcgcacguccgcugcaagggcgacgagaccgccuucuccgugcucgagggggugcacagcuacuccgucagccugagcuucgaccacgccgugguggacgagcagugccagcugaacugcggcgggcacgagucccacgucacccuccggggcaaccugaucuuccuggacgugcccaaguucguggacggcagcuacaugcagaccuaccacuccacgguccccaccggggccaacaucccgagccccaccgacuggcucaacgcccuguucggcaacgggcugucccgcuggauccucggcgugaucggcguccugcucgggggccuggcgcuguucuuccugaucaugagccucuucaagcuggggaccaagcaggucuuccggucccgcacgaagcuggccuga

SEQ ID NO: 13105 - RNA, 3222 nt, Artificial Sequence
  derived and/or modified CDS sequence (opt1) from SFTSV(JS2012-79)__KR230772.1__GP
augaugaaggugaucugguucagcucccugaccugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcacggagagcggcgagcugugcagcuccgacagcggcaccuccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagacgaagugggugcaggaguccagcuccaaggacuucgucugcuacaaggagggcaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggauccgcccgaagugcuacggguucagccggaugauggccacgcuggaggucaaccagcccgagcagcgccugggccagugcaccgggugccaccucgagugcaucaacggcggggugcggcugaucacccugaccuccgagcucaagagcgcgacggugugcgccucccacuucugcagcuccgccaccagcggcaagaaguccaccgagauccaguuccacagcggcucccuggucgggaagaccgccauccacgugaagggcgcccuggucgacgggacggaguucaccuucgagggcagcugcauguuccccgacggcugcgacgcgguggacugcaccuucugccgcgaguuccucaagaacccccagugcuacccggccaagaaguggcuguucaucaucaucgugauccugcucggguacgccggccugaugcugcucaccaacguccugaaggccaucgggaucuggggcuccugggugaucgcccccgugaagcugauguucgcgaucaucaagaagcucaugcggacggucagcugccugaugcgcaagcugauggaccgggggcgccaggugauccacgaggagaucggcgagaaccgggagggcaaccaggacgacgugcgcaucgagauggcccgcccccggcgcguccggcacuggauguacucccccgugauccucaccauccuggccaucgggcuggccgagagcugcgacgagauggugcacgccgacuccaagcucgucagcugccgccagggcuccgggaacaugaaggagugcgugaccaccggccgggcgcugcugagcgccgugaacccggggcaggaggccugccuccacuucacggcccccggcagccccgacuccaagugccugaagaucaaggucaagcgcaucaaccugaagugcaagaaguccagcagcuacuucgugcccgacgcccggucccgcugcaccagcgugcggcgcugccggugggcgggcgacugccaguccgggugcccgccccacuucaccagcaacuccuucagcgacgacugggccggcaagauggaccgcgccgggcucggcuucuccgggugcagcgacggcugcggcggggccgcgugcggcugcuucaacgccgcccccuccugcaucuucuggcggaagugggucgagaacccgcacgggaucaucuggaaggugagccccugcgccgccugggugcccuccgcggucaucgagcugaccaugcccagcggcgaggugcgcacguuccacccgauguccgggauccccacccagguguucaagggcgucagcgugaccuaccugggcuccgacauggaggugagcgggcucaccgaccugugcgagaucgaggagcucaagagcaagaagcuggcccuggcccccugcaaccaggccggcaugggggucgugggcaaggugggcgagauccagugcuccagcgaggaguccgcccggacgaucaagaaggacgggugcaucuggaacgcggaccuggucggcaucgagcugcgcguggacgacgccgugugcuacagcaagaucaccuccgucgaggccguggccaacuacagcgccauccccaccaccaucgggggccuccgguucgagcgcucccacgacagccaggggaagaucuccggcagcccgcuggacaucacggcgauccggggcuccuucagcgugaacuaccgcgggcugcgccucucccugagcgagaucaccgcgaccugcaccggcgaggucaccaacguguccgggugcuacagcugcaugacgggcgccaagguguccaucaagcugcacagcuccaagaacagcaccgcccacguccggugcaagggggacgagaccgccuucagcgugcucgagggcggccacuccuacaccgugagccuguccuucgaccacgccgucguggacgagcagugccagcugaacugcgggggccacgagagccaggugacgcucaaggggaaccugaucuuccuggacguccccaaguucguggacggcuccuacaugcagaccuaccacagcaccgugcccaccggggccaacauccccuccccgacggacuggcucaacgcccuguucggcaacggccugagccgcuggauccucggggucaucggcgugcugcucgggggccuggcccuguucuucaugaucaugucccuguucaagcucggcaccaagcaggucuuccggagccgcaccaagcuggcguga

SEQ ID NO: 13106 - RNA, 3222 nt, Artificial Sequence
  derived and/or modified CDS sequence (opt1) from SFTSV(JS2013-44)__KR230773.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggagaccagcgaggccaagugccgcugcucccucgugcacaagcccggggaggucguggugagcuacggcggcaugcggauccgcccgaagugcuacggguucagccggaugauggccacgcuggaggucaaccagcccgagcagcgccugggccagugcaccgggugccaccucgagugcaucaacggcggggugcggcugaucacccugaccuccgagcucaagagcgccacggugugcgcgucccacuucugcagcuccgccaccagcggcaagaaguccaccgagauccaguuccacagcggcucccuggucgggaagaccgccauccacgugaagggcgcccuggucgacgggacggaguucaccuucgagggcagcugcauguuccccgacggcugcgacgccguggacugcaccuucugccgcgaguuccucaagaacccccagugcuacccggcgaagaaguggcuguucaucaucaucgugauccugcucggguacgccggccugaugcugcucaccaacguccugaaggccaucgggaucuggggcuccugggugaucgcccccgugaagcugauguucgccaucaucaagaagcucaugcggacggucagcugccugaugcgcaagcugauggaccgggggcgccaggugauccacgaggagaucggcgagaaccgggagggcaaccaggacgacgugcgcaucgagauggcgcgcccccggcgcguccggcacuggauguacucccccgugauccucaccauccuggccaucgggcuggccgagagcugcgacgagauggugcacgccgacuccaagcucgucagcugccgccagggcuccgggaacaugaaggagugcgugaccaccggccgggcccugcugccggcggugaaccccgggcaggaggccugccuccacuucacggcccccggcagccccgacagcaagugccugaagaucaaggucaagcgcaucaaccugaagugcaagaaguccagcuccuacuucgugccggacgcccggagccgcugcaccuccgugcggcgcugccggugggccggcgacugccagagcgggugcccgccccacuucaccuccaacagcuucuccgacgacugggcgggcaagauggaccgcgccgggcucggcuucagcgggugcuccgacggcugcggcggggccgccugcggcugcuucaacgcggcccccagcugcaucuucuggcggaagugggucgagaacccccacgggaucaucuggaaggugucccccugcgccgccugggugcccagcgccgucaucgagcugaccaugccguccggcgaggugcgcacguuccaccccaugagcgggauccccacccagguguucaagggcgucuccgugaccuaccugggcagcgacauggagguguccgggcucaccgaccugugcgagaucgaggagcucaagagcaagaagcuggcgcuggcccccugcaaccaggccggcaugggggucgugggcaaggugggcgagauccagugcagcuccgaggagagcgcccggacgaucaagaaggacgggugcaucuggaacgccgaccuggucggcaucgagcugcgcguggacgacgcggugugcuacuccaagaucaccagcgucgaggccguggccaacuacuccgccaucccgaccaccaucgggggccuccgguucgagcgcagccacgacucccaggggaagaucagcggcagcccccuggacaucagcgccauccggggcuccuucagcgugaacuaccgcgggcugcgccucucccugagcgagaucacggcgaccugcaccggcgaggucaccaacguguccgggugcuacagcugcaugaccggcgccaagguguccaucaagcugcacagcuccaagaacagcacggcccacguccggugcaagggggacgagaccgccuucagcgugcucgagggcgugcacuccuacaucgucagccuguccuucgaccacgcggugguggacgagcagugccagcugaacugcggcgggcacgagagccaggucacccucaagggcaaccugaucuuccuggacgugcccaaguucguggacggguccuacaugcagaccuaccacagcacgguccccaccggcgccaacaucccgucccccaccgacuggcucaacgcccuguucgggaacggccugagccgcuggauccucggcgugaucggggugcugcugggcgggcucgcccuguucuccaugaucaugagccuguucaagcucggcaccaagcaggucuuccggucccgcacgaagcuggccuga

SEQ ID NO: 13107 - RNA, 3222 nt, Artificial Sequence
  derived and/or modified CDS sequence (opt1) from SFTSV(JS2013-46)__KR230774.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugaacgagcccgagcagcgcaucgggcagugcaccggcugccaccucgagugcaucagcgggggcgugcggcugaucacccugaccagcgagcucaaguccgcgacggucugcgccagccacuucugcuccagcgccaccuccggcaagaaguccaccgagauccaguuccacuccgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugguguucgcgaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucacgauccuggccauggggcuggccgagggcugcgacgagauggugcacgcggacuccaagcucgucagcugccggcagggguccggcaacaugaaggagugcgugaccaccggccgcgcccugcugccggccgugaaccccgggcaggaggccugccuccacuucauggcccccggcagccccgacuccaagugccugaagaucaaggucaagcggaucaaccugaagugcaagaaguccagcagcuacuucgugccggacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugcccagcgccgucaucgagcugaccaugccguccggcgaggugcggaccuuccaccccaugagcgggauccccacccagguguucaagggcgucuccgugacguaccuggggagcgacauggagguguccggccucaccgaccugugcgagaucgaggagcucaagagcaagaagcuggcccuggcccccugcaaccaggccggcaugggggucgugggcaaggugggggagauccagugcuccagcgaggagagcgcgcgcaccaucaagaaggacggcugcaucuggaacgccgaccuggucgggaucgagcugcggguggacgacgccgugugcuacuccaagaucaccagcgucgaggccguggccaacuacuccgcgaucccgacgaccaucggcggccuccgcuucgagcggagccacgacucccaggggaagaucagcggcagcccccuggacaucaccgccauccgcgggagcuucuccaucaacuaccggggccugcgccucagccuguccgagaucagcgcgaccugcacgggggaggugaccaacgucuccggcugcuacagcugcaugaccggcgccaagguguccaucaagcugcacagcuccaagaacagcaccgcccacgugcgcugcaagggggacgagaccgccuucuccguccucgagggcgugcacagcuacagcgugucccugagcuucgaccacgccgucguggacgagcagugccagcugaacugcgggggccacgagucccaggugacgcuccgggggaaccugaucuuccuggacguccccaaguucguggacggcagcuacaugcagaccuaccacuccaccgugcccaccggcgccaacaucccgagccccacggacuggcucaacgcccuguucgggaacggccugucccgcuggauccucggggucaucggcgugcugcugggcgggcucgcgcuguucuuccugaucaugagccucuucaagcugggcaccaagcaggucuuccggucccgcaccaagcuggccuga

SEQ ID NO: 13108 - RNA, 3222 nt, Artificial Sequence
  derived and/or modified CDS sequence (opt1) from SFTSV(JS2013-52)__KR230775.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugauguucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacguuccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaucggcguccuccugggggugcuggcccucuucuuccugaucaugagccuguucaagcucggcacgaagcaggucuuccgcucccggaccaagcuggcguga

SEQ ID NO: 13109 - RNA, 3222 nt, Artificial Sequence
  derived and/or modified CDS sequence (opt1) from SFTSV(JS2013-69)__KR230776.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaucaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggguccgcccgaagugcuacggguucagccggaugauggccacccuggaggugaaccagcccgagcagcgccugggccagugcacggggugccaccucgagugcaucaacggcggggugcggcugaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacgcucgagagcuccugcauguuccccgacggcugcgacgcgguggacugcaccuucugccgcgaguuccugaagaacccccagugcuacccggccaagaaguggcuguucaucaucaucgucauccuccugggcuacgccgggcugaugcuccugaccaacgugcugaaggccaucggcaucugggggagcugggugaucgcccccgucaagcucauguucgcgaucaucaagaagcugaugcggaccguguccugccugaugcgcaagcucauggaccggggccgccaggugauccacgaggagaucggggagaaccgggagggcaaccaggacgacguccgcaucgagauggcccgcccccggcgcgugcggcacuggauguacagccccgugauccugacgauccuggccaucggccucgccgaguccugcgacgagaugguccacgccgacagcaagcugguguccugccgccaggggagcggcaacaugaaggagugcgugaccaccgggcgggcgcugcucccggccgucaaccccggccaggaggccugccugcacuucaccgcccccgggagccccgacuccaagugccugaagaucaaggugaagcgcaucaaccucaagugcaagaaguccagcagcuacuucgugccggacgcccggucccgcugcacgagcguccggcgcugccggugggcgggcgacugccaguccggcugcccgccccacuucaccagcaacuccuucagcgacgacugggccgggaagauggaccgcgccggccugggguucuccggcugcagcgacgggugcggcggcgccgcgugcgggugcuucaacgccgcccccuccugcaucuucuggcggaaguggguggagaacccccacggcaucaucuggaaggugagccccugcgccgccuggguccccuccgcggugaucgagcugaccaugccgagcggggaggugcgcaccuuccaccccauguccggcauccccacgcaggucuucaagggggugagcgugaccuaccucggcuccgacauggaggucagcggccugaccgaccugugcgagaucgaggagcucaagagcaagaagcuggcccuggcccccugcaaccaggccgggaugggcgugguggggaaggucggcgagauccagugcuccagcgaggaguccgcccggaccaucaagaaggacggcugcaucuggaacgcggaccugguggggaucgagcuccgcguggacgacgccgucugcuacagcaagaucacguccguggaggccguggccaacuacagcgccaucccgaccaccaucggcgggcugcgguucgagcgcucccacgacagccagggcaagaucuccgggagcccccuggacaucaccgcgauccggggcuccuucagcgucaacuaccgcggccuccgccugucccugagcgagaucacggcgaccugcaccggggaggugaccaacguguccggcugcuacagcugcaugaccggggccaaggucuccaucaagcuccacagcuccaagaacagcacggcccacgugcggugcaagggcgacgagaccgccuucagcgugcuggaggggguccacuccuacaccgugagccuguccuucgaccacgccguggucgacgagcagugccagcucaacugcggcggccacgagagccaggugacccugaaggggaaccugaucuuccucgacgugcccaaguucgucgacggcuccuacaugcagacguaccacagcuccgugcccaccggggccaacaucccgagccccaccgacuggcugaacgcccuguucggcaacgggcucucccgcuggauccugggcgugaucggcguccugcucggggugcuggcccuguucuuccucaucaugagccuguucaagcugggcaccaagcaggucuuccggucccgcacgaagcucgcguga

SEQ ID NO: 13110 - RNA, 3222 nt, Artificial Sequence
  derived and/or modified CDS sequence (opt1) from SFTSV(JS2013-71)__KR230777.1__GP
augaugaaggugaucugguucagcucccugaucugcuucgugauccagugcggcggggacaccggccccaucaucugcgccgggccgauccacagcaacaaguccgccgacaucccccaccuccugggcuacagcgagaagaucugccagaucgaccgccugauccacguguccagcuggcuccggaaccacucccaguuccagggguacgugggccagcgcggcgggcggagccaggucuccuacuaccccgcggagaacagcuacucccgcuggagcggccugcugucccccugcgacgccgacuggcucgggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcugugcuccagcgacagcgggaccuccagcggccuccugcccuccgaccggguccuguggaucggggacguggccugccagccgaugacccccauccccgaggagaccuuccucgagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccucgugcacaagcccggcgaggucguggugagcuacggcgggaugcggguccgcccgaagugcuacggcuucucccggaugauggccacgcuggaggugaaccagcccgagcagcgcaucgggcagugcaccggcugccaccuggagugcaucaacgggggcgugcggcucaucacccugaccagcgagcucaagagcgcgacggucugcgccucccacuucugcagcuccgccaccagcggcaagaaguccaccgagauccaguuccacagcgggucccucgugggcaagaccgccauccacgucaagggggcccugguggacggcacggaguucaccuucgagggcagcugcauguuccccgacgggugcgacgcgguggacugcaccuucugccgcgaguuccugaagaacccccagugcuacccggccaagaaguggcuguucaucaucaucgucauccugcugggcuacgccgggcucaugcugcugaccaacgugcucaaggccaucggcguguggggguccugggucaucgcccccgugaagcugguguucgcgaucaucaagaagcugaugcgggccgucagcugccucaugggcaagcugauggaccgcggccgccaggugauccacgaggagaucggggagaaccgggagggcaaccaggacgacgugcggaucgagauggcccgcccccgccggguccgccacuggauguacucccccgugauccugacgauccucgccaucgggcuggccgagggcugcgacgagauggugcacgcggacagcaagcuggucuccugccggcaggggagcggcaacaugaaggagugcgugaccaccggccgcgcccuccugccggccgugaaccccgggcaggaggccugccugcacuucaccgcccccggcucccccgacagcaagugccucaagaucaaggucaagcggaucaaccugaagugcaagaaguccagcagcuacuucgugccggacgcgcgcucccggugcacgagcgugcgccggugccgcugggccggggacugccaguccggcugcccgccccacuucaccagcaacuccuucagcgacgacugggccgggaagauggaccgggccggccugggcuucuccgggugcagcgacggcugcgggggcgcggccugcgggugcuucaacgccgcccccuccugcaucuucuggcgcaagugggucgagaacccccacggcaucaucuggaaggugagccccugcgccgcgugggugcccuccgccgucaucgagcucaccaugccgagcggcgaggugcggaccuuccaccccauguccgggauccccacccagguguucaagggcgucagcgugaccuaccugggguccgacauggaggugagcggccugaccgaccucugcgagaucgaggagcugaaguccaagaagcuggcccuggcccccugcaaccaggccggcaugggggucgugggcaaggugggggagauccagugcagcuccgaggagagcgcgcgcaccaucaagaaggacggcugcaucuggaacgccgaccucgucgggaucgagcugcggguggacgacgccgugugcuacagcaagaucacguccgucgaggccguggccaacuacagcgcgaucccgaccaccaucggcggccugcgcuucgagcggucccacgacagccaggggaagaucuccggcagcccccucgacaucaccgccauccgcggguccuucagcgugaacuaccggggccugcgccugucccucagcgagaucacggccacgugcaccggggaggucaccaacguguccggcugcuacagcugcaugaccggcgccaagguguccaucaagcugcacagcuccaagaacagcacggcgcacguccgcugcaagggggacgagaccgccuucuccgugcuggagggcgugcacagcuacuccgucagccucagcuucgaccacgccgugguggacgagcagugccagcugaacugcgggggccacgagucccacgucacccugcgggggaaccucaucuuccuggacgugcccaaguucguggacggcagcuacaugcagaccuaccacuccacgguccccaccggcgccaacaucccgagccccaccgacuggcugaacgcccucuucgggaacggccugucccgcuggauccugggggugaucggcguccuccugggcgggcuggcgcuguucuuccugaucaugagccuguucaagcucggcaccaagcaggucuuccggucccgcacgaagcuggccuga

SEQ ID NO: 13111 - RNA, 3222 nt, Artificial Sequence
  derived and/or modified CDS sequence (opt1) from SFTSV(JS2014-03)__KR230778.1__GP
augaugaaggugaucugguucagcucccugaucuacuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgcaucggccagugcacggggugccaccuggagugcaucaacggcggggugcggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccuggucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugauguucgcgaucaucaagaagcugaugcggaccgucagcugccucauggggaagcugauggaccgcggccgccaggugauccacgaggagaucggcgagaaccgggaggggaaccaggacgacgugcggaucgagauggcccgcccccgccggguccgccacuggauguacucccccgugauccugacguuccucgccaucggccuggccgagagcugcgacgagauggugcacgccgacuccaagcuggucagcugccggcagggguccggcaacaugaaggagugcgugaccaccgggcgcgcgcuccugccggccgugaaccccggccaggaggccugccugcacuucaccgcccccggcagccccgacagcaagugccucaagaucaaggucaagcggaucaaccugaagugcaagaaguccagcuccuacuucgugccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaagugggucgagaacccccacggcaucaucuggaaggugucccccugcgccgccugggugcccagcgcggucaucgagcucaccaugccguccggggaggugcggaccuuccaccccaugagcggcauccccacccagguguucaagggcgucuccgugaccuaccuggggagcgacauggagguguccggccugaccgaccucugcgagaucgaggagcucaagagcaagaagcuggcccuggcccccugcaaccaggccgggaugggcgucgugggccgcgugggggagauccagugcagcuccgaggagagcgcccggaccaucaagaaggacggcugcaucuggaacgcggaccuggucgggaucgagcugcgcguggacgacgccgugugcuacuccaagaucacgagcgucgaggccguggccaacuacuccgccaucccgaccaccaucggcgggcugcgguucgagcgcagccacgacucccagggcaagaucagcggcagcccccucgacaucaccgcgauccgggggagcuucuccgugaacuaccgcggccugcgccugagccucuccgagaucacggccacgugcaccggggaggucaccaacgugagcggcugcuacuccugcaugaccggggccaaggugagcaucaagcugcacuccagcaagaacuccacggcccacguccggugcaagggcgacgagaccgcguucagcgugcuggagggcgugcacagcuacaccgucucccucagcuucgaccacgccgugguggacgagcagugccagcugaacugcgggggccacgagucccaggucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgcuggauccugggggugaucggcgugcuccucgggggccuggcccuguucuucaugaucaugagccuguucaagcugggcacgaagcaggucuuccggucccgcaccaagcucgcguga

SEQ ID NO: 13112 - RNA, 3222 nt, Artificial Sequence
  derived and/or modified CDS sequence (opt1) from SFTSV(JS2014-16)__KR230780.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagguggacgggaucgucuucaaccagugcgacagcgagucccucccgcagcccaucgacguggccuggauggacgugggccacagccacaagaucaucaugcgcgagcacaagacgaaguggguccaggaguccagcuccaaggacuucgugugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccugguccacaagcccggcgaggugguggucagcuacgggggcaugcgggugcgcccgaagugcuacggcuucagccggaugauggccacgcuggaggugaacccgcccgagcagcgcaucgggcagugcaccggcugccaccucgagugcaucaacgggggcguccggcugaucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugauggcgcccgugaagcugauguucgccaucaucaagaagcucaugcggagcgucuccugcaugaugggcaagcugauggaccgcgggcgccaggugauccacgaggagaucggcgagaaccgggagggcaaccaggacgacgugcggaucgagauggcccgcccccgccggguccgccacuggauguacagcccggugauccugaccauccucgccaucgggcuggccgagggcugcgacgagauggugcacgcggacuccaagcugguccucugccggcaggggagcggcaacaugaaggagugcgugacgaccgggcgcgcccugcugcccgccgugaaccccggccaggaggccugccuccacuucaccgcccccggcuccccggacagcaagugccugaagaucaaggucaagcggaucaaccugaagugcaagaaguccuccagcuacuucgugcccgacgcgcgcucccggugcaccagcgugcgccggugccgcugggccggggacugccaguccggcugccccagccacuucacguccaacagcuucuccgacgacugggccgggaagauggaccgggccggccucggguucagcggcugcuccgacggcugcgggggcgcggccugcgggugcuucaacgccgccccgagcugcaucuucuggcgcaagugggucgagaacccccacggcaucaucuggaaggugucccccugcgccgcgugggugcccagcgccgucaucgagcugaccaugccguccggggaggugcggaccuuccaccccaugagcggcauccccacccagguguucaagggcgucuccgugacguaccuggggagcgacauggagguguccggccucaccgaccugugcgagaucgaggagcucaagagcaagaagcuggcccuggcccccugcaaccaggccgggaugggcgucgugggcaaggugggggagauccagugcagcuccgaggagagcgcgcgcaccaucaagaaggacggcugcaucuggaacgccgaccuggucgggaucgagcugcggguggacgacgccgugugcuacuccaagaucaccagcgucgaggccguggccaacuacuccgcgaucccgacgaccaucggcgggcuccgcuucgagcggagccacgacucccagggcaagaucagcggcagcccccuggacaucaccgccauccgcgggagcuucuccgugaacuaccggggccugcgccucagccuguccgagaucaccgccacgugcaccggggaggucaccaacgugagcggcugcuacuccugcaugaccggggccaaggugagcaucaagcugcacuccagcaagaacuccaccgcgcacguccgcugccggggcgacgagacggccuucagcgugcucgagggcgugcacagcuacaccgucucccugagcuucgaccacgccgugguggacgagcagugccagcugaacugcgggggccacgagucccaggucacccucaaggggaaccugaucuuccuggacgugcccaaguucguggacggcagcuacaugcagaccuaccacuccagcguccccacgggggccaacaucccgucccccaccgacuggcucaacgcccuguucggcaacggccugagccgcuggauccucggggugaucggcguccugcugggggugcucgcgcuguucuuccugaucaugucccucuucaagcugggcaccaagcaggucuuccggagccgcaccaagcuggccuga

SEQ ID NO: 13113 - RNA, 3222 nt, Artificial Sequence
  derived and/or modified CDS sequence (opt1) from SFTSV(JS2014-18)__KR230781.1__GP
augaugaaggugaucugguucagcucccugaucugccucgugauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaccacccccauccccgaggagacguuccuggagcucaagagcuucucccagagcgaguuccccgacgugugcaagaucgacggcaucgucuucaaccagugcgagggggagucccugccgcagcccuucgacguggccuggauggacgugggccacagccacaagaucaucaugcgcgagcacaagaccaaguggguccaggaguccagcuccaaggacuucgugugcuacaaggagggcaccgggcccugcagcgaguccgaggagaagaccugcaagacgagcggcuccugccgcggggacaugcaguucugcaagguggcgggcugcgagcacggggaggaggccagcgaggccaagugccggugcucccugguccacaagcccggcgaggugguggucagcuacggcgggaugcgggugcgcccgaagugcuacggcuucucccggaugauggccacccuggaggugaacccgcccgagcagcgcaucgggcagugcaccggcugccaccucgagugcaucaacgggggcguccggcugaucacccugacgagcgagcucaagagcgcgaccgugugcgccucccacuucugcagcuccgccaccagcggcaagaaguccaccgagauccaguuccacagcgggucccuggucggcaagacggccauccacgugaagggggcccugguggacggcaccgaguucaccuucgagggcagcugcauguuccccgacgggugcgacgcggucgacugcaccuucugccgcgaguuccucaagaacccccagugcuaccccgccaagaaguggcuguucaucaucaucgugauccugcucggcuacgccgggcugaugcugcucacgaacgugcugaaggccaucggcgucuggggguccugggugaucgcccccgugaagcuggucuucgcgaucaucaagaagcucaugcgggccgugagcugccugaugggcaagcugauggaccgcggccgccaggugauccacgaggagaucggggagaaccgggagggcaaccaggacgacguccggaucgagauggcccgcccccgccgggugcgccacuggauguacuccccggugauccucaccauccuggccaucgggcuggccgagggcugcgacgagaugguccacgcggacagcaagcucguguccugccggcaggggagcggcaacaugaaggagugcgugaccaccggccgcgcccugcugcccgccgucaaccccgggcaggaggccugccuccacuucacggcccccggcuccccggacagcaagugccugaagaucaaggugaagcggaucaaccugaagugcaagaaguccagcagcuacuucgugcccgacgcgcgcucccggugcaccagcguccgccggugccgcugggccggggacugccaguccggcugcccgccccacuucaccagcaacuccuucagcgacgacugggccgggaagauggaccgggccggccucggcuucuccgggugcagcgacggcugcgggggcgcggccugcgggugcuucaacgccgcccccuccugcaucuucuggcgcaaguggguggagaacccccacggcaucaucuggaaggugagccccugcgccgcgugggucccguccgccgugaucgagcugaccaugcccagcggcgaggugcggacguuccaccccauguccgggauccccacccaggucuucaagggcgugagcgugaccuaccugggguccgacauggaggucagcggccucaccgaccugugcgagaucgaggagcugaaguccaagaagcuggcccucgccccgugcaaccaggccggcauggggguggugggcaaggucggggagauccagugcagcuccgaggagagcgcgcgcacgaucaagaaggacggcugcaucuggaacgccgaccugguggggaucgagcugcggguggacgacgccgucugcuacagcaagaucaccuccguggaggccguggccaacuacagcgcgauccccaccaccaucggcggccuccgcuucgagcggucccacgacagccaggggaagaucuccggcagcccccuggacaucacggccauccgcggguccuucagcgucaacuaccggggccugcgccucucccugagcgagaucaccgcgaccugcaccggggaggugaccaacguguccggcugcuacagcugcaugacgggcgccaaggucuccaucaagcugcacagcuccaagaacagcaccgcccacgugcgcugcaagggggacgagaccgccuucuccgugcucgagggcguccacagcuacuccgugagccugagcuucgaccacgccguggucgacgagcagugccagcugaacugcgggggccacgagucccaggugacccuccgggggaaccugaucuuccuggacgugcccaaguucgucgacggcagcuacaugcagacguaccacuccaccgugccgaccggcgccaacauccccagccccaccgacuggcucaacgcccuguucgggaacggccugucccgcuggauccucggggucaucggcgugcugcugggcgggcucgcgcuguucuuccugaucaugagccucuucaagcugggcacgaagcaggucuuccggucccgcaccaagcuggccuga

SEQ ID NO: 13114 - RNA, 3222 nt, Artificial Sequence
  derived and/or modified CDS sequence (opt1) from SFTSV(JS2014-31)__KR230782.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgccugggccagugcacggggugccaccucgagugcaucaacggcggggugcggcugaucacccugaccuccgagcucaagagcgcgaccgugugcgccucccacuucugcagcuccgccacgagcggcaagaaguccaccgagauccaguuccacagcggcucccuggucgggaagaccgccauccacgugaagggcgcccuggucgacgggaccgaguucacguucgagggcagcugcauguuccccgacggcugcgacgcgguggacugcaccuucugccgcgaguuccucaagaacccccagugcuacccggccaagaaguggcuguucaucaucaucgugauccugcucggguacgccggccugaugcugcucaccaacguccugaaggccaucgggaucuggggcuccugggugaucgcccccgugaagcugauguucgcgaucaucaagaagcucaugcggaccgucagcugccugaugcgcaagcugauggaccgggggcgccaggugauccacgaggagaucggcgagaaccgggagggcaaccaggacgacgugcgcaucgagauggcccgcccccggcgcguccggcacuggauguacucccccgugauccucacgauccuggccaucgggcuggccgagagcugcgacgagauggugcacgccgacuccaagcucgucagcugccgccagggcuccgggaacaugaaggagugcgugaccaccggccgggcgcugcugccggccgugaaccccgggcaggaggccugccuccacuucaccgcccccggcagccccgacagcaagugccugaagaucaaggucaagcgcaucaaccugaagugcaagaaguccagcuccuacuucgugccggacgcccggagccgcugcacguccgugcggcgcugccggugggcgggcgacugccagagcgggugcccgccccacuucaccuccaacagcuucuccgacgacugggccggcaagauggaccgcgccgggcucggcuucagcgggugcuccgacggcugcggcggggccgcgugcggcugcuucaacgccgcccccagcugcaucuucuggcggaagugggucgagaacccccacgggaucaucuggaaggugucccccugcgccgccugggugcccagcgcggucaucgagcugaccaugccguccggcgaggugcgcaccuuccaccccaugagcgggauccccacccagguguucaagggcgucuccgugaccuaccugggcagcgacauggagguguccgggcucaccgaccugugcgagaucgaggagcucaagagcaagaagcuggcccuggcccccugcaaccaggccggcaugggggucgugggcaaggugggcgagauccagugcagcuccgaggagagcgcccggaccaucaagaaggacgggugcaucuggaacgcggaccuggucggcaucgagcugcgcguggacgacgccgugugcuacuccaagaucacgagcgucgaggccguggccaacuacuccgccaucccgaccaccaucgggggccuccgguucgagcgcagccacgacucccaggggaagaucagcggcagcccccuggacaucaccgcgauccggggcagcuucuccgugaacuaccgcgggcugcgccucagccuguccgagaucacggccacgugcaccggcgaggucaccaacgugagcgggugcuacuccugcaugaccggcgccaaggugagcaucaagcugcacuccagcaagaacuccacggcccacguccggugcaagggggacgagaccgcguucagcgugcucgagggcgugcacagcuacaccgucucccugagcuucgaccacgccgugguggacgagcagugccagcugaacugcggcgggcacgagucccaggucacccucaagggcaaccugaucuuccuggacgugcccaaguucguggacgggagcuacaugcagacguaccacuccaccguccccaccggcgccaacaucccgagccccaccgacuggcucaacgcccuguucgggaacggccugucccgcuggauccucggcgugaucggggugcugcugggcguccucgcccuguucuuccugaucaugagccucuucaagcuggggacgaagcaggucuuccggucccgcaccaagcuggcguga

SEQ ID NO: 13115 - RNA, 3222 nt, Artificial Sequence
  derived and/or modified CDS sequence (opt1) from SFTSV(JS2014-33)__KR230783.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcaacugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcagcugggugaucgcccccgucaagcugaucuucgcgaucaucaagaagcugaugcgggccguggggugccucaugggcaagcugauggaccgcggccgccaggugauccacgaggagaucggggagaaccgggagggcaaccaggacgacguccggaucgagauggcccgcccccgccgggugcgccacuggauguacucccccgugauccugaccauccucgccaucgggcuggccgagagcugcgacgagaugguccacgcggacuccaagcuggugagcugccggcagggcgggggcaacaugaaggagugcgugacgaccggccgcgcccuccugccggccgucaaccccgggcaggaggccugccugcacuucaccgcccccggcucccccgacagcaagugccucaagaucaaggugaagcggaucaaccugaagugcaagaaguccagcagcuacuucgugccggacgcgcgcucccggugcaccagcguccgccggugccgcugggccggggacugccaguccggcugcccgccccacuucacgagcaacuccuucagcgacgacugggccgggaagauggaccgggccggccugggcuucuccgggugcagcgacggcugcgggggcgcggccugcgggugcuucaacgccgcccccuccugcaucuucuggcgcaaguggguggagaacccccacggcaucaucuggaaggugagccccugcgccgcguggguccccuccgccgugaucgagcucaccaugccgagcggcgaggugcggaccuuccaccccauguccgggauccccacccaggucuucaagggcgugagcgugacguaccugggguccgacauggaggucagcggccugaccgaccucugcgagaucgaggagcugaaguccaagaagcuggcccuggcccccugcaaccaggccggcauggggguggugggcaaggucggggagauccagugcagcuccgaggagagcgcgcgcaccaucaagaaggacggcugcaucuggaacgccgaccucguggggaucgagcugcggguggacgacgccgucugcuacagcaagaucaccuccguggaggccguggccaacuacagcgcgaucccgacgaccaucggcggccugcgcuucgagcggucccacgacagccaggggaagaucuccggcagcccccucgacaucaccgccauccgcggguccuucagcgucaacuaccggggccugcgccugucccucagcgagaucaccgccacgugcaccggggaggugaccaacguguccggcugcuacagcugcaugaccggcgccaaggucuccaucaagcugcacagcuccaagaacagcaccgcgcacgugcgcugcaagggggacgagacggccuucuccgugcuggagggcguccacagcuacaccgugucccucagcuucgaccacgccguggucgacgagcagugccagcugaacugcgggggccacgagagccaggugacccugaaggggaaccucaucuuccuggacgugcccaaguucgucgacggcuccuacaugcagaccuaccacagcgccgugcccacgggcgccaacaucccgucccccaccgacuggcugaacgcgcuguucgggaacggccugagccgguggauccugggggugaucggcguccuccugggcgggcuggcccucuucuucaugaucaugucccuguucaagcugggcaccaagcaggccuuccgcagccggaccaagcucgccuga

SEQ ID NO: 13116 - RNA, 3222 nt, Artificial Sequence
  derived and/or modified CDS sequence (opt1) from SFTSV(JS2014-39)__KR230784.1__GP
augaugaaggugaucugguucagcucccugaccugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcacggagagcggcgagcugugcagcuccgacagcggcaccuccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagacgaagugggugcaggaguccagcuccaaggacuucgucugcuacaaggagggcaccggccccugcagcgaguccgaggagaagaccugcaagaccagcggguccugccggggcgacaugcaguucugcaagguggcggggugcgagcacggcgaggagacgagcgaggccaagugccgcugcucccucgugcacaagcccggggaggucguggugagcuacggcggcaugcggauccgcccgaagugcuacggguucagccggaugauggccacccuggaggucaaccagcccgagcagcgccugggccagugcaccgggugccaccucgagugcaucaacggcggggugcggcugaucacccugacguccgagcucaagagcgccaccgugugcgcgucccacuucugcagcuccgccaccagcggcaagaaguccaccgagauccaguuccacagcggcucccuggucgggaagacggccauccacgugaagggcgcccuggucgacgggaccgaguucaccuucgagggcagcugcauguuccccgacggcugcgacgccguggacugcaccuucugccgcgaguuccucaagaacccccagugcuacccggcgaagaaguggcuguucaucaucaucgugauccugcucggguacgccggccugaugcugcucacgaacguccugaaggccaucgggaucuggggcuccugggugaucgcccccgugaagcugauguucgccaucaucaagaagcucaugcggaccgucagcugccugaugcgcaagcugauggaccgggggcgccaggugauccacgaggagaucggcgagaaccgggagggcaaccaggacgacgugcgcaucgagauggcgcgcccccggcgcguccggcacuggauguacucccccgugauccucaccauccuggccaucgggcuggccgagagcugcgacgagauggugcacgccgacuccaagcucgucagcugccgccagggcuccgggaacaugaaggagugcgugaccacgggccgggcccugcugccggcggugaaccccgggcaggaggccugccuccacuucaccgcccccggcagccccgacagcaagugccugaagaucaaggucaagcgcaucaaccugaagugcaagaaguccagcuccuacuucgugccggacgcccggagccgcugcaccuccgugcggcgcugccggugggccggcgacugccagagcgggugcccgccccacuucaccuccaacagcuucuccgacgacugggcgggcaagauggaccgcgccgggcucggcuucagcgggugcuccgacggcugcggcggggccgccugcggcugcuucaacgcggcccccagcugcaucuucuggcggaagugggucgagaacccccacgggaucaucuggaaggugucccccugcgccgccugggugcccagcgccgucaucgagcugacgaugccguccggcgaggugcgcaccuuccaccccaugagcgggauccccacccagguguucaagggcgucuccgugaccuaccugggcagcgacauggagguguccgggcucacggaccugugcgagaucgaggagcucaagagcaagaagcuggcgcuggcccccugcaaccaggccggcaugggggucgugggcaaggugggcgagauccagugcagcuccgaggagagcgcccggaccaucaagaaggacgggugcaucuggaacgccgaccuggucggcaucgagcugcgcguggacgacgcggugugcuacuccaagaucaccagcgucgaggccguggccaacuacuccgccaucccgaccacgaucgggggccuccgguucgagcgcagccacgacucccaggggaagaucagcggcagcccccuggacaucagcgccauccggggcuccuucagcgugaacuaccgcgggcugcgccucucccugagcgagaucaccgcgaccugcaccggcgaggucaccaacguguccgggugcuacagcugcaugacgggcgccaagguguccaucaagcugcacagcuccaagaacagcaccgcccacguccggugcaagggggacgagaccgccuucagcgugcucgagggcgugcacuccuacaucgucagccuguccuucgaccacgcggugguggacgagcagugccagcugaacugcggcgggcacgagagccaggucacccucaagggcaaccugaucuuccuggacgugcccaaguucguggacggguccuacaugcagacguaccacagcaccguccccaccggcgccaacaucccgucccccaccgacuggcucaacgcccuguucgggaacggccugagccgcuggauccucggcgugaucggggugcugcugggcgggcucgcccuguucuccaugaucaugagccuguucaagcucggcacgaagcaggucuuccggucccgcaccaagcuggccuga

SEQ ID NO: 13117 - RNA, 3222 nt, Artificial Sequence
  derived and/or modified CDS sequence (opt1) from SFTSV(JS2014-H.longicornis-02)__KR230786.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccguggaggccuuccucgagcucaagagcuucucccagagcgaguuccccgacaucugcaagaucgacgggaucgucuucaaccagugcgagggcgagucccugccgcagcccuucgacguggcguggauggacguggggcacagccacaagaucaucaugcgcgagcacaagaccaaguggguccaggaguccagcuccaaggacuucgugugcuacaaggagggcaccggccccugccccgagagcgaggagaagacgugcaagaccuccgggagcugccggggcgacaugcaguucugcaagguggccgggugcgagcacggcgaggaggccuccgaggccaagugccgcugcagccugguccacaagccgggggaggugguggucuccuacggcggcaugcggauccgccccaagugcuacggguucagccggaugauggcgacccuggaggugaaccagcccgagcagcgccugggccagugcaccgggugccaccucgagugcaucaacggcggggugcggcugaucacgcugaccagcgagcucaaguccgccaccgucugcgccagccacuucugcuccagcgccaccuccggcaagaaguccacggagauccaguuccacagcggcagccugguggggaagaccgccauccacgucaagggcgcgcugguggacgggaccgaguucaccuucgagggcuccugcauguuccccgacggcugcgacgccguggacugcacguucugccgcgaguuccucaagaacccgcagugcuaccccgccaagaaguggcuguucaucaucaucgucauccugcucggguacgccggccugaugcugcucaccaacgugcugaaggccaucgggaucuggggcagcugggugaucgcgcccgucaagcugauguucgccaucaucaagaagcucaugcggaccguguccugccugaugcgcaagcugauggaccgggggcgccaggugauccacgaggagaucggcgagaaccgggagggcaaccaggacgacguccgcaucgagauggcccgcccccggcgcgugcggcacuggauguacagcccggugauccucaccauccuggccaucgggcuggccgaguccugcgacgagaugguccacgcggacagcaagcucguguccugccgccagggcagcgggaacaugaaggagugcgugacgaccggccgggcccugcugcccgccgucaaccccgggcaggaggccugccuccacuucaccgcccccggcuccccggacagcaagugccugaagaucaaggugaagcgcaucaaccugaagugcaagaaguccagcagcuacuucgugcccgacgcgcggucccgcugcaccagcguccggcgcugccggugggccggcgacugccaguccgggugcccgccccacuucacgagcaacuccuucagcgacgacugggccggcaagauggaccgcgccgggcucggcuucuccgggugcagcgacggcugcggcggggcggccugcggcugcuucaacgccgcccccuccugcaucuucuggcggaaguggguggagaacccccacgggaucaucuggaaggugagccccugcgccgcgugggucccguccgccgugaucgagcugaccaugcccagcggcgaggugcgcaccuuccaccccauguccgggauccccacccaggucuucaagggcgugagcgugacguaccugggcuccgacauggaggucagcgggcucaccgaccugugcgagaucgaggagcugaaguccaagaagcuggcccucgccccgugcaaccaggccggcauggggguggugggcaaggucggcgagauccagugcagcagcgaggaguccgcgcggaccaucaagaaggacgggugcaucuggaacgccgaccuggugggcaucgagcugcgcguggacgacgccgucugcuacagcaagaucaccuccguggaggccguggccaacuacagcgcgauccccacgaccaucgggggccuccgguucgagcgcucccacgacagccaggggaagaucuccggcagcccccuggacaucaccgccauccggggcuccuucagcgucaacuaccgcgggcugcgccucucccugagcgagaucaccgccacgugcaccggcgaggugaccaacguguccgggugcuacagcugcaugaccggcgccaaggucuccaucaagcugcacagcuccaagaacagcaccgcgcacgugcggugcaagggggacgagacggccuucuccgugcucgagggcguccacagcuacaccgugagccuguccuucgaccacgccguggucgacgagcagugccagcugaacugcggcgggcacgagagccaggugacccucaagggcaaccugaucuuccuggacgugcccaaguucgucgacggguccuacaugcagaccuaccacagcacggugccgaccggcgccaacauccccucccccaccgacuggcucaacgcccuguucgggaacggccugagccgcuggauccucggcgugaucgggguccugcugggcgggcucgcgcuguucuucaugaucaugucccuguucaagcucggcaccaagcaggucuuccggagccgcacgaagcuggccuga

SEQ ID NO: 13118 - RNA, 3222 nt, Artificial Sequence
  derived and/or modified CDS sequence (opt1) from SFTSV(JS2014-H.longicornis-03)__KR230787.1__GP
augaugaaggugaucugguucagcucccugaccugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcacggagagcggcgagcugugcagcuccgacagcggcaccuccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagacgaagugggugcaggaguccagcuccaaggacuucgucugcuacaaggagggcaccggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacgcuggaggucaaccagcccgagcagcgcaucggccagugcaccgggugccaccuggagugcaucaacggcggggugcggcucaucacccugaccuccgagcucaagagcgcgacggugugcgccucccacuucugcagcuccgccaccagcggcaagaaguccaccgagauccaguuccacagcggcucccucgucgggaagaccgccauccacgugaagggcgcccuggucgacgggacggaguucaccuucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugauguucgcgaucaucaagaagcugaugcggacggucagcugccucauggggaagcugauggaccgcggccgccaggugauccacgaggagaucggcgagaaccgggaggggaaccaggacgacgugcggaucgagauggcccgcccccgccggguccgccacuggauguacucccccgugauccugaccuuccucgccaucggccuggccgagagcugcgacgagauggugcacgccgacuccaagcuggucagcugccggcagggguccggcaacaugaaggagugcgugaccaccgggcgcgcgcuccugccggccgugaaccccggccaggaggccugccugcacuucacggcccccggcagccccgacagcaagugccucaagaucaaggucaagcggaucaaccugaagugcaagaaguccagcuccuacuucgugccggacgcccgcagccggugcaccuccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaagugggucgagaacccccacggcaucaucuggaaggugucccccugcgccgccugggugcccagcgcggucaucgagcucaccaugccguccggggaggugcggacguuccaccccaugagcggcauccccacccagguguucaagggcgucuccgugaccuaccuggggagcgacauggagguguccggccugaccgaccucugcgagaucgaggagcucaagagcaagaagcuggcccuggcccccugcaaccaggccgggaugggcgucgugggcaaggugggggagauccagugcagcuccgaggagagcgcccgcacgaucaagaaggacggcugcaucuggaacgcggaccuggucgggaucgagcugcggguggacgacgccgugugcuacuccaagaucaccagcgucgaggccguggccaacuacuccgccaucccgaccaccaucggcgggcugcgcuucgagcggagccacgacucccagggcaagaucagcggcagcccccucgacaucacggcgauccgcgggagcuucuccgugaacuaccggggccugcgccugagccucuccgagaucaccgcgaccugcaccggggaggucaccaacgugagcggcugcuacuccugcaugacgggggccaaggugagcaucaagcugcacuccagcaagaacuccaccgcccacguccgcugcaagggcgacgagaccgccuucagcgugcuggagggcgugcacagcuacaccgucucccucagcuucgaccacgccgugguggacgagcagugccagcugaacugcgggggccacgagucccaggucacgcugaaggggaaccucaucuuccuggacgugcccaaguucguggacggcagcuacaugcagaccuaccacuccaccguccccaccggggccaacaucccgagccccacggacuggcugaacgcccucuucggcaacggccugucccgguggauccugggggugaucggcgugcuccucgggggccuggcccuguucuucaugaucaugagccuguucaagcugggcaccaagcaggucuuccgcucccggaccaagcucgcguga

SEQ ID NO: 13119 - RNA, 3222 nt, Artificial Sequence
  derived and/or modified CDS sequence (opt1) from SFTSV(JS2014-Hedgehog-02)__KR230789.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgcaucggccagugcacggggugccaccuggagugcaucaacggcggggugcggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccuggucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugauguucgcgaucaucaagaagcugaugcggaccgucagcugccucauggggaagcugauggaccgcggccgccaggugauccacgaggagaucggcgagaaccgggaggggaaccaggacgacgugcggaucgagauggcccgcccccgccggguccgccacuggauguacucccccgugauccugacgauccucgccaucggccuggccgagagcugcgacgagauggugcacgccgacuccaagcuggucagcugccggcagggguccggcaacaugaaggagugcgugaccaccgggcgcgcgcuccugccggccgugaaccccggccaggaggccugccugcacuucaccgcccccggcagccccgacagcaagugccucaagaucaaggucaagcggaucaaccugaagugcaagaaguccagcuccuacuucgugccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaagugggucgagaacccccacggcaucaucuggaaggugucccccugcgccgccugggugcccagcgcggucaucgagcucaccaugccguccggggaggugcggaccuuccaccccaugagcggcauccccacccagguguucaagggcgucuccgugaccuaccuggggagcgacauggagguguccggccugaccgaccucugcgagaucgaggagcucaagagcaagaagcuggcccuggcccccugcaaccaggccgggaugggcgucgugggcaaggugggggagauccagugcagcuccgaggagagcgcccgcaccaucaagaaggacggcugcaucuggaacgcggaccuggucgggaucgagcugcggguggacgacgccgugugcuacuccaagaucacgagcgucgaggccguggccaacuacuccgccaucccgaccaccaucggcgggcugcgcuucgagcggagccacgacucccagggcaagaucagcggcagcccccucgacaucaccgcgauccgcgggagcuucuccgugaacuaccggggccugcgccugagccucuccgagaucacggccacgugcaccggggaggucaccaacgugagcggcugcuacuccugcaugaccggggccaaggugagcaucaagcugcacuccagcaagaacuccacggcccacguccgcugcaagggcgacgagaccgcguucagcgugcuggagggcgugcacagcuacaccgucucccucagcuucgaccacgccgugguggacgagcagugccagcugaacugcgggggccacgagucccaggucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgguggauccugggggugaucggcgugcuccucgggggccuggcccuguucuucaugaucaugagccuguucaagcugggcacgaagcaggucuuccgcucccggaccaagcucgcguga

SEQ ID NO: 13120 - RNA, 3222 nt, Artificial Sequence
  derived and/or modified CDS sequence (opt1) from SFTSV(KACNH)__KU507558.1__GP
augaugaaggugaucugguucagcucccugaucugccucgucauccagugcagcggcgacuccgggcccaucaucugcgccggcccgauccacagcaacaaguccgccagcaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcaccgagagcggggagcucugcuccagcgacuccggcacgagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagggcgagagccucccgcagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaaggcgugcaagaccuccgggagcugccggggcgacaugcaguucugcaagguggccgggugcgagcacggcgaggaggccuccgacgccaagugccgcugcagccuggugcacaagcccggggaggucguggugagcuacggcggcaugcggguccgcccgaagugcuacggguucucccggaugauggcgacccuggaggugaacccgcccgagcagcgcaucggccagugcaccgggugccaccucgagugcaucaacggcggggugcggcugaucacgcugaccagcgagcucaaguccgccaccgucugcgccagccacuucugcuccagcgccaccuccggcaagaaguccacggagauccaguuccacuccggcagccugguggggaagaccgccauccacgucaagggcgcgcugguggacgggaccgaguucaccuucgagggcuccugcauguuccccgacggcugcgacgccguggacugcacguucugccgcgaguuccucaagaacccccagugcuaccccgccaagaaguggcuguucauccugaucgucauccuccugggguacgccggccugaugcucaucaccaacgugcugaaggccaucgggguguggggcagcugggucaucgcgcccgugaagcugauguucgccaucaucaagaagcucaugcggaccguguccugccugauggggaagcugauggaccgcggccggcaggucauccacgaggagaucggcgagaacggggagggcaaccaggacgacgugcgcaucgagauggcccggccccgccgcgugcggcacuggauguacagcccggucauccucaccauccuggccaucgggcuggccgagggcugcgacgagauggugcacgcggacuccaagcucgugagcugccgccagggguccggcaacaugaaggagugcgucacgaccggccgggcccugcugcccgccgugaaccccgggcaggaggccugccuccacuucaccgcccccggcagcccggacagcaagugccugaagaucaaggugaagcgcaucaaccugaagugcaagaaguccagcuccuacuucguccccgacgcgcggagccgcugcaccuccgugcggcgcugccggugggccggggacugccagagcggcugcccgccccacuucacguccaacagcuucuccgacgacugggccgggaagauggaccgcgccggccucggcuucagcgggugcuccgacggcugcgggggcgcggccugcgggugcuucaacgccgcccccagcugcaucuucuggcggaaguggguggagaacccccacggcaucaucuggaaggucucccccugcgccgcgugggugccgagcgccgugaucgagcugaccaugcccuccggcgagguccgcaccuuccaccccaugagcgggauccccacccagguguucaagggcguguccgucacguaccuggggagcgacauggagguguccggccucaccgaccugugcgagaucgaggagcucaagagcaagaagcuggcccuggccccgugcaaccaggccggcauggggguggucggcaaggugggggagauccagugcagcuccgaggagagcgcgcggaccaucaagaaggacggcugcaucuggaacgccgaccugguggggaucgagcugcgcgucgacgacgccgugugcuacuccaagaucaccagcguggaggccgucgccaacuacuccgcgauccccacgaccaucggcggccuccgguucgagcgcagccacgacucccaggggaagaucagcggcagcccccuggacaucaccgccauccgggggagcuucuccgugaacuaccgcggccugcggcucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacagcuacaccgugucccugagcuucgaccacgccgucguggacgagcagugccagcugaacugcgggggccacgagucccaggugacccucaaggggaaccugaucuuccuggacguccccaaguucguggacggcagcuacaugcagaccuaccacuccacggugccgaccggcgccaacauccccagccccaccgacuggcucaacgcccuguucgggaacggccugucccgcuggauccucggggucaucggcgugcugcugggcgggcucgcgcuguucuuccugaucaugagccucuucaagcugggcaccaagcaggucuuccggucccgcacgaagcuggccuga

SEQ ID NO: 13121 - RNA, 3222 nt, Artificial Sequence
  derived and/or modified CDS sequence (opt1) from SFTSV(KACNH2)__KU507559.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccucauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcaaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagcggaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacgcuggaggugaacccgcccgagcagcggaucgggcagugcaccggcugccacaucgagugcaucaacgggggcgugcgccucaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgggaguuccugaagaacccccagugcuaccccgccaagaaguggcuguucaucaucaucgucauccugcugggcuacgccgggcucaugcugcugaccaacgugcucaaggccaucggcguguggggguccugggucaucgcgcccgugaagcugauguucgccaucaucaagaagcugaugcgcagcguguccugccucaugggcaagcugauggaccgggggcgccaggucauccacgaggagaucggcgagaaccgggagggcaaccaggacgacgugcgcaucgagauggcccgcccccggcgcgugcggcacuggauguacagcccggucauccugaccauccucgccaucgggcuggccgagggcugcgacgagauggugcacgcggacuccaagcuggugagcugccgccagggcggcgggaacaugaaggagugcgucacgaccgggcgggcccuccugcccgccgugaaccccggccaggaggccugccugcacuucaccgcccccggguccccggacagcaagugccucaagaucaaggugaagcgcaucaaccugaagugcaagaaguccuccagcuacuucguccccgacgcgcggucccgcugcaccagcgugcggcgcugccggugggccggcgacugccaguccgggugccccagccacuucacguccaacagcuucuccgacgacugggccggcaagauggaccgcgccgggcugggcuucagcggcugcuccgacgggugcggcggggcggccugcggcugcuucaacgccgccccgagcugcaucuucuggcggaaguggguggagaacccccacgggaucaucuggaaggucucccccugcgccgcgugggugcccagcgccgugaucgagcucaccaugccguccggcgagguccgcaccuuccaccccaugagcggcauccccacccagguguucaaggggguguccgucacguaccugggcagcgacauggagguguccgggcugaccgaccucugcgagaucgaggagcucaagagcaagaagcuggcccuggcccccugcaaccaggccggcaugggcguggucgggaaggugggcgagauccagugcagcuccgaggagagcgcgcggaccaucaagaaggacgggugcaucuggaacgccgaccuggugggcaucgagcugcgcgucgacgacgccgugugcuacuccaagaucaccagcguggaggccgucgccaacuacuccgcgaucccgacgaccaucgggggccugcgguucgagcgcagccacgacucccagggcaagaucagcgggagcccccucgacaucaccgccauccggggcagcuucuccgugaacuaccgcgggcugcgccugagccucuccgagaucaccgccacgugcaccggcgaggugaccaacgucagcgggugcuacuccugcaugaccggcgccaaggugagcaucaagcugcacuccagcaagaacuccaccgcgcacgugcggugcaagggcgacgagacggccuucagcguccuggaggggauccacagcuacaccgugucccucagcuucgaccacgccguggucgacgagcagugccagcugaacugcggcgggcacgagucccaggugacccugaagggcaaccucaucuuccuggacgugcccaaguucgucgacgggagcuacaugcagaccuaccacuccagcgugcccacgggcgccaacaucccgucccccaccgacuggcugaacgcccucuucggcaacgggcugagccgcuggauccugggcgugaucgggguccuccugggcggccuggcccucuucuuccugaucaugucccuguucaagcucgggaccaagcaggucuuccggagccgcaccaagcuggcguga

SEQ ID NO: 13122 - RNA, 3222 nt, Artificial Sequence
  derived and/or modified CDS sequence (opt1) from SFTSV(KACNH3)__KP663744.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcggcgccaagugccggugcucccuggugcacaagcccggggaggucguggugagcuacggcggcaugcggguccgcccgaagugcuacggguucagccggaugauggccacgcuggaggugaacccgcccgagcagcgcaucggccagugcaccgggugccaccucgagugcaucaacggcggggugcggcugaucacccugaccuccgagcucaagagcgcgacggucugcgccucccacuucugcagcuccgccaccagcggcaagaaguccaccgagauccaguuccacagcggcucccugguggggaagaccgccauccacgucaagggcgcccugguggacgggacggaguucaccuucgagggcagcugcauguuccccgacggcugcgacgcgguggacugcaccuucugccgcgaguuccucaagaacccccagugcuaccccgccaagaaguggcuguucaucaucaucgucauccugcucggguacgccggccugaugcugcucaccaacgugcugaaggccaucgggguguggggcuccugggucaucgcccccgugaagcugauguucgcgaucaucaagaagcucaugcggagcguguccugccugauggggaagcugauggaccgcggccggcaggucauccacgaggagaucggcgagaaccgcgaggggaaccaggacgacgugcggaucgagauggcccgcccccgccgggugcgccacuggauguacagcccggucauccucacgauccuggccaucggccuggccgaggggugcgacgagauggugcacgccgacuccaagcucgugagcugcaagcagggcuccgggaacaugaaggagugcgucaccaccggccgggcgcugcugcccgccgugaaccccggccaggaggccugccuccacuucaccgcccccgggagcccggacagcaagugccugaagaucaaggugaagcgcaucaaccugaagugcaagaaguccagcuccuacuucguccccgacgcccggagccgcugcacguccgugcggcgcugccggugggcgggcgacugccagagcgggugccccucccacuucaccagcaacuccuucagcgacgacugggccggcaagauggaccgcgccgggcucggcuucuccggcugcagcgacgggugcggcggggccgcgugcggcugcuucaacgccgccccguccugcaucuucuggcggaaguggguggagaacccccacgggaucaucuggaaggucagccccugcgccgccugggugcccuccgcggugaucgagcugaccaugccgagcggcgagguccgcaccuuccaccccauguccggcauccccacccagguguucaagggggugagcgucaccuaccugggcuccgacauggaggugagcgggcucaccgaccugugcgagaucgaggagcucaagagcaagaagcuggcccuggcccccugcaaccaggccggcaugggcguggucgggaaggugggcgagauccagugcuccagcgaggaguccgcccggaccaucaagaaggacgggugcaucuggaacgcggaccuggugggcaucgagcugcgcgucgacgacgccgugugcuacagcaagaucacguccguggaggccgucgccaacuacagcgccaucccgaccaccaucgggggccuccgguucgagcgcucccacgacagccagggcaagaucuccgggagcccccuggacaucaccgcgauccggggcuccuucagcgugaacuaccgcgggcugcggcucucccugagcgaggugacggccacgugcaccggcgaggucaccaacguguccgggugcuacagcugcaugaccggcgccaagguguccaucaagcugcacagcuccaagaacagcacggcccacguccgcugcaagggcgacgagaccgcguucagcgugcucgagggggugcacuccuacaccgucagccuguccuucgaccacgccgugguggacgagcagugccagcugaacugcggcgggcacgagagccaggucacccucaagggcaaccugaucuuccuggacgugcccaaguucguggacggguccuacaugcagacguaccacagcuccguccccaccggcgccaacaucccgagccccaccgacuggcucaacgcccuguucggcaacgggcugucccgcuggauccucggcgugaucgggguccugcugggcggccucgcccuguucuuccugaucaugagccucuucaagcuggggaccaagcaggucuuccggucccgcacgaagcuggcguga

SEQ ID NO: 13123 - RNA, 3222 nt, Artificial Sequence
  derived and/or modified CDS sequence (opt1) from SFTSV(KADGH)__KU507548.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucgcccagccguucgacgucgcguggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggccggcugcgagcacggggaggagacgagcguggccaagugccggugcucccugguccacaagcccggcgaggugguggucagcuacgggggcaugcgggugcgccccaagugcuacggcuucagccggaugauggccacccuggaggugaacccgcccgagcagcgcaucgggcagugcaccggcugccaccucgagugcaucuccgggggcguccggcugaucacccugacgagcgagcucaaguccgcgaccgugugcgccagccacuucugcuccagcgccaccuccgggaagaaguccaccgagauccaguuccacagcggcagccuggucggcaaggccgccauccacgugaagggggugcuggucgacggcacggaguucaccuucgagggguccugcauguuccccgacggcugcgacgcgguggacugcaccuucugccgcgaguuccucaagaacccccagugcuacccggccaagaaguggcuguucaucaucaucgugauccugcucggcuacgccgggcugaugcugcucaccaacguccugaaggccaucggcgugugggggagcugggugaucgcccccgucaagcugauguucgcgaucaucaagaagcucaugcgguccgugagcugccugaugggcaagcugauggaccgcgggcgccaggugauccacgaggagaucggcgagaaccgggagggcaaccaggacgacguccggaucgagauggcccgcccccgccgggugcgccacuggauguacucccccgugauccucacgauccuggccaucgggcuggccgagggcugcgacgagaugguccacgccgacagcaagcucguguccugccggcaggggagcggcaacaugaaggagugcgugaccaccgggcgcgcgcugcugccggccgucaaccccggccaggaggccugccuccacuucaccgcccccggcagccccgacuccaagugccugaagaucaaggugaagcggaucaaccugaagugcaagaaguccagcagcuacuucgugccggacgcccgcucccggugcacgagcguccgccggugccgcugggcgggggacugccaguccggcugccccagccacuucaccuccaacagcuucuccgacgacugggccgggaagauggaccgggccggccucggguucagcggcugcuccgacggcugcgggggcgccgcgugcgggugcuucaacgccgcccccagcugcaucuucuggcgcaaguggguggagaacccgcacggcaucaucuggaaggugucccccugcgccgccuggguccccagcgcggugaucgagcugaccaugcccuccggggaggugcggaccuuccacccgaugagcggcauccccacgcaggucuucaagggcguguccgugaccuaccuggggagcgacauggaggucagcggccucaccgaccugugcgagaucgaggagcugaaguccaagaagcuggcccucgcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccauccccaccaccaucggcgggcuccgcuucgagcggagccacgacucccagggcaagaucagcggcuccccgcuggacaucaccgcgauccgcgggagcuucuccgucaacuaccggggccugcgccucagccuguccgagaucacggcgaccugcaccggggaggugaccaacgugagcggcugcuacuccugcaugaccggggccaaggucagcauccgccugcacuccagcaagaacagcacggcccacgugcggugcaaggaggacgagaccgccuucuccgugcucgagggcguccacagcuacaccgugucccugagcuucgaccacgccguggucgacgagcagugccagcugaacugcggcgggcacgagucccaggugacccucaagggcaaccugaucuuccuggacgugcccaaguucgucgacgggagcuacaugcagacguaccacuccagcgugcccaccggcgccaacauccccuccccgaccgacuggcucaacgcccuguucgggaacggccugagccgcuggauccucggcgucaucggggugcugcugggcgggcucgcccuguucuuccugaucaugucccucuucaagcugggcaccaagcaggucuuccggagccgcacgaagcuggcguga

SEQ ID NO: 13124 - RNA, 3222 nt, Artificial Sequence
  derived and/or modified CDS sequence (opt1) from SFTSV(KAGBH)__KU507560.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucauccggagcguguccugccugaugggcaagcugauggaccgcgggcggcaggucauccacgaggagaucggcgagaaccgcgagggcaaccaggacgacgugcggaucgagauggcccgcccccgccgggugcgccacuggauguacagcccggucauccucacgauccuggccaucgggcuggccgagggcugcgacgagauggugcacgccgacuccaagcucgugagcugcaagcagggguccggcaacaugaaggagugcgucaccaccgggcgggcgcugcugcccgccgugaaccccggccaggaggccugccuccacuucaccgcccccggcagcccggacagcaagugccugaagaucaaggugaagcgcaucaaccugaagugcaagaaguccagcuccuacuucguccccgacgcccggagccgcugcacguccgugcggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggucagccccugcgccgccugggugcccuccgcggugaucgagcugaccaugccgagcggggagguccgcaccuuccaccccauguccggcauccccacccagguguucaagggcgugagcgucaccuaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccggaccaucaagaaggacggcugcaucuggaacgcggaccugguggggaucgagcugcgcgucgacgacgccgugugcuacagcaagaucacguccguggaggccgucgccaacuacagcgccaucccgaccaccaucggcgggcuccgguucgagcgcucccacgacagccagggcaagaucuccggcagcccccuggacaucaccgcgauccggggguccuucagcgugaacuaccgcggccugcggcucucccugagcgagaucacggccacgugcaccggggaggugaccaacgucuccggcugcuacagcugcaugaccggggccaagguguccaucaagcugcacagcuccaagaacagcacggcccacgugcgcugcaagggcgacgagaccgcguucagcguccucgagggcgugcacuccuacaccgugagccuguccuucgaccacgccgucguggacgagcagugccagcugaacugcgggggccacgagagccaggugacccucaaggggaaccugaucuuccuggacguccccaaguucguggacggcuccuacaugcagacguaccacagcuccgugcccaccggggccaacaucccgagccccaccgacuggcucaacgcccuguucggcaacggccugucccgcuggauccucggggucaucggcgugcugcucgggggccuggcccuguucuuccugaucaugagccucuucaagcugggcaccaagcaggucuuccggucccgcacgaagcuggcguga

SEQ ID NO: 13125 - RNA, 3222 nt, Artificial Sequence
  derived and/or modified CDS sequence (opt1) from SFTSV(KAGBH3)__KU507561.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccucauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcaaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggagacgagcgaggccaagugccggugcucccuggugcacaagcccggcgaggucguggugagcuacgggggcaugcggguccgcccgaagugcuacggcuucagccggaugauggccacccuggaggugaacccgcccgagcagcgcaucgggcagugcaccggcugccaccucgagugcaucaacgggggcgugcggaucaucacccugacguccgagcucaagagcgccaccgucugcgcgucccacuucugcagcuccgccaccagcgggaagaaguccaccgagauccaguuccacagcggcucccuggugggcaagacggccauccacgucaagggggcccugguggacggcaccgaguucaccuucgaggggagcugcauguuccccgacggcugcgacgccguggacugcaccuucugccgcgaguuccugaagaacccccagugcuaccccgcgaagaaguggcuguucaucaucaucgucauccugcugggcuacgccgggcucaugcugcugacgaacgugcucaaggccaucggcguguggggguccugggucaucgcccccgugaagcugauguucgccaucaucaagaagcugaugcggagcguguccugccucaugggcaagcugauggaccgcgggcggcaggucauccacgaggagaucggcgagaaccgcgagggcaaccaggacgacgugcggaucgagauggcgcgcccccgccgggugcgccacuggauguacagcccggucauccugaccauccucgccaucgggcuggccgagggcugcgacgagauggugcacgccgacuccaagcuggugcucugcaagcaggggagcggcaacaugaaggagugcgucaccaccgggcgggcccugcugcccgcggugaaccccggccaggaggccugccuccacuucacggcccccggcuccccggacagcaagugccugaagaucaaggugaagcgcaucaaccugaagugcaagaaguccuccagcuacuucguccccgacgcccggucccgcugcaccagcgugcggcgcugccggugggccggggacugccaguccggcugccccagccacuucaccuccaacagcuucuccgacgacugggcggggaagauggaccgcgccggccucggguucagcggcugcuccgacggcugcgggggcgccgccugcgggugcuucaacgcggccccgagcugcaucuucuggcggaaguggguggagaacccccacggcaucaucuggaaggucucccccugcgccgccugggugcccagcgccgugaucgagcugaccaugccguccggggagguccgcacguuccaccccaugagcggcauccccacccagguguucaagggcguguccgucaccuaccuggggagcgacauggagguguccggccucaccgaccugugcgagaucgaggagcucaagagcaagaagcuggcgcuggcccccugcaaccaggccgggaugggcguggucggcaaggugggggagauccagugcagcuccgaggagagcgcccggacgaucaagaaggacggcugcaucuggaacgccgaccugguggggaucgagcugcgcgucgacgacgcggugugcuacuccaagaucaccagcguggaggccgucgccaacuacuccgccaucccgaccaccaucggcgggcuccgguucgagcgcagccacgacucccagggcaagaucagcggcagcccccuggacaucacggccauccgggggagcuucuccgugaacuaccgcggccugcggcucagccuguccgagaucaccgcgaccugcaccggggaggugaccaacgucagcggcugcuacuccugcaugacgggggccaaggugagcaucaagcugcacuccagcaagaacuccaccgcccacgugcgcugcaagggcgacgagaccgccuucagcguccucgagggcgugcacagcuacgcggugucccugagcuucgaccacgccgucguggacgagcagugccagcugaacugcgggggccacgagucccaggugacccucaaggggaaccugaucuuccuggacguccccaaguucguggacggcagcuacaugcagacguaccacuccagcgugcccaccggggccaacaucccgucccccaccgacuggcucaacgcccuguucggcaacggccugagccgcuggauccucggggucaucggcgugcugcucgggggccuggcccuguucuuccugaucaugucccucuucaagcugggcaccaagcaggucuuccggagccgcacgaagcuggcguga

SEQ ID NO: 13126 - RNA, 3222 nt, Artificial Sequence
  derived and/or modified CDS sequence (opt1) from SFTSV(KAGBH4)__KU507562.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucaugcggagcguguccugccugaugggcaagcugauggaccgcgggcggcaggucauccacgaggagaucggcgagaaccgcgagggcaaccaggacgacgugcggaucgagauggcccgcccccgccgggugcgccacuggauguacagcccggucauccucacgauccuggccaucgggcuggccgagggcugcgacgagauggugcacgccgacuccaagcucgugagcugcaagcagggguccggcaacaugaaggagugcgucaccaccgggcgggcgcugcugcccgccgugaaccccggccaggaggccugccuccacuucaccgcccccggcagcccggacagcaagugccugaagaucaaggugaagcgcaucaaccugaagugcaagaaguccagcuccuacuucguccccgacgcccggagccgcugcacguccgugcggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggucagccccugcgccgccugggugcccuccgcggugaucgagcugaccaugccgagcggggagguccgcaccuuccaccccauguccggcauccccacccagguguucaagggcgugagcgucaccuaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccggaccaucaagaaggacggcugcaucuggaacgcggaccugguggggaucgagcugcgcgucgacgacgccgugugcuacagcaagaucacguccguggaggccgucgccaacuacagcgccaucccgaccaccaucggcgggcuccgguucgagcgcucccacgacagccagggcaagaucuccggcagcccccuggacaucaccgcgauccggggguccuucagcgugaacuaccgcggccugcggcucucccugagcgagaucacggccacgugcaccggggaggugaccaacgucuccggcugcuacagcugcaugaccggggccaagguguccaucaagcugcacagcuccaagaacagcacggcccacgugcgcugcaagggcgacgagaccgcguucagcguccucgagggcgugcacuccuacaccgugagccuguccuucgaccacgccgucguggacgagcagugccagcugaacugcgggggccacgagagccaggugacccucaaggggaaccugaucuuccuggacguccccaaguucguggacggcuccuacaugcagacguaccacagcuccgugcccaccggggccaacaucccgagccccaccgacuggcucaacgcccuguucggcaacggccugucccgcuggauccucggggucaucggcgugcugcucgggggccuggcccuguucuuccugaucaugagccucuucaagcugggcaccaagcaggucuuccggucccgcacgaagcuggcguga

SEQ ID NO: 13127 - RNA, 3222 nt, Artificial Sequence
  derived and/or modified CDS sequence (opt1) from SFTSV(KAGBH5)__KP663738.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggcccccucuacaaggggaagguguucuucgagcggcccaccuucgacggcuacgugggcugggggugcggcagcgggaagucccgcacggagagcggcgagcugugcuccagcgacagcggcaccuccagcgggcugcuccccuccgaccggguccuguggaucggcgacguggccugccagccgaugacccccauccccgaggagaccuuccuggagcucaagagcuucucccagagcgaguuccccgacaucugcaagaucgacgggaucguguucaaccagugcgaguccgagagccugccgcagcccuucgacgucgccuggauggacgugggccacucccacaagaucaucaugcgcgagcacaagacgaagugggugcaggagagcuccagcaaggacuucgucugcuacaaggaggggaccggccccugcuccgagagcgaggagaagaccugcaagaccuccggcagcugccgcggggacaugcaguucugcaagguggcgggcugcgagcacggggaggagacguccgaggccaagugccggugcagccuggugcacaagcccggcgaggucgugguguccuacgggggcaugcggguccgcccgaagugcuacggcuucagccggaugauggccacccucgaggugaacccgcccgagcagcgcaucgggcagugcaccggcugccaccuggagugcaucaacgggggcgugcggcugaucacccucacgagcgagcugaaguccgccaccgucugcgcgagccacuucugcuccagcgccaccuccgggaagaaguccaccgagauccaguuccacagcggcagccuggugggcaagacggccauccacgucaagggggcccucguggacggcaccgaguucaccuucgaggggcgcugcauguuccccgacggcugcgacgccguggacugcaccuucugccgggaguuccugaagaacccccagugcuaccccgcgaagaaguggcuguucaucaucaucgucauccuccugggcuacgccgggcugaugcuccugacgaacgugcugaaggccgugggcgucuggggguccugggugaucgcccccgugaagcucauguucgccaucaucaagaagcugaugcgcagcgucuccugccugaugggcaagcucauggaccgggggcgccaggugauccacgaggagaucggcgagaaccgggagggcaaccaggacgacgugcgcaucgagauggcgcgcccccggcgcguccggcacuggauguacagcccggugauccuggccauccuggccaucgggcucgccgagggcugcgacgagauggugcacgccgacuccaagcuggucagcugcaagcagggguccggcaacaugaaggagugcgugaccaccgggcgcgcgcugcuccccgccgugaaccccggccaggaggccugccugcacuucaccgcccccggcagcccggacuccaagugccugaagaucaaggucaagcggaucaaccucaagugcaagaaguccagcagcuacuucgugcccgacgcccgcagccggugcacguccgugcgccggugccgcugggcgggggacugccagagcggcugccccucccacuucaccagcaacuccuucagcgacgacugggccgggaagauggaccgggccggccugggguucuccggcugcagcgacggcugcgggggcgccgcgugcgggugcuucaacgccgccccguccugcaucuucuggcgcaagugggucgagaacccccacggcaucaucuggaaggugagccccugcgccgccugggugcccuccgcggucaucgagcugaccaugccgagcggggaggugcggaccuuccaccccauguccggcauccccacccagguguucaagggcgucagcgugaccuaccucggguccgacauggaggugagcggccugaccgaccugugcgagaucgaggagcugaaguccaagaagcucgcccuggcccccugcaaccaggccgggaugggcgucgugggcaaggugggggagauccagugcagcagcgaggaguccgcccgcaccaucaagaaggacggcugcaucuggaacgcggaccuggucgggaucgagcuccggguggacgacgccgugugcuacagcaagaucacguccgucgaggccguggccaacuacagcgccaucccgaccaccaucggcgggcugcgcuucgagcggucccacgacagccagggcaagaucuccggcagcccccuggacaucaccgcgauccgcggguccuucagcgugaacuaccggggccuccgccugucccugagcgagaucacggccacgugcaccggggaggucaccaacguguccggcugcuacagcugcaugaccggggccaagguguccaucaagcuccacagcuccaagaacagcacggcccacguccgcugcaagggcgacgagaccgcguucuccgugcuggagggcgugcacagcuacaccgucagccuguccuucgaccacgccgugguggacgagcagugccagcucaacugcgggggccacgagagccaggucacccugaaggggaaccugaucuuccucgacgugcccaaguucguggacggcuccuacaugcagacguaccacagcuccguccccaccggggccaacaucccgagccccaccgacuggcugaacgcccuguucggcaacggccucucccgguggauccugggggugaucggcguccugcucgggggccuggcccuguucuuccucaucaugagccuguucaagcugggcaccaagcaggucuuccgcucccggacgaagcucgcguga

SEQ ID NO: 13128 - RNA, 3222 nt, Artificial Sequence
  derived and/or modified CDS sequence (opt1) from SFTSV(KAGBH6)__KP663741.1__GP
augaucaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucauccggagcguguccugccugaugggcaagcugauggaccgcgggcggcaggucauccacgaggagaucggcgagaaccgcgagggcaaccaggacgacgugcggaucgagauggcccgcccccgccgggugcgccacuggauguacagcccggucauccucacgauccuggccaucgggcuggccgagggcugcgacgagauggugcacgccgacuccaagcucgugagcugcaagcagggguccggcaacaugaaggagugcgucaccaccgggcgggcgcugcugcccgccgugaaccccggccaggaggccugccuccacuucaccgcccccggcagcccggacagcaagugccugaagaucaaggugaagcgcaucaaccugaagugcaagaaguccagcuccuacuucguccccgacgcccggagccgcugcacguccgugcggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggucagccccugcgccgccugggugcccuccgcggugaucgagcugaccaugccgagcggggagguccgcaccuuccaccccauguccggcauccccacccagguguucaagggcgugagcgucacguaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccggaccaucaagaaggacggcugcaucuggaacgcggaccugguggggaucgagcugcgcgucgacgacgccgugugcuacagcaagaucacguccguggaggccgucgccaacuacagcgccaucccgaccaccaucggcgggcuccgguucgagcgcucccacgacagccagggcaagaucuccggcagcccccuggacaucaccgcgauccggggguccuucagcgugaacuaccgcggccugcggcucucccugagcgagaucuccgccacgugcaccggggaggugaccaacgucagcggcugcuacuccugcaugaccggggccaaggugagcaucaagcugcacuccagcaagaacagcaccgcccacgugcgcugcaagggcgacgagacggcguucuccguccucgagggcgugcacagcuacaccgugucccugagcuucgaccacgccgucguggacgagcagugccagcugaacugcgggggccacgagucccaggugacccucaaggggaaccugaucuuccuggacguccccaaguucguggacggcagcuacaugcagaccuaccacuccagcgugcccacgggggccaacaucccgucccccaccgacuggcucaacgcccuguucggcaacggccugagccgcuggauccucggggucaucggcgugcugcucgggggccuggcccuguucuuccugaucaugucccucuucaagcugggcaccaagcaggcguuccggagccgcaccaagcuggccuga

SEQ ID NO: 13129 - RNA, 3222 nt, Artificial Sequence
  derived and/or modified CDS sequence (opt1) from SFTSV(KAGNH)__KU507550.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcgccggggcggccgcucccaggucagcuacuuccccgcggagaacuccuacagccggugguccgggcugcucagccccugcgacgccgacuggcugggcaugcugguggugaagaaggccaagggguccgacaugaucgucccgggccccagcuacaaggggaagguguucuucgagcgccccaccuucgacggcuacgugggcugggggugcggcuccggcaagagccggacggaguccggggagcucugcagcagcgacuccggcaccagcuccgggcugcugcccagcgaccgcguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgggagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacgcuggaggugaacccgcccgagcagcggaucgggcagugcaccggcugccaccucgagugcaucaacgggggcgugcgccugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgggaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucauccgcagcguguccugccugaugggcaagcugauggaccgggggcgccaggucauccacgaggagaucggcgagaaccgggagggcaaccaggacgacgugcgcaucgagauggcccgcccccggcgcgugcggcacuggauguacagcccggucauccucacgauccuggccaucgggcuggccgagggcugcgacgagauggugcacgccgacuccaagcucgugagcugcaagcagggguccggcaacaugaaggagugcgucaccaccgggcgcgcgcugcugcccgccgugaaccccggccaggaggccugccuccacuucaccgcccccggcagcccggacagcaagugccugaagaucaaggugaagcggaucaaccugaagugcaagaaguccagcuccuacuucguccccgacgcccgcagccggugcacguccgugcgccggugccgcugggcgggggacugccagagcggcugccccucccacuucaccagcaacuccuucagcgacgacugggccgggaagauggaccgggccggccucggguucuccggcugcagcgacggcugcgggggcgccgcgugcgggugcuucaacgccgccccguccugcaucuucuggcgcaaguggguggagaacccccacggcaucaucuggaaggucagccccugcgccgccugggugcccuccgcggugaucgagcugaccaugccgagcggggagguccggaccuuccaccccauguccggcauccccacccagguguucaagggcgugagcgucaccuaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccgcaccaucaagaaggacggcugcaucuggaacgcggaccugguggggaucgagcugcgggucgacgacgccgugugcuacagcaagaucacguccguggaggccgucgccaacuacagcgccaucccgaccaccaucggcgggcuccgcuucgagcggucccacgacagccagggcaagaucuccggcagcccccuggacaucaccgcgauccgcggguccuucagcgugaacuaccggggccugcgccucucccugagcgagaucacggccacgugcaccggggaggugaccaacgucuccggcugcuacagcugcaugaccggggccaagaucuccaucaagcugcacagcuccaagaacagcacggcccacgugcgcugcaagggcgacgagaccgcguucagcgugcucgagggcguccacuccuacaccgugagccuguccuucgaccacgccguggucgacgagcagugccagcugaacugcgggggccacgagagccaggugacccucaaggggaaccugaucuuccuggacgugcccaaguucgucgacggcuccuacaugcagacguaccacagcuccgugcccaccggggccaacaucccgagccccaccgacuggcucaacgcccuguucggcaacggccugucccgguggauccucggggugaucggcguccugcucgggggccuggcccuguucuuccugaucaugagccucuucaagcugggcaccaaccagguguuccgcucccggacgaagcuggcguga

SEQ ID NO: 13130 - RNA, 3222 nt, Artificial Sequence
  derived and/or modified CDS sequence (opt1) from SFTSV(KAGNH4)__KU507551.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggauccgcccgaagugcuacggcuucagccggaugauggccacgcuggaggucaacccgcccgagcagcgcaucgggcagugcaccggcugccaccucgagugcaucaacgggggcgugcggcugaucacccugaccuccgagcucaagagcgcgacggugugcgccucccacuucugcagcuccgccaccagcgggaagaaguccaccgagauccaguuccacagcggcucccuggucggcaagaccgccauccacgugaagggggcccuggucgacggcacggaguucaccuucgaggggagcugcauguuccccgacggcugcgacgcgguggacugcaccuucugccgcgaguuccucaagaacccccagugcuaccccgccaagaaguggcuguucaucaucaucgugauccugcucggcuacgccgggcugaugcugcucaccaacguccugaaggccaucggcguguggggguccugggugaucgcccccgucaagcugauguucgcgaucaucaagaagcucaugcggagcguguccugccugaugggcaagcugauggaccgcgggcgccaggugauccacgaggagaucggcgagaaccgggagggcaaccaggacgacguccggaucgagauggcccgcccccgccgggugcgccacuggauguacagcccggugauccucacgauccuggccaucgggcuggccggcgggugcgacgagaugguccacgccgacuccaagcucgugagcugccggcagggcuccgggaacaugaaggagugcgugaccaccggccgcgcgcugcugcccgccgucaaccccggccaggaggccugccuccacuucaccgcccccgggagcccggacagcaagugccugaagauccgggugaagcgcaucaaccugaagugcaagaaguccagcuccuacuucgugcccgacgcccggagccgcugcacguccguccggcgcugccggugggcgggcgacugccagagcgggugccccucccacuucaccagcaacuccuucagcgacgacugggccggcaagauggaccgcgccgggcucggcuucuccggcugcagcgacgggugcggcggggccgcgugcggcugcuucaacgccgccccguccugcaucuucuggcggaaguggguggagaacccccacgggaucaucuggaaggugagccccugcgccgccuggguccccuccgcggugaucgagcugaccaugccgagcggcgaggugcgcaccuuccaccccauguccggcauccccacgcaggucuucaagggggugagcgugaccuaccugggcuccgacauggaggucagcgggcucaccgaccugugcgagaucgaggagcucaagagccggaagcuggcccuggcccccugcaaccaggccggcaugggcgugguggggaaggucggcgagauccagugcuccagcgaggaguccgcccgcaccaucaagaaggacgggugcaucuggaacgcggaccuggugggcaucgagcugcggguggacgacgccgucugcuacagcaagaucacguccguggaggccguggccaacuacagcgccaucccgaccaccaucgggggccuccgcuucgagcggucccacgacagccagggcaagaucuccgggagcccccuggacaucaccgcgauccgcggcuccuucagcgucaacuaccgcgggcugcggcucucccugagcgagaucacggcgaccugcaccggcgaggugaccaacguguccgggugcuacagcugcaugaccggcgccaaggucuccaucaagcugcacagcuccaagaacagcacggcccacgugcgcugcaagggcgacgagaccgccuucagcgugcucgaggggguccacuccuacaccgugagccuguccuucgaccacgccguggucgacgagcagugccagcugaacugcggcgggcacgagagccaggugacccucaagggcaaccugaucuuccuggacgugcccaaguucgucgacggguccuacaugcagacguaccacagcuccgugcccaccggcgccaacaucccgagccccaccgacuggcucaacgcccuguucggcaacgggcugucccgguggauccucggcgugaucgggguccugcugggcggccucgcccuguuccugcucaucaugagccuguucaagcuggggaccaagcaggucuuccgcucccggacgaagcucgcguga

SEQ ID NO: 13131 - RNA, 3222 nt, Artificial Sequence
  derived and/or modified CDS sequence (opt1) from SFTSV(KAGWH2)__KU507564.1__GP
augaugaaggugaucugguucagcucccugaucugccucgugauccagugcggcggggacaccggccccaucaucugcgccgggccgauccacagcaacaaguccgccggcaucccccaccuccugggguacagcgagaagaucugccagaucgaccgccugauccacguguccagcuggcugcggaaccacucccaguuccagggcuacgugggccagcgcgggggccggagccaggucuccuacuaccccgcggagaacagcuacucccgcuggagcgggcugcucucccccugcgacgccgacuggcugggcaugcugguggugaagaaggccaaggggagcgacaugaucgucccgggccccuccuacaagggcaagguguucuucgagcggcccaccuucgacggguacgugggcugggggugcggcagcggcaagucccgcacggagagcggggagcucugcuccagcgacagcggcaccuccagcgggcugcugcccuccgaccggguccucuggaucggcgacguggccugccagccgaugacccccauccccgaggagaccuuccuggagcucaagagcuucucccagagcgaguuccccgacgugugcaagaucgacgggaucgucuucaaccagugcgagggcgagucccugccgcagcccuucgacguggccuggauggacgugggccacagccacaagaucaucaugcgcgagcacaagacgaaguggguccaggaguccagcuccaaggacuucgugugcuacaaggaggggaccggccccugcagcgaguccgaggagaagaccugcaagaccagcggguccugccggggcgacaugcaguucugcaagguggcggggugcgagcacggcgaggaggccagcgaggccaagugccgcugcucccugguccacaagcccggcgaggugguggucagcuacgggggcaugcgggugcgcccgaagugcuacggguucucccggaugauggccacgcuggaggugaacccgcccgagcagcgcaucggccagugcaccgggugccaccucgagugcaucaacggcggcguccggcugaucacccugaccagcgagcucaagagcgcgacggugugcgccucccacuucugcagcuccgccaccagcgggaagaaguccaccgagauccaguuccacagcggcucccuggucgggaagaccgccauccacgugaagggcgcccugguggacggcacggaguucaccuucgaggggagcugcauguuccccgacggcugcgacgcggucgacugcaccuucugccgcgaguuccucaagaacccccagugcuaccccgccaagaaguggcuguucaucaucaucgugauccugcucggguacgccggccugaugcugcucaccaacgugcugaaggccaucggggucuggggcuccugggugaucgcccccgugaagcuggucuucgcgaucaucaagaagcucaugcgggccgugagcugccugaugggcaagcugauggaccgcgggcgccaggugauccacgaggagaucggcgagaaccgggaggggaaccaggacgacguccggaucgagauggcccgcccccgccgggugcgccacuggauguacuccccggugauccucacgauccuggccaucggccuggccgaggggugcgacgagaugguccacgcggacagcaagcucguguccugccggcagggcagcggcaacaugaaggagugcgugaccaccgggcgcgcccugcugcccgccgucaaccccggccaggaggccugccuccacuucaccgcccccggguccccggacagcaagugccugaagaucaaggugaagcggaucaaccugaagugcaagaaguccagcagcuacuucgugcccgacgcgcgcucccggugcacgagcguccgccggugccgcugggccggcgacugccaguccgggugcccgccccacuucaccagcaacuccuucagcgacgacugggccggcaagauggaccgggccggccucggguucuccggcugcagcgacgggugcggcggggcggccugcggcugcuucaacgccgcccccuccugcaucuucuggcgcaaguggguggagaacccccacggcaucaucuggaaggugagccccugcgccgcgugggucccguccgccgugaucgagcugaccaugcccagcggggaggugcggaccuuccaccccauguccggcauccccacgcaggucuucaagggggugagcgugaccuaccugggcuccgacauggaggucagcggccucaccgaccugugcgagaucgaggagcugaaguccaagaagcuggcccucgccccgugcaaccaggccgggaugggcgugguggggaaggucggcgagauccagugcagcuccgaggagagcgcgcgcaccaucaagaaggacgggugcaucuggaacgccgaccuggugggcaucgagcugcggguggacgacgccgucugcuacagcaagaucacguccguggaggccguggccaacuacagcgcgauccccaccaccaucggcgggcuccgcuucgagcggucccacgacagccagggcaagaucuccgggagcccccuggacaucaccgccauccgcggcuccuucagcgucaacuaccgggggcugcgccucucccugagcgagaucacggcgaccugcaccggcgaggugaccaacguguccggcugcuacagcugcaugaccggggccaaggucuccaucaagcugcacagcuccaagaacagcacggcccacgugcgcugcaagggcgacgagaccgccuucuccgugcucgaggggguccacagcuacuccgugagccugagcuucgaccacgccguggucgacgagcagugccagcugaacugcggcgggcacgagucccaggugacccuccggggcaaccugaucuuccuggacgugcccaaguucgucgacggcagcuacaugcagaccuaccacuccacggugccgaccggggccaacauccccagccccaccgacuggcucaacgcccuguucggcaacgggcugucccgcuggauccucggcgucaucggcgugcugcucgggggccuggcgcuguucuuccugaucaugagccucuucaagcuggggaccaagcaggucuuccggucccgcacgaagcuggccuga

SEQ ID NO: 13132 - RNA, 3222 nt, Artificial Sequence
  derived and/or modified CDS sequence (opt1) from SFTSV(KAGWH3)__KP663735.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugaucgugaagaaggccaagggguccgacaugaucgugccgggccccagcuacaaggggaaggucuucuucgagcggcccaccuucgacggcuacgugggcugggggugcggcuccggcaagagccgcacggaguccggggagcucugcagcagcgacuccggcaccagcuccgggcugcugcccagcgaccgggugcucuggaucggcgacgucgccugccagccgaugacccccauccccgaggagaccuuccuggagcugaaguccuucagccaguccgaguuccccgacaucugcaagaucgacgggaucguguucaaccagugcgagagcgagucccucccgcagcccuucgacguggccuggauggacgucggccacagccacaagaucaucaugcgcgagcacaagacgaagugggugcaggaguccagcuccaaggacuucgugugcuacaaggaggggaccggccccugcagcgaguccgaggagaagaccugcaagaccagcggcuccugccgcggggacaugcaguucugcaaggucgcgggcugcgagcacggggaggaggccagcgaggccaagugccggugcucccuggugcacaagcccggcgagguggucgugagcuacgggggcaugcgggugcgcccgaagugcuacggcuucagccggaugauggccacgcuggaggucaacccgcccgagcagcgcaucgggcagugcaccggcugccaccucgagugcaucaacgggggcgugcggcugaucacccugaccuccgagcucaagagcgcgacggugugcgccucccacuucugcagcuccgccaccagcgggaagaaguccaccgagauccaguuccacagcggcucccuggucggcaagaccgccauccacgugaagggggcccuggucgacggcacggaguucaccuucgaggggagcugcauguuccccgacggcugcgacgcgguggacugcaccuucugccgcgaguuccucaagaacccccagugcuaccccgccaagaaguggcuguucaucaucaucgugauccugcucggcuacgccgggcugaugcugcucaccaacguccugaaggccaucggcguguggggguccugggugaucgcccccgucaagcugauguucgcgaucaucaagaagcucaugcggagcguguccugccugaugggcaagcugauggaccgcgggcgccaggugauccacgaggagaucggcgagguccgggagggcaaccaggacgacgugcggaucgagauggcccgcccccgccgggugcgccacuggauguacagcccggucauccucacgauccuggccaucgggcuggccgagggcugcgacgagauggugcacgccgacuccaagcucgugagcugcaagcagggguccggcaacaugaaggagugcgucaccaccgggcgggcgcugcugcccgccgugaaccccggccaggaggccugccuccacuucaccgcccccggcagcccggacagcaagugccugaagaucaaggugaagcgcaucaaccugaagugcaagaaguccagcuccuacuucguccccgacgcccggagccgcugcacguccgugcggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggucagccccugcgccgccugggugcccuccgcggugaucgagcugaccaugccgagcggggagguccgcaccuuccaccccauguccggcauccccacccagguguucaagggcgugagcgucaccuaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccggaccaucaagaaggacggcugcaucuggaacgcggaccugguggggaucgagcugcgcgucgacgacgccgugugcuacagcaagaucacguccguggaggccgucgccaacuacagcgccaucccgaccaccaucggcgggcuccgguucgagcgcucccacgacagccagggcaagaucuccggcagcccccuggacaucaccgcgauccggggguccuucagcgugaacuaccgcggccugcggcucucccugagcgagaucacggccacgugcaccggggaggugaccaacgucuccggcugcuacagcugcaugaccggggccaagguguccaucaagcugcacagcuccaagaacagcacggcccacgugcgcugcaagggcgacgagaccgcguucagcguccucgagggcgugcacuccuacaccgugagccuguccuucgaccacgccgucguggacgagcagugccagcugaacugcgggggccacgagagccaggugacccucaaggggaaccugaucuuccuggacguccccaaguucguggacggcuccuacaugcagacguaccacagcuccgugcccaccggggccaacaucccgagccccaccgacuggcucaacgcccuguucggcaacggccugucccgcuggauccucggggucaucggcgugcugcucgggggccuggcccuguucuuccugaucaugagccucuuccggcugggcaccaagcaggucuuccgcucccggacgaagcuggcguga

SEQ ID NO: 13133 - RNA, 3222 nt, Artificial Sequence
  derived and/or modified CDS sequence (opt1) from SFTSV(KAICH)__KU507565.1__GP
augaugaaggugaucugguucagcucccugaucugccucgugauccagugcggcggggacaccagccccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagggcgagagccucccgcagcccuucgacgucgccuggauggacguggggcacucccacaagaucaucaugcgcgagcacaagacgaagugggugcaggagagcuccagcaaggacuucgucugcuacaaggagggcaccggccccugcuccgagagcgaggagaagaccugcaagaccuccgggagcugccggggcgacaugcaguucugcaagguggcggggugcgagcacggcgaggaggccuccgaggccaagugccgcugcagccuggugcacaagcccggggaggucgugguguccuacggcggcaugcggguccgcccgaagugcuacggguucagccggaugauggccacgcuggaggugaaccagcccgagcagcgcaucggccagugcaccgggugccaccucgagugcaucagcggcggggugcggcugaucacccugaccuccgagcucaagagcgcgacggucugcgccucccacuucugcagcuccgccaccagcggcaagaaguccaccgagauccaguuccacagcggcucccugguggggaagaccgccauccacgucaagggcgcccugguggacgggacggaguucaccuucgagggcagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggguguggggcuccugggucaucgcccccgugaagcugguguucgcgaucaucaagaagcucaugcgggccgucagcugccugauggggaagcugauggaccgcggccgccaggugauccacgaggagaucggcgagaaccgggaggggaaccaggacgacgugcggaucgagauggcccgcccccgccggguccgccacuggauguacucccccgugauccucacgauccuggccaucggccuggccgaggggugcgacgagauggugcacgcggacagcaagcucgucuccugccggcagggcagcgggaacaugaaggagugcgugaccaccggccgcgcccugcugccggccgugaaccccggccaggaggccugccuccacuucaccgcccccgggucccccgacagcaagugccugaagaucaaggucaagcggaucaaccugaagugcaagaaguccagcagcuacuucgugccggacgcgcgcucccggugcacgagcgugcgccggugccgcugggccggcgacugccaguccgggugcccgccccacuucaccagcaacuccuucagcgacgacugggccggcaagauggaccgggccgggcucggcuucuccggcugcagcgacgggugcggcggggcggccugcggcugcuucaacgccgcccccuccugcaucuucuggcgcaagugggucgagaacccccacgggaucaucuggaaggugagccccugcgccgcgugggugcccuccgccgucaucgagcugaccaugccgagcggcgaggugcggaccuuccaccccauguccggcauccccacccagguguucaagggggucagcgugaccuaccugggcuccgacauggaggugagcgggcucaccgaccugugcgagauggaggagcugaaguccaagaagcuggcccucgcccccugcaaccaggccggcaugggcgucguggggaaggugggcgagauccagugcagcagcgaggaguccgcgcgcaccaucaagaaggacgggugcaucuggaacgccgaccuggucggcaucgagcugcggguggacgacgccgugugcuacagcaagaucacguccgucgaggccgugaccaacuacagcgccaucccgaccaccaucgggggccuccgcuucgagcggucccacgacagccagggcaagaucuccgggagcccccuggacaucacggcgauccgcggcuccuucagcgugaacuaccgggggcugcgccucucccugagcgagaucaccgccacgugcaccggcgaggucaccaacguguccgggugcuacagcugcaugacgggcgccaagguguccaucaagcugcacagcuccaagaacagcaccgcccacguccgcugcaagggcgacgagaccgcguucuccgugcucgagggggugcacagcuacagcgucucccugagcuucgaccacgccgugguggacgagcagugccagcugaacugcggcgggcacgaguccaaggucacccuccggggcaaccugaucuuccuggacgugcccaaguucguggacgggagcuacaugcagacguaccacuccaccguccccaccggcgccaacaucccgagccccaccgacuggcucaacgcccuguucggcaacgggcugucccgcugguuccucggcgugaucgggguccugcugggcggccucgcccuguucuuccugaucaugagccucuucaagcuggggacgaagcaggucuuccggucccgcagcaagcuggcguga

SEQ ID NO: 13134 - RNA, 3222 nt, Artificial Sequence
  derived and/or modified CDS sequence (opt1) from SFTSV(KAJJH)__KU507566.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccucauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcaaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagcggaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacgcuggaggugaacccgcccgagcagcggaucgggcagugcaccggcugccacaucgagugcaucaacgggggcgugcgccucaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgggaguuccugaagaacccccagugcuaccccgccaagaaguggcuguucaucaucaucgucauccugcugggcuacgccgggcucaugcugcugaccaacgugcucaaggccaucggcguguggggguccugggucaucgcgcccgugaagcugauguucgccaucaucaagaagcugaugcgcagcguguccugccucaugggcaagcugauggaccgggggcgccaggucauccacgaggagaucggcgagaaccgggagggcaaccaggacgacgugcgcaucgagauggcccgcccccggcgcgugcggcacuggauguacagcccggucauccugaccauccucgccaucgggcuggccgagggcugcgacgagauggugcacgcggacuccaagcuggugagcugccgccagggcggcgggaacaugaaggagugcgucacgaccgggcgggcccuccugcccgccgugaaccccggccaggaggccugccugcacuucaccgcccccggguccccggacagcaagugccucaagaucaaggugaagcgcaucaaccugaagugcaagaaguccuccagcuacuucguccccgacgcgcggucccgcugcaccagcgugcggcgcugccggugggccggcgacugccaguccgggugccccagccacuucacguccaacagcuucuccgacgacugggccggcaagauggaccgcgccgggcugggcuucagcggcugcuccgacgggugcggcggggcggccugcggcugcuucaacgccgccccgagcugcaucuucuggcggaaguggguggagaacccccacgggaucaucuggaaggucucccccugcgccgcgugggugcccagcgccgugaucgagcucaccaugccguccggcgagguccgcaccuuccaccccaugagcggcauccccacccagguguucaaggggguguccgucacguaccugggcagcgacauggagguguccgggcugaccgaccucugcgagaucgaggagcucaagagcaagaagcuggcccuggcccccugcaaccaggccggcaugggcguggucgggaaggugggcgagauccagugcagcuccgaggagagcgcgcggaccaucaagaaggacgggugcaucuggaacgccgaccuggugggcaucgagcugcgcgucgacgacgccgugugcuacuccaagaucaccagcguggaggccgucgccaacuacuccgcgaucccgacgaccaucgggggccugcgguucgagcgcagccacgacucccagggcaagaucagcgggagcccccucgacaucaccgccauccggggcagcuucuccgugaacuaccgcgggcugcgccugagccucuccgagaucaccgccacgugcaccggcgaggugaccaacgucagcgggugcuacuccugcaugaccggcgccaaggugagcaucaagcugcacuccagcaagaacuccaccgcgcacgugcggugcaagggcgacgagacggccuucagcguccuggagggggugcacagcuacaccgugucccucagcuucgaccacgccgucguggacgagcagugccagcugaacugcggcgggcacgagucccaggugacccugaagggcaaccucaucuuccuggacguccccaaguucguggacgggagcuacaugcagaccuaccacuccagcgugcccacgggcgccaacaucccgucccccaccgacuggcugaacgcccucuucggcaacgggcugagccgcuggauccugggcgucaucggggugcuccugggcggccuggcccucuucuuccugaucaugucccuguucaagcucgggaccaagcaggucuuccggagccgcaccaagcuggcguga

SEQ ID NO: 13135 - RNA, 3222 nt, Artificial Sequence
  derived and/or modified CDS sequence (opt1) from SFTSV(KAJNH2)__KU507552.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcuggugcucaagaaggccaaggaguccgacaugaucgugccggggcccagcuacaagggcaaggucuucuucgagcggcccaccuucgacggguacgugggcuggggcugcggguccggcaagagccgcacggaguccggggagcugugcagcagcgacuccggcaccagcuccggccugcuccccagcgaccgggugcuguggaucggggacgucgccugccagccgaugacccccauccccgaggagaccuuccuggagcucaaguccuucagccaguccgaguuccccgacaucugcaagaucgacggcaucguguucaaccagugcgagagcgagucccugccgcagcccuucgacguggccuggauggacgucgggcacagccacaagaucaucaugcgcgagcacaagacgaagugggugcaggaguccagcuccaaggacuucgugugcuacaaggagggcaccgggcccugcagcgaguccgaggagaagaccugcaagaccagcggcuccugccggggcgacaugcaguucugcaaggucgcggggugcgagcacggcgaggaggccagcgaggccaagugccgcugcucccuggugcacaagcccggggagguggucgugagcuacggcgggaugcgggugcgcccgaagugcuacggcuucagccggaugauggccacgcucgaggucaacccgcccgagcagcgcaucggccagugcaccgggugccaccuggagugcaucaacggcggggugcggcugaucacccucaccuccgagcucaagagcgcgacggugugcgccucccacuucugcagcuccgccaccagcggcaagaaguccaccgagauccaguuccacagcgggucccuggucggcaaggccgccauccacgugaagggcgcgcuggucgacgggaccgaguucacguucgagggcagcugcauguuccccgacgggugcgacgccguggacugcaccuucugccgcgaguuccugaagaacccccagugcuaccccgccaagaaguggcuguucaucaucaucgugauccuccugggcuacgccggccugaugcuccugaccaacguccugaaggccaucgggguguggggcuccugggugaucgcgcccgucaagcucauguucgccaucaucaagaagcugaugcggagcguguccugccugauggggaagcucauggaccgcggccgccaggugauccacgaggagaucggggagaaccgggagggcaaccgggacgacguccgcaucgagauggcccgcccccggcgcgugcggcacuggauguacagcccggugauccugaccauccuggccaucggccucgccgaggggugcgacgagaugguccacgcggacuccaagcuggugagcugccgccagggcuccgggaacaugaaggagugcgugacgaccggccgggcccugcuccccgccgucaaccccgggcaggaggccugccugcacuucaccgcccccggcagcccggacagcaagugccugaagaucaaggugaagcgcaucaaccucaagugcaagaaguccagcuccuacuucgugcccgacgcgcggagccgcugcaccuccguccggcgcugccggugggccggcgacugccagagcgggugccccucccacuucacgagcaacuccuucagcgacgacugggccggcaagauggaccgcgccgggcugggcuucuccgggugcagcgacggcugcggcggggcggccugcggcugcuucaacgccgccccguccugcaucuucuggcggaaguggguggagaacccccacgggaucaucuggaaggugagccccugcgccgcguggguccccuccgccgugaucgagcugaccaugccgagcggcgaggugcgcaccuuccaccccauguccgggauccccacccaggucuucaagggcgugagcgugacguaccucggcuccgacauggaggucagcgggcugaccgaccugugcgagaucgaggagcucaagagcaagaagcuggcccuggcccccugcaaccaggccggcauggggguggugggcaaggucggcgagauccagugcuccagcgaggaguccgcgcggaccaucaagaaggacgggugcaucuggaacgccgaccuggugggcaucgagcuccgcguggacgacgccgucugcuacagcaagaucaccuccguggaggccguggccaacuacagcgcgaucccgacgaccaucgggggccugcgguucgagcgcucccacgacagccaggggaagaucuccggcagcccccuggacaucaccgccauccggggcuccuucagcgucaacuaccgcgggcuccgccugucccugagcgagaucaccgccacgugcaccggcgaggugaccaacguguccgggugcuacagcugcaugaccggcgccaaggucuccaucaagcuccacagcuccaagaacagcaccgcgcacgugcggugcaagggggacgagacggccuucagcgugcuggagggcguccacuccuacaccgugagccuguccuucgaccacgccguggucgacgagcagugccagcucaacugcggcgggcacgagagccaggugacccugaagggcaaccugaucuuccucgacgugcccaaguucgucgacggguccuacaugcagaccuaccacagcuccgugcccacgggcgccaacaucccgagccccaccgacuggcugaacgcccuguucgggaacggccucucccgcuggauccugggcgugaucgggguccugcucggcgggcuggcgcuguucuuccucaucaugagccuguucaagcugggcaccaagcaggucuuccggucccgcgccaagcucgccuga

SEQ ID NO: 13136 - RNA, 3222 nt, Artificial Sequence
  derived and/or modified CDS sequence (opt1) from SFTSV(ZL13-32)__KU361342.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaucggcguccuccucgggggccuggcccuguucuucaugaucaugagccuguucaagcugggcacgaagcaggucuuccgcucccggaccaagcucgcguga

SEQ ID NO: 13137 - RNA, 3222 nt, Artificial Sequence
  derived and/or modified CDS sequence (opt1) from SFTSV(AHL/China/2011)__JQ670930.1__GP
augaugaaggugaucugguucagcucccugaucugccucgucauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagggcgagagccucccgcagcccuucgacgucgccuggauggacguggggcacucccacaagaucaucaugcgcgagcacaagacgaagugggugcaggagagcuccagcaaggacuucgucugcuacaaggagggcaccggccccugcuccgagagcgaggagaagaccugcaagaccuccgggagcugccggggcgacaugcaguucugcaagguggcggggugcgagcacggcgaggaggccuccgaggccaagugccgcugcagccuggugcacaagcccggggaggucgugguguccuacggcggcaugcggauccgcccgaagugcuacggguucagccggaugauggccacgcuggaggucaacccgcccgagcagcgcaucggccagugcaccgggugccaccucgagugcaucaacggcggggugcggcugaucacccugaccagcgagcucaaguccgcgacggugugcgccagccacuucugcuccagcgccaccuccggcaagaagaacaccgagauccaguuccacagcggcucccuggucgggaagaccgccauccacgugaagggcgcccuggucgacgggacggacuucaccuucgagggcagcugcauguuccccgacggcugcgacgcgguggacugcaccuucugccgcgaguuccucaagaacccccagugcuaccccgccaagaaguggcuguucaucaucaucgugauccugcucggguacgccggccugaugcugcucaccaacguccugaaggccaucgggguguggggcuccugggugaucgcccccgucaagcugauguucgcgaucaugaagaagcucaugcggagcguguccugccugauggggaagcugauggaccgcggccgccaggugauccacgaggagaucggcgagaaccgggaggggaaccaggacgacguccggaucgagauggcccgcccccgccgggugcgccacuggauguacagcccggugauccucacgauccuggccaccggccuggccgaggggugcgacgagaugguccacgccgacuccaagcucgugagcugccggcagggcuccgggaacaugaaggagugcgugaccaccggccgcgcgcugcugcccgccgucaaccccggccaggaggccugccuccacuucacggcccccgggagcccggacuccaagugccugaagaucaaggugaagcggaucaaccugaagugcaagaaguccagcuccuacuucgugcccgacgcccgcagccggugcaccuccguccgccggugccgcugggcgggcgacugccagagcgggugcccgccccacuucaccuccaacagcuucuccgacgacugggccggcaagauggaccgggccgggcucggcuucagcggcugcuccgacgggugcggcggggccgcgugcggcugcuucaacgccgcccccagcugcaucuucuggcgcaaguggguggagaacccccacgggaucaucuggaaggugucccccugcgccgccugggucccgagcgcggugaucgagcugaccaugcccuccggcgaggugcggacguuccaccccaugagcggcauccccacccaggucuucaaggggguguccgugaccuaccugggcagcgacauggaggucuccgggcucaccgaccugugcgagaucgaggagcucaagagcaagaagcuggcccuggccccgugcaaccaggccggcaugggcgugguggggaaggucggcgagauccagugcuccagcgaggagagcgcccgcacgaucaagaaggacgggugcaucuggaacgcggaccuggugggcaucgagcugcggguggacgacgccgucugcuacuccaagaucaccagcguggaggccguggccaacuacuccgccauccccaccaccaucgggggccuccgcuucgagcggagccacgacucccagggcaagaucagcgggagcccccuggacaucacggcgauccgcggcagcuucuccgucaacuaccgggggcugcgccucagccuguccgagaucaccgcgaccugcaccggcgaggugaccaacgugagcgggugcuacuccugcaugacgggcgccaaggucagcgugaagcugcacuccagcaagaacuccaccgcccacgugcgcugcaagggcgacgagaccgccuucagcguccucgagggggugcacuccuacaccgugagccugagcuucgaccacgccgucguggacgagcagugccagcugaacugcggcgggcacgagucccaggugacgcucaagggcaaccugaucuuccuggacguccccaaguucguggacgggagcuacaugcagaccuaccacuccaccgugccgaccggcgccaacauccccagccccacggacuggcucaacgcccuguucggcaacgggcugucccgguggauccucggcgucaucggggugcugcugggcggccucgcccuguucuuccugaucaugagccucuucaagcuggggaccaagcaggucuuccgcucccggaccaagcuggcguga

SEQ ID NO: 13138 - RNA, 3222 nt, Artificial Sequence
  derived and/or modified CDS sequence (opt1) from SFTSV(AH-YTY/China/05/2012)__KR017849.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcgggccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugaccauccucgccaucggccuggccgagagcugcgacgagaugguccacgcggacuccaagcuggugagcugccggcagggguccggcaacaugaaggagugcgugacgaccgggcgcgcccuccugccggccgucaaccccggccaggaggccugccugcacuucaccgcccccggcagccccgacagcaagugccucaagaucaaggugaagcggaucaaccugaagugcaagaaguccagcuccuacuucgugccggacgcgcgcagccggugcaccuccguccgccggugccgcugggccggggacugccagagcggcugcccgccccacuucacguccaacagcuucuccgacgacugggccgggaagauggaccgggccggccugggguucagcggcugcuccgacggcugcgggggcgcggccugcgggugcuucaacgccgcccccagcugcaucuucuggcgcaaguggguggagaacccccacggcaucaucuggaaggugucccccugcgccgcguggguccccagcgccgugaucgagcucaccaugccguccggggaggugcggaccuuccaccccaugagcggcauccccacccaggucuucaagggcguguccgugacguaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcgcgcaccaucaagaaggacggcugcaucuggaacgccgaccucguggggaucgagcugcggguggacgacgccgucugcuacuccaagaucaccagcguggaggccguggccaacuacuccgcgaucccgacgaccaucggcgggcugcgcuucgagcggagccacgacucccagggcaagaucagcggcagcccccucgacaucaccgccauccgcgggagcuucuccgucaacuaccggggccugcgccugagccucuccgagaucaccgccacgugcaccggggaggugaccaacgugagcggcugcuacuccugcaugaccggggccaaggucagcaucaagcugcacuccagcaagaacuccaccgcgcacgugcgcugcaagggcgacgagacggccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagaccuaccacuccacggugcccaccggggccaacaucccgagccccaccgacuggcugaacgcccucuucggcaacggccugucccgguggauccugggggugaucggcguccuccucgggggccuggcgcuguucuucaugaucaugagccuguucaagcugggcaccaagcaggucuuccgcucccggacgaagcuggccuga

SEQ ID NO: 13139 - RNA, 3222 nt, Artificial Sequence
  derived and/or modified CDS sequence (opt1) from SFTSV(AHZ/China/2011)__JQ670931.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcauccugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagaucgcggggugcgagcacggcgaggaggccagcgaggccaagugccgcugcucccucgugcacaagcccggggagguggucgugagcuacggcggcaugcgggugcgcccgaagugcuacggguucagccggaugauggccacccuggaggucaaccagcccgagcagcgcaucggccagugcacggggugccaccuggagugcaucaacggcggggugcggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccuggucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugaucuucgcgaucaucaagaagcugaugcggaccgucagcugccucauggggaagcugauggaccgcggccgccaggugauccacgaggagaucggcgagaaccgggaggggaaccaggacgacgugcggaucgagauggcccgcccccgccggguccgccacuggauguacucccccgugauccugacgauccucgccaucggccuggccgagagcugcgacgagauggugcacgccgacuccaagcuggucagcugccggcagggguccggcaacaugaaggagugcgugaccaccgggcgcgcgcuccugccggccgugaaccccggccaggaggccugccugcacuucaccgcccccggcagccccgacagcaagugccucaagaucaaggucaaguggaucaaccugaagugcaagaaguccagcuccuacuucgugccggacgcccggagccgcugcacguccgugcggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaagugggucgagaacccccacggcaucaucuggaaggugucccccugcgccgccugggugcccagcgcggucaucgagcucuccaugccgagcggggaggugcgcaccuuccaccccauguccggcauccccacccagguguucaagggcgucagcgugacguaccugggguccgacauggaggugagcggccugaccgggcucugcgagaucgaggagcucaagagcaagaagcuggcccuggcccccugcaaccaggccggcaugggcgucguggggaaggugggcgagauccagugcuccagcgaggaguccgcccggaccaucaagaaggacgggugcaucuggaacgcggaccuggucggcaucgagcugcgcguggacgacgccgugugcuacagcaagaucaccuccgucgagagcguggccaacuacuccgccaucccgacgaccaucgggggccugcgguucgagcgcagccacgacucccagggcaagaucagcgggagcccccucgacaucaccgccauccggggcagcuucuccgugaacuaccgcgggcugcggcugagccucuccgagaucaccgcgacgugcaccggcgaggucaccaacgugagcgggugcuacuccugcaugaccggcgccaaggugagcaucaagcugcacuccagcaagaacagcaccgcccacguccgcugcaagggcgacgagacggccuucuccgugcuggagggggugcacagcuacaccgucucccucagcuucgaccacgcggugguggacgagcagugccagcugaacugcggcgggcacgagucccaggucacccugaagggcaaccucaucuuccuggacgugcccaaguucguggacgggagcuacaugcagaccuaccacuccacgguccccaccggcgccaacaucccgagccccaccgacuggcugaacgcccucuucggcaacgggcugucccgcuggauccugggccucaucggggugcugcugggcggccucgcccuguucuucaugaucaugagccuguucaagcucgggaccaagcaggucuuccggucccgcacgaagcuggccuga

SEQ ID NO: 13140 - RNA, 3222 nt, Artificial Sequence
  derived and/or modified CDS sequence (opt1) from SFTSV(DS02/CHN/2013)__KR698332.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcuggucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaaccugcagugcuaccccgccaagaaguggcuguucaucaucaucgugauccuccugggcuacgccgggcugaugcuccugaccaacgugcugaaggccaucggcgucuggggguccugggugaucgcgcccgugaagcucauguucgccaucaucaagaagcugaugcggagcgucuccugccugaugggcaagcucauggaccgcgggcgccaggugauccacgaggagaucggcgagaaccgggagggcaaccaggacgacgugcggaucgagaugguccgcccccgccgggugcgccacuggauguacagccccgugauccugaccauccuggccaucgggcucacggagggcugcgacgagaugguccacgccgacuccaagcuggugagcugccggcagggguccggcaacaugaaggagugcgugaccaccgggcgcgcccugcucccggcggucaaccccggccaggaggccugccugcacuucaccgcccccggcagccccgacagcaagugccugaagaucaaggugaagcggaucaaccucaagugcaagaaguccagcuccuacuucgugccggacgcccgcagccggugcacguccguccgccggugccgcugggccggggacugccagagcggcugccccucccacuucaccagcaacuccuucagcgacgacugggcggggaagauggaccgggccggccugggguucuccggcugcagcgacggcugcgggggcgccgccugcgggugcuucaacgcggcccccuccugcaucuucuggcgcaaguggguggagaacccgcacggcaucaucuggaaggugagccccugcgccgccuggguccccuccgccgugaucgagcugaccaugcccagcggggaggugcggaccuuccacccgauguccggcauccccacgcaggucuucaagggcgugagcgugaccuaccucggguccgacauggaggucagcggccugaccgaccugugcgagaucgaggagcucaagagcaagaagcuggcgcuggcccccugcaaccaggccgggaugggcguggugggcaaggucggggagauccagugcuccagcgaggaguccgcccgcaccaucaagaaggacggcugcaucuggaacgccgaccugguggggaucgagcuccggguggacgacgcggucugcuacagcaagaucacguccguggaggccguggccaacuacagcgccauccccaccaccaucggcgggcugcgcuucgagcggucccacgacagccagggcaagaucuccggcagcccgcuggacaucaccgccauccgcggguccuucagcgucaacuaccggggccuccgccugucccugagcgagaucacggcgaccugcaccggggaggugaccaacguguccggcugcuacagcugcaugaccggggccaaggucuccaucaagcuccacagcuccaagaacagcacggcccacgugcgcugcaagggcgacgagaccgccuucagcgugcuggagggcguccacuccuacaccgugagccuguccuucgaccacgcgguggucgacgagcagugccagcucaacugcgggggccacgagagccaggugacccugaaggggaaccugaucuuccucgacgugcccaaguucgucgacggcuccuacaugcagacguaccacagcuccgugcccaccggggccaacauccccagcccgaccgacuggcugaacgcccuguucggcaacggccucucccgguggauccugggggucaucggcgugcugcucgggggccuggcccuguucuuccucaucaugagccuguucaagcugggcaccaagcaggucuuccgcucccggacgaagcucgccuga

SEQ ID NO: 13141 - RNA, 3222 nt, Artificial Sequence
  derived and/or modified CDS sequence (opt1) from SFTSV(DS03/CHN/2013)__KR698333.1__GP
augaugaaggugaucugguucagcucccugaucuaccucgucauccagugcagcggcgacuccgggcccaucaucugcgccggcccgauccacagcaacaaguccgccaacaucccccaccuccugggguacagcgagaagaucugccagaucgaccgccugauccacguguccagcuggcugcggaaccacucccaguuccagggcuacguggggcagcgcggcggccggagccaggucuccuacuaccccgcggagaacagcuacucccgcuggagcgggcugcucucccccugcgacgccgacuggcugggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagcgcgagucccugccgcagcccuucgacgucgccuggauggacgugggccacagccacaagaucaucaugcgggagcacaagaccaagugggugcaggaguccagcuccaaggacuucgucugcuacaaggaggggacgggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacccuggaggugaacccgcccgagcagcggaucgggcagugcacgggcugccaccucgagugcaucaacgggggcgugcgccugaucacccugaccuccgagcucaagagcgcgaccgucugcgccucccacuucugcagcuccgccacgagcgggaagaaguccaccgagauccaguuccacagcggcucccuggugggccggaccgccauccacgucaagggggcccugguggacggcaccgaguucacguucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucaugcggagcguguccugccugaugggcaagcugauggaccgcgggcggcaggucauccacgaggagaucggcgagaaccgcgagggcaaccaggacgacauccgcaucgagauggcccggccccgccgggugcgccacuggauguacagcccggugauccucaccauccuggccgucgggcuggccgagggcugcgacgagauggugcacgccgacuccaagcucgugagcugcaagcagggguccggcaacaugaaggagugcgucacgaccgggcgggcgcugcugcccgccgugaaccccggccaggaggccugccuccacuucaccgcccccggcagcccggacagcaagugccugaagaucaaggugaagcgcaucaaccugaagugcaagaaguccagcuccuacuucguccccgacgcccggagccgcugcaccuccgugcggcgcugccggugggcgggggacugccagagcggcugccccucccacuucacgagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggucagccccugcgccgccugggugcccuccgcggugaucgagcugaccaugccgagcggggagguccgcaccuuccaccccauguccggcauccccacccagguguucaagggcgugagcgucacguaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccggaccaucaagaaggacggcugcaucuggaacgcggaccugguggggaucgagcugcgcgucgacgacgccgugugcuacagcaagaucaccuccguggaggccgucgccaacuacagcgccaucccgacgaccaucggcgggcuccgguucgagcgcucccacgacagccagggcaagaucuccggcagcccccuggacaucaccgcgauccggggguccuucagcgugaacuaccgcggccugcgccucucccugagcgagaucaccgccacgugcaccggggaggugaccaacgucuccggcugcuacagcugcaugaccggggccaagguguccaucaagcugcacagcuccaagaacagcaccgcccacgugcggugcaagggcgacgagacggcguucagcguccucgagggcgugcacuccuacaccgugagccuguccuucgaccacgccgucguggacgagcagugccagcugaacugcgggggccacgagagccaggugacccucaaggggaaccugaucuuccuggacguccccaaguucguggacggcuccuacaugcagaccuaccacagcuccgugcccacgggggccaacaucccgagccccaccgacuggcucaacgcccuguucggcaacggccugucccgcuggauccucggggucaucggcgugcugcucgggggccuggcccuguucuuccugaucaugagccucuucaagcugggcaccaagcaggucuuccggucccgcaccaagcuggcguga

SEQ ID NO: 13142 - RNA, 3222 nt, Artificial Sequence
  derived and/or modified CDS sequence (opt1) from SFTSV(DS04/CHN/2013)__KR698334.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcgcccgugaagcugauguucgccaucaucaagaagcucaugcggagcguguccugccugaugggcaagcugauggaccgcgggcggcaggucauccacgaggagaucggcgagaaccgcgagggcaaccaggacgacgugcggaucgagauggugcgcccccgccggguccgccacuggauguacagcccggugauccucaccauccuggccaucgggcugacggagggcugcgacgagauggugcacgccgacuccaagcucgucagcugccggcagggguccggcaacaugaaggagugcgugaccaccgggcgcgcccugcugcccgcggugaaccccggccaggaggccugccuccacuucaccgcccccggcagcccggacagcaagugccugaagaucaaggucaagcggaucaaccugaagugcaagaaguccagcuccuacuucgugcccgacgcccgcagccggugcacguccgugcgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaagugggucgagaacccccacggcaucaucuggaaggugagccccugcgccgccugggugcccuccgccgucaucgagcugaccaugccgagcggggaggugcggaccuuccgccccauguccggcauccccacccagguguucaagggcgucagcgugaccuaccugggguccgacauggaggugagcggccucaccgaccugugcgagaucgaggagcucaagagcaagaagcuggcgcuggcccccugcaaccaggccgggaugggcgucgugggcaaggugggggagauccagugcuccagcgaggaguccgcccggaccaucaagaaggacggcugcaucuggaacgccgaccuggucgggaucgagcugcgcguggacgacgcggugugcuacagcaagaucacguccgucgaggccguggugaacuacagcgccaucccgaccaccaucggcgggcuccgguucgagcgcucccacgacagccagggcaagaucuccggcagcccccuggacaucaccgccauccggggguccuucagcgucaacuaccgcggccugcgccucucccugagcgagaucacggccacgugcaccggggaggugaccaacguguccggcugcuacagcugcaugaccggggcgaaggucuccaucaagcugcacagcuccaagaacagcacggcccacgugcggugcaagggcgacgagaccgccuucagcgugcucgagggcguccacuccuacaccgugagccuguccuucgaccacgccguggucgacgagcagugccagcugaacugcgggggccacgagagccaggugacccucaaggggaaccugaucuuccuggacgugcccaaguucgucgacggcuccuacaugcagacguaccacagcuccgugcccaccggggcgaacaucccgagccccaccgacuggcucaacgcccuguucggcaacggccugucccgcuggauccucggggucaucggcgugcugcucgggggccuggcccuguucuuccugaucaugagccucuucaagcugggcaccaagcaggucuuccggucccgcacgaagcuggccuga

SEQ ID NO: 13143 - RNA, 3222 nt, Artificial Sequence
  derived and/or modified CDS sequence (opt1) from SFTSV(DS05/CHN/2013)__KR698335.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugccacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcgcccgugaagcugauguucgccaucaucaagaagcucaugcggagcguguccugccugaugggcaagcugauggaccgcgggcggcaggucauccacgaggagaucggcgagaaccgcgagggcaaccaggacgacgugcggaucgagauggugcgcccccgccggguccgccacuggauguacagcccggugauccucaccauccuggccaucgggcugacggagggcugcgacgagauggugcacgccgacuccaagcucgucagcugccggcagggguccggcaacaugaaggagugcgugaccaccgggcgcgcccugcugcccgcggugaaccccggccaggaggccugccuccacuucaccgcccccggcagcccggacagcaagugccugaagaucaaggucaagcggaucaaccugaagugcaagaaguccagcuccuacuucgugcccgacgcccgcagccggugcacguccgugcgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaagugggucgagaacccccacggcaucaucuggaaggugagccccugcgccgccugggugcccuccgccgucaucgagcugaccaugccgagcggggaggugcggaccuuccaccccauguccggcauccccacccagguguucaagggcgucagcgugacguaccugggguccgacauggaggugagcggccucaccgaccugugcgagaucgaggagcucaagagcaagaagcuggcgcuggcccccugcaaccaggccgggaugggcgucgugggcaaggugggggagauccagugcuccagcgaggaguccgcccgcaccaucaagaaggacggcugcaucuggaacgccgaccuggucgggaucgagcugcggguggacgacgcggugugcuacagcaagaucacguccgucgaggccguggccaacuacagcgccaucccgaccaccaucggcgggcuccgcuucgagcggucccacgacagccagggcaagaucuccggcagcccccuggacaucaccgccauccgcggguccuucagcgugaacuaccggggccugcgccucucccugagcgagaucacggcgaccugcaccggggaggucaccaacguguccggcugcuacagcugcaugaccggggccaagguguccaucaagcugcacagcuccaagaacagcacggcccacguccgcugcaagggcgacgagaccgccuucagcgugcucgagggcgugcacuccuacaccgucagccuguccuucgaccacgcggugguggacgagcagugccagcugaacugcgggggccacgagagccaggucacccucaaggggaaccugaucuuccuggacgugcccaaguucguggacggcuccuacaugcagacguaccacagcuccguccccaccggggccaacaucccgagccccaccgacuggcucaacgcccuguucggcaacggccugucccgguggauccucggggugaucggcguccugcucgggggccuggcccuguucuuccugaucaugagccucuucaagcugggcaccaagcaggucuuccgcucccggacgaagcuggccuga

SEQ ID NO: 13144 - RNA, 3222 nt, Artificial Sequence
  derived and/or modified CDS sequence (opt1) from SFTSV(HB154/China/2011)__JQ733560.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccaccagcggcaagaaguccacggagauccacuuccacagcggcucccugguggggaagaccgccauccacgucaagggcgcgcugguggacgggaccgaguucaccuucgagggcagcugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcuccugggucaucgcgcccgugaagcugauguucgccaucaucaagaagcucaugcgcaccgugagcugccuggucgggaagcugauggaccggggccgccaggugaucaacgaggagaucggcgagaacggggagggcaaccaggacgacgugcggaucgagauggcccgcccccgccggguccgccacuggauguacuccccggugauccucaccauccuggccaucgggcuggccgagggcugcgacgagauggugcacgcggacagcaagcucgucuccugccggcaggggagcggcaacaugaaggagugcaucacgaccggccgcgcccugcugcccgccgugaaccccgggcaggaggccugccuccacuucaccgcccccggcuccccggacagcaagugccugaagaucaaggugaagcggaucaaccugaagugcaagaaguccagcagcuacuucguccccgacgcgcgcucccggugcaccagcgugcgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaaguggguggagaacccccacggcaucaucuggaaggucagccccugcgccgcgugggugccguccgccgugaucgagcugaccaugcccagcggcgagguccggaccuuccaccccauguccgggauccccacccagguguucaagggcgugagcgucacguaccugggguccgacauggaggugagcggccucaccgaccugugcgagaucgaggagcugaaguccaagaagcuggcccucgccccgugcaaccaggccggcauggggguggucggcaaggugggggagauccagugcagcagcgaggaguccgcgcgcaccaucaagaaggacggcugcaucuggaacgccgaccugguggggaucgagcugcgggucgacgacgccgugugcuacagcaagaucaccuccguggaggccgucgccaacuacagcgcgauccccacgaccaucggcggccuccgcuucgagcggucccacgacagccaggggaagaucuccggcagcccccuggacaucaccgccauccgcggguccuucagcgugaacuaccggggccugcgccucucccugagcgagaucaccgccacgugcaccggggaggugaccaacgucuccggcugcuacagcugcaugaccggcgccaagguguccaucaagcugcacagcuccaagaacagcaccgcgcacgugcgcugcaagggggacgagacggccuucuccguccucgagggcgugcacagcuacaucgugagccuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgguggauccucggggucaucggcgugcugcugggcgggcucgcgcuguucucccugaucauguuccuccugaagcugggcaccaagcaggucuuccgcagccggaccaagcucgccuga

SEQ ID NO: 13145 - RNA, 3222 nt, Artificial Sequence
  derived and/or modified CDS sequence (opt1) from SFTSV(HB155/China/2011)__JQ733563.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccaccagcggcaagaaguccacggagauccacuuccacagcggcucccugguggggaagaccgccauccacgucaagggcgcgcugguggacgggaccgaguucaccuucgagggcagcugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcuccugggucaucgcgcccgugaagcugauguucgccaucaucaagaagcucaugcgcaccgugagcugccuggucgggaagcugauggaccggggccgccaggugauccacgaggagaucggcgagaacggggagggcaaccaggacgacgugcggaucgagauggcccgcccccgccggguccgccacuggauguacuccccggugauccucaccauccuggccaucgggcuggccgagggcugcgacgagauggugcacgcggacagcaagcucgucuccugccggcaggggagcggcaacaugaaggagugcaucacgaccggccgcgcccugcugcccgccgugaaccccgggcaggaggccugccuccacuucaccgcccccggcuccccggacagcaagugccugaagaucaaggugaagcggaucaaccugaagugcaagaaguccagcagcuacuucguccccgacgcgcgcucccggugcaccagcgugcgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaaguggguggagaacccccacggcaucaucuggaaggucagccccugcgccgcgugggugccguccgccgugaucgagcugaccaugcccagcggcgagguccggaccuuccaccccauguccgggauccccacccagguguucaagggcgugagcgucacguaccugggguccgacauggaggugagcggccucaccgaccugugcgagaucgaggagcugaaguccaagaagcuggcccucgccccgugcaaccaggccggcauggggguggucggcaaggugggggagauccagugcagcagcgaggaguccgcgcgcaccaucaagaaggacggcugcaucuggaacgccgaccugguggggaucgagcugcgggucgacgacgccgugugcuacagcaagaucaccuccguggaggccgucgccaacuacagcgcgauccccacgaccaucggcggccuccgcuucgagcggucccacgacagccaggggaagaucuccggcagcccccuggacaucaccgccauccgcggguccuucagcgugaacuaccggggccugcgccucucccugagcgagaucaccgccacgugcaccggggaggugaccaacgucuccggcugcuacagcugcaugaccggcgccaagguguccaucaagcugcacagcuccaagaacagcaccgcgcacgugcgcugcaagggggacgagacggccuucuccguccucgagggcgugcacagcuacaucgugagccuguccuucgaccacgccgucguggacgagcagugccagcugaacugcgggggccacgagagccaggugacccucaaggggaaccugaucuuccuggacgucccccgguucguggacggcuccuacaugcagaccuaccacagcaccgugccgacgggcgccaacauccccucccccaccgacuggcucaacgcccuguucgggaacggccugagccgcuggauccucggggucaucggcgugcugcugggcgggcucgcgcuguucuuccugaucauguuccuccugaagcugggcaccaagcaggucuuccggucccgcaccaagcucgccuga

SEQ ID NO: 13146 - RNA, 3222 nt, Artificial Sequence
  derived and/or modified CDS sequence (opt1) from SFTSV(HB156/China/2011)__JQ733566.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccaccagcggcaagaaguccacggagauccacuuccacagcggcucccugguggggaagaccgccauccacgucaagggcgcgcugguggacgggaccgaguucaccuucgagggcagcugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcuccugggucaucgcgcccgugaagcugauguucgccaucaucaagaagcucaugcgcaccgugagcugccuggucgggaagcugauggaccggggccgccaggugauccacgaggagaucggcgagaacggggagggcaaccaggacgacgugcggaucgagauggcccgcccccgccggguccgccacuggauguacuccccggugauccucaccauccuggccaucgggcuggccgagggcugcgacgagauggugcacgcggacagcaagcucgucuccugccggcaggggagcggcaacaugaaggagugcaucacgaccggccgcgcccugcugcccgccgugaaccccgggcaggaggccugccuccacuucaccgcccccggcuccccggacagcaagugccugaagaucaaggugaagcggaucaaccugaagugcaagaaguccuccagcuacuucguccccgacgcgcgcucccggugcaccagcgugcgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaaguggguggagaacccccacggcaucaucuggaaggucagccccugcgccgcgugggugccguccgccgugaucgagcugaccaugcccagcggcgagguccggaccuuccaccccauguccgggauccccacccagguguucaagggcgugagcgucacguaccugggguccgacauggaggugagcggccucaccgaccugugcgagaucgaggagcugaaguccaagaagcuggcccucgccccgugcaaccaggccggcauggggguggucggcaaggugggggagauccagugcagcagcgaggaguccgcgcgcaccaucaagaaggacggcugcaucuggaacgccgaccugguggggaucgagcugcgggucgacgacgccgugugcuacagcaagaucaccuccguggaggccgucgccaacuacagcgcgauccccacgaccaucggcggccuccgcuucgagcggauccacgacucccaggggaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacuccuacaucgugagccugagcuucgaccacgccgucguggacgagcagugccagcugaacugcgggggccacgagucccaggugacccucaaggggaaccugaucuuccuggacguccccaaguucguggacggcagcuacaugcagaccuaccacuccaccgugccgacgggcgccaacauccccagccccaccgacuggcucaacgcccuguucgggaacggccugucccgguggauccucggggucaucggcgugcugcugggcgggcucgcgcuguucuuccugaucauguuccuccugaagcugggcaccaagcaggucuuccgcagccggaccaagcucgccuga

SEQ ID NO: 13147 - RNA, 3222 nt, Artificial Sequence
  derived and/or modified CDS sequence (opt1) from SFTSV(HB2014-04)__KR080475.1__GP
augaugaaggugaucugguuccccagccugaucugcuucgugauccagugcuccggcgacagcgggccgaucaucugcgccggccccauccacuccaacaagagcgccgacaucccccaccuccugggguacuccgagaagaucugccagaucgaccgccugauccacgugagcuccuggcuccggaaccacagccaguuccagggcuacguggggcagcgcggcggccggucccacgucagcuacuaccccgcggagaacuccuacagccgcugguccgggcugcugagcccgugcgacgccgacuggcucggcaugcugguggugaagaaggccaagggguccgacaugaucguccccggccccagcuacaaggggaagguguucuucgagcggcccaccuucgacggcuacgugggcugggggugcggcuccggcaagagccgcaccgaguccggggagcugugcagcagcgacuccggcacgagcuccgggcuccugccgagcgaccggguccuguggaucggcgacguggccugccagcccaugacccccauccccgaggagaccuuccucgagcugaaguccuucagccaguccgaguucccggacaucugcaagaucgacgggaucguguucaaccagugcgagggcgagagccugccccagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaagaccugcaagaccuccgggagcugccggggcgacaugcaguucugcaagguggcggggugcgagcacggcgaggaggccuccgaggccaagugccgcugcagccucgugcacaagccgggggaggucgugguguccuacggcggcaugcggguccgccccaagugcuacggguucagccggaugauggccacccuggaggugaaccagcccgagcagcgcaucggccagugcacggggugccaccuggagugcaucaacggcggggugcggcucaucacccugaccagcgagcugaaguccgcgaccgucugcgccagccacuucugcuccagcgccacguccggcaagaaguccaccgagauccaguuccacagcggcagccucguggggaagaccgccauccacgucaagggcgcccugguggacgggaccgaguucacguucgagggcuccugcauguuccccgacggcugcgacgcgguggacugcaccuucugccgcgaguuccugaagaacccgcagugcuaccccgccaagaaguggcuguucaucaucaucgucauccugcugggguacgccggccucaugcugcugaccaacgugcucaaggccaucgggaucuggggcagcugggugaucgcccccgucaagcugaucuucgcgaucaucaagaagcugaugcggaccguguccugccucauggggaagcugauggaccgcggccgccaggugauccacgaggagaucggcgagaaccgggaggggaaccaggacgacguccggaucgagauggcccgcccccgccgggugcgccacuggauguacagcccggugauccugacgauccucgccaucggccuggccgaguccugcgacgagaugguccacgccgacagcaagcugguguccugccggcaggggagcggcaacaugaaggagugcgugaccaccgggcgcgcgcuccugcccgccgucaaccccggccaggaggccugccugcacuucaccgcccccggcuccccggacagcaagugccucaagaucaaggugaagcggaucaaccugaagugcaagaaguccagcagcuacuucgugcccgacgcccgcucccggugcacgagcguccgccggugccgcugggcgggggacugccaguccggcugcccgccccacuucaccagcaacuccuucagcgacgacugggccgggaagauggaccgggccggccugggguucuccggcugcagcgacggcugcgggggcgccgcgugcgggugcuucaacgccgcccccuccugcaucuucuggcgcaaguggguggagaacccccacggcaucaucuggaaggugagccccugcgccgccugggucccguccgcggugaucgagcucaccaugcccagcggggaggugcggaccuuccaccccauguccggcauccccacgcaggucuucaagggcgugagcgugaccuaccugggguccgacauggaggucagcggccugaccgaccucugcgagaucgaggagcugaaguccaagaagcuggcccuggccccgugcaaccaggccgggaugggcguggugggcaaggucggggagauccagugcagcagcgaggaguccgcccgcaccaucaagaaggacggcugcaucuggaacgcggaccucguggggaucgagcugcggguggacgacgccgucugcuacagcaagaucacguccguggaggccguggccaacuacagcgccauccccaccaccaucggcgggcugcgcuucgagcggucccacgacagccagggcaagaucuccggcagcccccucgacaucaccgcgauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucuccgugcuggagggcguccacagcuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagacguaccacagcaccgugccgaccggggccaacauccccucccccaccgacuggcugaacgcccucuucggcaacggccugagccgguggauccugggggugaucggcguccuccucgggggccuggcccucuucuucaugaucaugucccuguucaagcugggcacgaagcaggucuuccgcagccgguccaagcucgcguga

SEQ ID NO: 13148 - RNA, 3222 nt, Artificial Sequence
  derived and/or modified CDS sequence (opt1) from SFTSV(HNXH)__KT254590.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugagccagcccgagcagcgcaucgggcagugcaccggcugccaccucgagugcaucaacgggggcgugcggcugaucacccugaccagcgagcucaaguccgcgacggucugcgccagccacuucugcuccagcgccaccuccggcaagaaguccaccgagauccaguuccacuccgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugguguucgcgcucaucaagaagcugaugcgggccgucuccugccugaugggcaagcucauggaccgcggccgccaggugauccacgaggagaucggggagaaccgggagggcaaccaggacgacgugcggaucgagauggcccgcccccgccggguccgccacuggauguacagccccgugauccugacgauccuggccaucgggcucgccgagggcugcgacgagauggugcacgcggacuccaagcuggucagcugccggcagggguccggcaacaugaaggagugcgugaccaccggccgcgcccugcucccggccgugaaccccgggcaggaggccugccugcacuucaccgcccccggcagccccgacuccaagugccugaagaucaaggucaagcggaucaaccucaagugcaagaaguccagcagcuacuucgugccggacgcgcgcagccggugcacguccgugcgccggugccgcugggccggggacugccagagcggcugcccgccccacuucaccuccaacagcuucuccgacgacugggccgggaagauggaccgggccggccugggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugcccagcgccgucaucgagcugaccaugccguccggcgaggugcggaccuuccaccccaugagcgggauccccacccagguguucaagggcgucuccgugaccuaccucgggagcgacauggagguguccggccugaccgaccugugcgagaucgaggagcucaagagcaagaagcuggcccuggcccccugcaaccaggccggcaugggggucgugggcaaggugggggagauccagugcuccagcgaggagagcgcgcgcaccaucaagaaggacggcugcaucuggaacgccgaccuggucgggaucgagcuccggguggacgacgccgugugcuacuccaagaucacgagcgucgaggccguggccaacuacuccgcgaucccgaccaccaucggcggccugcgcuucgagcggagccacgacucccaggggaagaucagcggcagcccccuggacaucaccgccauccgcgggagcuucuccgugaacuaccggggccuccgccugagccuguccgagaucacggccacgugcaccggggaggucaccaacgugagcggcugcuacuccugcaugaccggcgccaaggugagcaucaagcuccacuccagcaagaacuccacggcgcacguccgcugcaagggggacgagaccgccuucagcgugcuggagggcgugcacuccuacagcgucagccuguccuucgaccacgccgugguggacgagcagugccagcucaacugcgggggccacgagagccaggucacccugcgggggaaccugaucuuccucgacgugcccaaguucguggacggcuccuacaugcagaccuaccacagcacgguccccaccggcgccaacaucccgucccccaccgacuggcugaacgcccuguucgggaacggccucagccgcuggauccugggggugaccggcguccugcucggcgggcuggcgcuguucuuccucaucaugucccuguucaagcugggcacgaagcagaucuuccggagccgcaccaagcucgccuga

SEQ ID NO: 13149 - RNA, 3222 nt, Artificial Sequence
  derived and/or modified CDS sequence (opt1) from SFTSV(JS2012-goat01)__KC473538.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgccugggccagugcacggggugccaccucgagugcaucaacggcggggugcggcugaucacccugaccuccgagcucaagagcgcgaccgugugcgccucccacuucugcagcuccgccacgagcggcaagaaguccaccgagauccaguuccacagcggcucccuggucgggaagaccgccauccacgugaagggcgcccuggucgacgggaccgaguucacguucgagggcagcugcauguuccccgacggcugcgacgcgguggacugcaccuucugccgcgaguuccucaagaacccccagugcuacccggccaagaaguggcuguucaucaucaucgugauccugcucggguacgccggccugaugcugcucaccaacguccugaaggccaucgggaucuggggcuccugggugaucgcccccgugaagcugauguucgcgaucaucaagaagcucaugcggaccgucagcugccugaugcgcaagcugauggaccgggggcgccaggugauccacgaggagaucggcgagaaccgggagggcaaccaggacgacgugcgcaucgagauggcccgcccccggcgcguccggcacuggauguacucccccgugauccucacgauccuggccaucgggcuggccgagagcugcgacgagauggugcacgccgacuccaagcucgucagcugccgccagggcuccgggaacaugaaggagugcgugaccaccggccgggcgcugcugccggccgugaaccccgggcaggaggccugccuccacuucaccgcccccggcagccccgacagcaagugccugaagaucaaggucaagcgcaucaaccugaagugcaagaaguccagcuccuacuucgugccggacgcccggagccgcugcacguccgugcggcgcugccggugggcgggcgacugccagagcgggugcccgccccacuucaccuccaacagcuucuccgacgacugggccggcaagauggaccgcgccgggcucggcuucagcgggugcuccgacggcugcggcggggccgcgugcggcugcuucaacgccgcccccagcugcaucuucuggcggaagugggucgagaacccccacgggaucaucuggaaggugucccccugcgccgccugggugcccagcgcggucaucgagcugaccaugccguccggcgaggugcgcaccuuccaccccaugagcgggauccccacccagguguucaagggcgucuccgugaccuaccugggcagcgacauggagguguccgggcucaccgaccugugcgagaucgaggagcucaagagcaagaagcuggcccuggcccccugcaaccaggccggcaugggggucgugggcaaggugggcgagauccagugcagcuccgaggagagcgcccggaccaucaagaaggacgggugcaucuggaacgcggaccuggucggcaucgagcugcgcguggacgacgccgugugcuacuccaagaucacgagcgucgaggccguggccaacuacuccgccaucccgaccaccaucgggggccuccgguucgagcgcagccuggacucccaggggaagaucagcggcagcccccuggacaucaccgcgauccggggcagcuucuccgugaacuaccgcgggcuccgccugagccuguccgagaucacggccacgugcaccggcgaggucaccaacgugagcgggugcuacuccugcaugaccggcgccaaggugagcaucaagcuccacuccagcaagaacuccacggcccacguccggugcaagggggacgagaccgcguucagcgugcuggagggcgugcacagcuacaccgucucccugagcuucgaccacgccgugguggacgagcagugccagcucaacugcggcgggcacgagucccaggucacccugaagggcaaccugaucuuccucgacgugcccaaguucguggacgggagcuacaugcagacguaccacuccaccguccccaccggcgccaacaucccgagccccaccgacuggcugaacgcccuguucgggaacggccucucccgcuggauccugggcgugaucggggugcugcucggcgggcuggcccuguucuucaugaucaugagccucuucaagcugggcacgaagcaggucuuccggucccgcaccaagcuggcguga

SEQ ID NO: 13150 - RNA, 3222 nt, Artificial Sequence
  derived and/or modified CDS sequence (opt1) from SFTSV(JS2012-tick01)__KC473541.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgccugggccagugcacggggugccaccucgagugcaucaacggcggggugcggcugaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggaucuggggcuccugggugaucgcccccgucaagcugauguucgcgaucaucaagaagcucaugcggaccgugagcugccugaugcgcaagcugauggaccgggggcgccaggugauccacgaggagaucggcgagaaccgggagggcaaccaggacgacguccgcaucgagauggcccgcccccggcgcgugcggcacuggauguacucccccgugauccucacgauccuggccaucgggcuggccgagagcugcgacgagaugguccacgccgacuccaagcucgugagcugccgccagggcuccgggaacaugaaggagugcgugaccaccggccgggcgcugcugccggccgucaaccccgggcaggaggccugccuccacuucaccgcccccggcagccccgacagcaagugccugaagaucaaggugaagcgcaucaaccugaagugcaagaaguccagcuccuacuucgugccggacgcccggagccgcugcacguccguccggcgcugccggugggcgggcgacugccagagcgggugcccgccccacuucaccuccaacagcuucuccgacgacugggccggcaagauggaccgcgccgggcucggcuucagcgggugcuccgacggcugcggcggggccgcgugcggcugcuucaacgccgcccccagcugcaucuucuggcggaaguggguggagaacccccacgggaucaucuggaaggugucccccugcgccgccuggguccccagcgcggugaucgagcugaccaugccguccggcgaggugcgcaccuuccaccccaugagcgggauccccacgcaggucuucaagggcguguccgugaccuaccugggcagcgacauggaggucuccgggcucaccgaccugugcgagaucgaggagcucaagagcaagaagcuggcccuggcccccugcaaccaggccggcauggggguggugggcaaggucggcgagauccagugcagcuccgaggagagcgcccggaccaucaagaaggacgggugcaucuggaacgcggaccuggugggcaucgagcugcgcguggacgacgccgucugcuacuccaagaucacgagcguggaggccguggccaacuacuccgccaucccgaccaccaucgggggccuccgguucgagcgcagccacgacucccaggggaagaucagcggcagcccccuggacaucaccgcgauccggggcagcuucuccgucaacuaccgcgggcugcgccucagccuguccgagaucacggcgaccugcaccggcgaggugaccaacgugagcgggugcuacuccugcaugaccggcgccaaggucagcaucaagcugcacuccagcaagaacuccacggcccacgugcggugcaagggggacgagaccgccuucagcgugcucgagggcguccacagcuacaccgugucccugagcuucgaccacgccguggucgacgagcagugccagcugaacugcggcgggcacgagucccaggugacccucaagggcaaccugaucuuccuggacgugcccaaguucgucgacgggagcuacaugcagacguaccacuccaccgugcccaccggcgccaacaucccgagccccaccgacuggcucaacgcccuguucgggaacggccugucccgcuggauccucggcgugaucgggguccugcugggcgggcucgcccuguucuucaugaucaugagccuguucaagcucggcacgaagcaggucuuccggucccgcaccaagcuggcguga

SEQ ID NO: 13151 - RNA, 3222 nt, Artificial Sequence
  derived and/or modified CDS sequence (opt1) from SFTSV(LN2012-14)__KF887436.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacgucuggaucgagauggcccggccccgccgcgugcgguacuggauguacucccccgugauccugacgauccucgccgucggccuggccgagagcugcgacgagauggugcacgccgacuccaagcuggugagcugccgccagggguccggcaacaugaaggagugcgucaccaccgggcgggcgcuccugccggccgugaaccccggccaggaggccugccugcacuucaccgcccccggcagccccgacagcaagugccucaagauccgcgugaagcggaucaaccugaagugcaagaaguccagcuccuacuucgucccggacgcccgcagccggugcacguccgugcgccggugccgcugggcgggggacugccagagcggcugcccgccccacuucaccuccaacagcuucuccgacgacuggguggggaagauggaccgggccggccugggguucagcggcugcuccgacggcugcgggggcgccgccugcgggugcuucaacgcggcccccagcugcaucuucuggcgcaagugggucgagaacccccacggcaucaucuggaaggugucccccugcgccgccugggugcccagcgccgucaucgagcucaccaugccguccggggaggugcggaccuuccaccccaugagcggcauccccacccagguguucaagggcgucuccgugacguaccuggggagcgacauggagguguccggccugaccgaccucugcgagaucgaggagcucaagagcaagaagcuggcgcuggcccccugcaaccaggccgggaugggcgucgugggcaaggugggggagauccagugcagcuccgaggagagcgcccgcaccaucaagaaggacggcugcaucuggaacgccgaccuggucgggaucgagcugcggguggacgacgcggugugcuacuccaagaucacgagcgucgaggccguggccaacuacuccgccaucccgaccaccaucggcgggcugcgcuucgagcggagccacgacucccagggcaagaucagcggcagcccccucgacaucaccgccauccgcgggagcuucuccgugaacuaccggggccugcgccugagccucuccgagaucacggcgaccugcaccggggaggucaccaacgugagcggcugcuacuccugcaugaccggggccaaggugagcaucaagcugcacuccaacaagaacagcacggcccacguccgcugcaagggcgacgagaccgccuucuccgugcuggagggcgugcacagcuacaccgucagccucuccuucgaccacgcggugguggacgagcagugccagcugaacugcgggggccacgagagccaggucacccugaaggggaaccucaucuuccuggacgugcccaaguucguggacggcuccuacaugcagacguaccacagcaccguccccaccggggccaacaucccgucccccaccgacuggcugaacgcccucuucggcaacggccugagccgguggauccugggggugaucggcguccuccucgggggccuggcccuguucuucaugaucaugucccuguucaagcugggcacgaagcaggucuuccgcagccggaccaagcucgccuga

SEQ ID NO: 13152 - RNA, 3222 nt, Artificial Sequence
  derived and/or modified CDS sequence (opt1) from SFTSV(LN2012-34)__KF887437.1__GP
augaugaaggugaucugguucuucagccugaucugcuucgucauccagugcuccggcgacagcgggcccaucaucugcgccggcccgauccacuccaacaagagcgccgacaucccccaccuccugggguacuccgagaagaucugccagaucgaccgccugauccacgugagcuccuggcuccggaaccacagccaguuccagggcuacguggggcagcgcggcggccggucccaggucagcuacuaccccgcggagaacuccuacagccgcugguccgggcugcugagccccugcgacgccgacuggcucggcaugcugguggugaagaaggccaagggguccgacaugaucgucccgggccccagcuacaaggggaagguguucuucgagcggcccaccuucgacggcuacgugggcugggggugcggcuccggcaagagccgcaccgaguccggggagcugugcagcagcgacuccggcacgagcuccgggcuccugcccagcgaccggguccuguggaucggcgacguggccugccagccgaugacccccauccccgaggagaccuuccucgagcugaaguccuucagccaguccgaguuccccgacaucugcaagaucgacgggaucguguucaaccagugcgagggcgagagccugccgcagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaagaccugcaagaccuccgggagcugccggggcgacaugcaguucugcaagguggcggggugcgagcacggcgaggaggccuccgaggccaagugccgcugcagccucgugcacaagcccggggaggucgugguguccuacggcggcaugcggauccgcccgaagugcuacggguucagccggaugauggccacccuggaggucaaccagcccgagcagcgcaucggccagugcacggggugccaccuggagugcaucaacggcggggugcggcucaucacccugaccagcgagcugaaguccgcgaccgugugcgccagccacuucugcuccagcgccacguccggcaagaaguccaccgagauccaguuccacagcggcagccucgucgggaagaccgccauccacgugaagggcgcccuggucgacgggaccgaguucacguucgagggcuccugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcagcugggugaucgcccccgugaagcugaucuucgcgaucaucaagaagcugaugcggaccgucuccugccucauggggaagcugauggaccgcggccgccaggugauccacgaggagaucggcgagaaccgggaggggaaccaggacgacgugcggaucgagauggcccgcccccgccggguccgccacuggauguacagccccgugauccugacgauccucgccaucggccuggccgaguccugcgacgagauggugcacgccgacagcaagcuggucuccugccggcaggggagcggcaacgugaaggagugcgugaccaccgggcgcgcgcuccugccggccgucaaccccggccaggaggccugccugcacuucaccgcccccggcucccccgacagcaagugccucaagauccgggugaagcgcaucaaccugaagugcaagaaguccagcagcuacuucgugccggacgcccggucccgcugcacgagcguccggcgcugccggugggcgggggacugccaguccggcugcccgccccacuucaccagcaacuccuucagcgacgacugggccgggaagauggaccgcgccggccugggguucuccggcugcagcgacggcugcgggggcgccgcgugcgggugcuucaacgccgcccccuccugcaucuucuggcggaaguggguggagaacccccacggcaucaucuggaaggugagccccugcgccgccuggguccccuccgcggugaucgagcucaccaugccgagcggggaggugcgcaccuuccaccccauguccggcauccccacgcaggucuucaagggcgugagcaucaccuaccugggguccgacauggaggugagcggccugaccgaccucugcgagaucgaggagcugaaguccaagaagcuggcccuggcccccugcaaccaggccgggaugggcgucgugggcaaggugggggagauccagugcagcagcgaggaguccgcccggaccaucaagaaggacggcugcaucuggaacgcggaccucgucgggaucgagcugcgcguggacgacgccgugugcuacagcaagaucacguccgucgaggccguggccaacuacagcgccaucccgaccaccaucggcgggcugcgguucgagcgcucccacgacagccagggcaagaucuccggcagcccccucgacaucaccgcgauccggggguccuucagcgugaacuaccgcggccugcgccugucccucagcgagaucacggcgaccugcaccggggaggucaccaacguguccggcugcuacagcugcaugaccggggccaagguguccaucaagcugcacagcaacaagaacuccacggcccacguccggugcaagggcgacgagaccgccuucagcgugcuggagggcgugcacuccuacaccgucagccucagcuucgaccacgccgugguggacgagcagugccagcugaacugcgggggccacgagucccaggucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgcuggauccugggggugaucggcgugcuccucgggggccuggcccucuucuucaugaucaugagccuguucaagcugggcacgaagcaggucuuccggucccgcaccaagcucgcguga

SEQ ID NO: 13153 - RNA, 3222 nt, Artificial Sequence
  derived and/or modified CDS sequence (opt1) from SFTSV(LN2012-41)__KF887438.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacgugaaggagugcgucaccaccgggcgcgcgcuccugccggccgugaaccccggccaggaggccugccugcacuucaccgcccccggcagccccgacagcaagugccucaagauccgggugaagcgcaucaaccugaagugcaagaaguccagcuccuacuucgucccggacgcccggagccgcugcacguccgugcggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggucucccccugcgccgccugggugcccagcgcggugaucgagcucaccaugccguccggggagguccgcaccuuccaccccaugagcggcauccccacccagguguucaagggcguguccgucacguaccuggggagcgacauggagguguccggccugaccgaccucugcgagaucgaggagcucaagagcaagaagcuggcccuggcccccugcaaccaggccgggaugggcguggucggcaaggugggggagauccagugcagcuccgaggagagcgcccggaccaucaagaaggacggcugcaucuggaacgcggaccugguggggaucgagcugcgcgucgacgacgccgugugcuacuccaagaucacgagcguggaggccgucgugaacuacuccgccaucccgaccaccaucggcgggcugcgguucgagcgcagccacgacucccagggcaagaucagcggcagcccccucgacaucaccgccauccgggggagcuucuccgugaacuaccgcggccugcgccugagccucuccgagaucacggcgaccugcaccggggaggucaccaacgugagcggcugcuacuccugcaugaccggggccaaggugagcaucaagcugcacuccaacaagaacagcacggcccacguccggugcaagggcgacgagaccgccuucuccgugcuggagggcgugcacagcuacaccgucagccucuccuucgaccacgcggugguggacgagcagugccagcugaacugcgggggccacgagagccaggucacccugaaggggaaccucaucuuccuggacgugcccaaguucguggacggcuccuacaugcagacguaccacagcaccguccccaccggggccaacaucccgucccccaccgacuggcugaacgcccucuucggcaacggccugagccgcuggauccugggggugaucggcguccuccucgggggccuggcccuguucuucaugaucaugucccuguucaagcugggcacgaagcaggucuuccggagccgcaccaagcucgccuga

SEQ ID NO: 13154 - RNA, 3222 nt, Artificial Sequence
  derived and/or modified CDS sequence (opt1) from SFTSV(LN2012-58)__KF887440.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgugcagcgcaucggccagugcacggggugccaccuggagugcaucaacggcgggguccggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccugguggacgggaccgaguucacguucgagggcagcugcauguuccccgacggcugcgacgcggucgacugcaccuucugccgcgaguuccugaagaacccccagugcuacccggccaagaaguggcuguucaucaucaucgugauccugcugggguacgccggccucaugcugcugaccaacgugcucaaggccaucgggaucuggggcuccugggucaucgcccccgugaagcugaucuucgcgaucaucaagaagcugaugcggaccgugagcugccucauggggaagcugauggaccgcggccggcaggucauccacgaggagaucggcgagaaccgcgaggggaaccaggacgacgugcggaucgagauggcccgcccccgccgggugcgccacuggauguacucccccgucauccugacgauccucgugaugggccuggccgagagcugcgacgagauggugcacgccgacuccaagcuggucagcugccggcagggguccggcaacaugaaggagugcgugaccaccgggcgcgcccuccugccggcggugaaccccggccaggaggccugccugcacuucaccgcccccggcagccccgacagcaagugccucaagaucaaggucaagcggaucaaccugaagugcaagaaguccagcuccuacuucgugccggacgcccgcagccggugcacguccgugcgccggugccgcugggccggggacugccagagcggcugcccgccccacuucaccuccaacagcuucuccgacgacugggcggggaagauggaccgggccggccugggguucagcggcugcuccgacggcugcgggggcgccgccugcgggugcuucaacgcggcccccagcugcaucuucuggcgcaagugggucgagaacccccacggcaucaucuggaaggugucccccugcgccgccugggugcccagcgccgucaucgagcucaccaugccguccggggaggugcggaccuuccaccccaugagcggcauccccacccagguguucaagggcgucuccgugacguaccuggggagcgacauggagguguccggccugaccgaccucugcgagaucgaggagcucaagagcaagaagcuggcgcuggcccccugcaaccaggccgggaugggcgucgugggcaaggugggggagauccagugcagcuccgaggagagcgcccgcaccaucaagaaggacggcugcaucuggaacgccgaccuggucgggaucgagcugcggguggacgacgcggugugcuacuccaagaucacgagcgucgaggccguggccaacuacuccgccaucccgaccaccaucggcgggcugcgcuucgagcggagccacgacucccagggcaagaucagcggcagcccccucgacaucaccgccauccgcgggagcuucuccgugaacuaccggggccugcgccugagccucuccgagaucacggcgaccugcaccggggaggucaccaacgugagcggcugcuacuccugcaugaccggggccaaggugagcaucaagcugcacuccagcaagaacuccacggcccacguccgcugcaagggcgacgagaccgccuucagcgugcuggagggcgugcacagcuacaccgucucccucagcuucgaccacgcggugguggacgagcagugccagcugaacugcgggggccacgagucccaggucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgguggauccugggggugaucggcguccuccucgggggccuggcccuguucuucaugaucaugagccuguucaagcugggcacgaagcaggucuuccgcucccggaccaagcucgccuga

SEQ ID NO: 13155 - RNA, 3222 nt, Artificial Sequence
  derived and/or modified CDS sequence (opt1) from SFTSV(NB24/CHN/2013)__KR698337.1__GP
augaugaaggugaucugguucagcucccugaucugccucgugauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcgugaacgggggcguccggcugaucacccugaccuccgagcucaagagcgcgacggugugcgccucccacuucugcagcuccgccaccagcgggaagaaguccaccgagauccaguuccacagcggcucccuggucggcaagaccgccauccacgugaagggggcccugguggacggcacggaguucaccuucgaggggagcugcauguuccccgacggcugcgacgcggucgacugcaccuucugccgcgaguuccucaagaacccccagugcuaccccgccaagaaguggcuguucaucaacaucgugauccugcucggcuacgccgggcugaugcugcucaccaacgugcugaaggccaucggcgucuggggguccugggugaucgcccccgugaagcugauguucgcgaucaucaagaagcucaugcggagcgucuccugccugaugggcaagcugauggaccgcgggcgccaggugauccacgaggagaucggcgagaaccgggagggcaaccaggacgacgugcggaucgagauggcccgcccccgccggguccgccacuggauguacagcccggugauccucacgauccuggccguggggcuggccgagggcugcgacgagaugguccacgccgacuccaagcucgugagcugcaagcagggguccggcaacaugaaggagugcgugaccaccgggcgggcgcugcugcccgccgucaaccccggccaggaggccugccuccacuucaccgcccccggcagcccggacagcaagugccugaagaucaaggugaagaagaucaaccugaagugcaagaaguccagcuccuacuucgugcccgacgcccgcagccggugcacguccguccgccggugccgcugggcgggggacugccagagcggcugccccucccacuucaccagcaacuccuucagcgacgacugggccgggaagauggaccgggccggccucggguucuccggcugcagcgacggcugcgggggcgccgcgugcgggugcuucaacgccgccccguccugcaucuucuggcgcaaguggguggagaacccccacggcaucaucuggaaggugagccccugcgccgccuggguccccuccgcggugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcucaagagcaagaagcuggcccuggcccccugcaaccaggccgggaugggcguggugggcaaggucggggagauccagugcuccagcgaggaguccgcccgcaccaucaagaaggacggcugcaucuggaacgcggaccugguggggaucgagcugcggguggacgacgccgucugcuacagcaagaucacguccguggaggccguggccaacuacagcgccaucccgaccaccaucggcgggcuccgcuucgagcggucccacgacagccagggcaagaucuccggcagcccccuggacaucaccgcgauccgcggguccuucagcgucaacuaccggggccugcgccucucccugagcgagaucacggcgaccugcaccggggaggugaccaacguguccggcugcuacagcugcaugaccggggccaaggucuccaucaagcugcacagcaacaagaacuccacggcccacgugcggugcaagggcgacgagaccgccuucagcgugcucgagggcguccacagcuacaccgugucccugagcuucgaccacgccguggucgacgagcagugccagcugaacugcgggggccacgagucccaggugacccucaaggggaaccugaucuuccuggacgugcccaaguucgucgacggcagcuacaugcagacguaccacuccagcgugcccaccggggccaacaucccgucccccaccgacuggcucaacgcccuguucggcaacggccugagccgcuggauccucggggucaucggcgugcugcucgggggccuggcccuguucuuccugaucaugucccucuucaagcugggcaccaagcaggucuuccgcagccgguccaagcuggcguga

SEQ ID NO: 13156 - RNA, 3222 nt, Artificial Sequence
  derived and/or modified CDS sequence (opt1) from SFTSV(NB31/CHN/2013)__KR698338.1__GP
augaugaaggugaucugguucagcucccugaucugcuucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcuccggaaccacagccaguuccagggcuacguggggcagcgcggcggccggucccaggucagcuacuaccccuccgagaacagcaacucccgcuggagcgggcugcugucccccugcgacgcggacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcacggagagcggcgagcugugcagcuccgacagcggcaccuccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgaguccgagagccugccgcagcccuucgacgucgccuggauggacgugggccacucccacaagaucaucaugcgcgagcacaagacgaagugggugcaggagagcuccagcaaggacuucgucugcuacaaggaggggaccggccccugcuccgagagcgaggagaagaccugcaagaccuccggcagcugccgcggggacaugcaguucugcaagguggccggcugcgagcacggggaggaggcguccgaggccaagugccggugcagccucgugcacaagcccggcgaggucguggugagcuacgggggcaugcggguccgcccgaagugcuacggcuucucccggaugauggccacgcuggaggugaacccgcccgagcagcgcaucgggcagugcaccggcugccaccuggagugcaucaacgggggcgugcggcucaucacccugaccagcgagcugaaguccgccacggucugcgcgagccacuucugcuccagcgccaccuccgggaagaagaacaccgagauccaguuccacagcggcucccucgugggcaagaccgucauccacgugaagggggcccugguggacggcacggaguucaccuucgaggggagcugcauguuccccgacggcugcgaggccgucgacugcaccuucugccgcgaguuccugaagaacccccagugcuaccccgccaagaaguggcuguucaucaucaucgugauccugcugggcuacgcggggcucaugcugcugaccaacgugcucaaggccaucggcgucuggggguccugggugaucgcccccgugaagcugauguucgccaucaucaagaagcugaugcggagcgucuccugccucaugggcaagcugauggaccgcgggcgccaggugauccacgaggagaucggcgagaaccgggagggcaaccgggacgacgugcgcaucgagauggcccgcccccggcgcguccggcacuggauguacagcccggugauccugacgauccucgcgaucgggcuggccgagggcugcgacgagauggugcacgccgacuccaagcuggucagcugcaagcagggguccggcaacaugaaggagugcgugaccaccgggcgcgugcuccugcccgccgucaaccccggccaggaggccugccugcacuucaccgcgcccggcagcccggacagcaagugccucaagaucaaggugaagcggaucaaccugaagugcaagaaguccagcuccuacuucgugcccgacgcccgcagccggugcacguccguccgccggugccgcugggccggggacugccagagcggcugccccucccacuucaccagcaacuccuucagcgacgacugggccgggaagauggaccgggccggccugggguucuccggcugcagcgacggcugcgggggcgcggccugcgggugcuucaacgccgccccguccugcaucuucuggcgcaaguggguggagaacccccacggcaucaucuggaaggugagccccugcgcggccuggguccccuccgccgugaucgagcucaccaugccgagcggggaggugcggaccuuccaccccauguccggcauccccacgcaggucuucaagggcgugagcgugaccuaccugggguccgacauggaggucagcggccugaccgaccucugcgagaucgaggagcucaagagcaagaagcuggcccuggcccccugcaaccaggcggggaugggcguggugggcaaggucggggagauccagugcuccagcgaggaguccgcccgcaccaucaagaaggacggcugcaucuggaacgccgaccugguggggaucgagcugcggguggacgacgccgucugcuacagcaagaucacguccguggaggccguggcgaacuacagcgccaucccgaccaccaucggcgggcugcgcuucgagcggucccacgacagccagggcaagaucuccggcagcccccucgacaucaccgccauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcuccaagaacagcacggcgcacgugcgcugcaagggcgacgagaccgccuucagcgugcuggagggcguccacuccuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagacguaccacagcuccgugcccaccggggccaacaucccgagccccaccgacuggcugaacgcccucuucggcaacggccugucccgguggauccugggggucgugggcgugcuccucgggggccugguccuguucuuccugaucaugagccuguucaagcucggcaccaagcaggucuuccgcucccggacgaagcuggccuga

SEQ ID NO: 13157 - RNA, 3222 nt, Artificial Sequence
  derived and/or modified CDS sequence (opt1) from SFTSV(NB38/CHN/2013)__KR698341.1__GP
augaugaaggugaucugguucagcucccugaucugccucgugauccagugcggcggggacaccagccccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagggcgagagccucccgcagcccuucgacgucgccuggauggacguggggcacucccacaagaucaucaugcgcgagcacaagacgaagugggugcaggagagcuccagcaaggacuucgucugcuacaaggagggcaccggccccugcuccgagagcgaggagaagaccugcaagaccuccgggagcugccggggcgacaugcaguucugcaagguggcggggugcgagcacgaggaggaggccuccgaggccaagugccgcugcagccuggugcacaagcccggcgaggucgugguguccuacgggggcaugcggguccgcccgaagugcuacggcuucagccggaugauggccacgcuggaggugaaccagcccgagcagcgcaucgggcagugcaccggcugccaccucgagugcaucagcgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcguguggggguccugggucaucgcccccgugaagcugguguucgcgaucaucaagaagcucaugcgggccgucagcugccugaugggcaagcugauggaccgcgggcgccaggugauccacgaggagaucggcgagaaccgggagggcaaccaggacgacgugcggaucgagauggcccgcccccgccggguccgccacuggauguacucccccgugauccucacgauccuggccaucgggcuggccgagggcugcgacgagauggugcacgcggacagcaagcucgucuccugccggcaggggagcggcaacaugaaggagugcgugaccaccgggcgcgcccugcugccggccgugaaccccggccaggaggccugccuccacuucaccgcccccggcucccccgacagcaagugccugaagaucaaggucaagcggaucaaccugaagugcaagaaguccagcagcuacuucgugccggacgcgcgcucccggugcacgagcgugcgccggugccgcugggccggggacugccaguccggcugcccgccccacuucaccagcaacuccuucagcgacgacugggccgggaagauggaccgggccggccucggguucuccggcugcagcgacggcugcgggggcgcggccugcgggugcuucaacgccgcccccuccugcaucuucuggcgcaagugggucgagaacccccacggcaucaucuggaaggugagccccugcgccgcgugggugcccuccgccgucaucgagcugaccaugccgagcggggaggugcggaccuuccaccccauguccggcauccccacccagguguucaagggcgucagcgugaccuaccugggguccgacauggaggugagcggccucaccgaccugugcgagauggaggagcugaaguccaagaagcuggcccucgcccccugcaaccaggccgggaugggcgucgugggcaaggugggggagauccagugcagcagcgaggaguccgcgcgcaccaucaagaaggacggcugcaucuggaacgccgaccuggucgggaucgagcugcggguggacgacgccgugugcuacagcaagaucacguccgucgaggccguggccaaccacagcgcgaucccgaccaccaucggcgggcuccgcuucgagcggucccacgacagccagggcaagaucuccggcagcccccuggacaucaccgccauccgcggguccuucagcgugaacuaccggggccugcgccucucccugagcgagaucacggccacgugcaccggggaggucaccaacguguccggcugcuacagcugcaugaccggggccaagguguccaucaagcugcacagcuccaagaacagcacggcgcacguccgcugcaagggcgacgagaccgccuucuccgugcucgagggcgugcacagcuacagcgucucccugagcuucgaccacgccgugguggacgagcagugccagcugaacugcgggggccacgaguccaaggucacccuccgggggaaccugaucuuccuggacgugcccaaguucguggacggcagcuacaugcagaccuaccacuccacgguccccaccggggccaacaucccgagccccaccgacuggcucaacgcccuguucggcaacggccugucccgcugguuccucggggugaucggcguccugcucgggggccuggcgcuguucuuccugaucaugagccucuucaagcugggcaccaagcaggucuuccggucccgcagcaagcuggccuga

SEQ ID NO: 13158 - RNA, 3222 nt, Artificial Sequence
  derived and/or modified CDS sequence (opt1) from SFTSV(NB39/CHN/2014)__KR698342.1__GP
augaugaaggugaucugguucagcucccugaucugccucgugauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcgccggggcggccgcucccaggucagcuacuaccccgcggagaacuccuacagccggugguccgggcugcucagccccugcgacgccgacuggcugggcaugcugguggugaagaaggccaagggguccgacaugaucgucccgggccccagcuacaaggggaagguguucuucgagcgccccaccuucgacggcuacgugggcugggggugcggcuccggcaagagccggacggaguccggggagcucugcagcagcgacuccggcaccagcuccgggcugcugcccagcgaccgcguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgggagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacgcuggaggugaacccgcccgagcagcggaucgggcagugcaccggcugccaccucgagugcgugaacgggggcguccgccugaucacccugaccuccgagcucaagagcgcgacggugugcgccucccacuucugcagcuccgccaccagcgggaagaaguccaccgagauccaguuccacagcggcucccuggucggcaagaccgccauccacgugaagggggcccugguggacggcacggaguucaccuucgaggggagcugcauguuccccgacggcugcgacgcggucgacugcaccuucugccgggaguuccucaagaacccccagugcuaccccgccaagaaguggcuguucaucaucaucgugauccugcucggcuacgccgggcugaugcugcucaccaacgugcugaaggccaucggcgucuggggguccugggugaucgcccccgugaagcugauguucgcgaucaucaagaagcucaugcgcagcgucuccugccugaugggcaagcugauggaccgggggcgccaggugauccacgaggagaucggcgagaaccgggagggcaaccaggacgacgugcgcaucgagauggcccgcccccggcgcguccggcacuggauguacagcccggugauccucacgauccuggccguggggcuggccgagggcugcgacgagaugguccacgccgacuccaagcucgugagcugcaagcagggguccggcaacaugaaggagugcgugaccaccgggcgcgcgcugcugcccgccgucaaccccggccaggaggccugccuccacuucaccgcccccggcagcccggaccugaagugccugaagaucaaggugaagaagaucaaccucaagugcaagaaguccuccagcuacuucgugcccgacgcccggucccgcugcacgagcguccggcgcugccggugggcgggggacugccaguccggcugccccagccacuucaccuccaacagcuucuccgacgacugggccgggaagauggaccgcgccggccugggguucagcggcugcuccgacggcugcgggggcgccgcgugcgggugcuucaacgccgccccgagcugcaucuucuggcggaaguggguggagaacccccacggcaucaucuggaaggugucccccugcgccgccuggguccccagcgcggugaucgagcugaccaugccguccggggaggugcgcaccuuccaccccaugagcggcauccccacgcaggucuucaagggcguguccgugaccuaccucgggagcgacauggaggucuccggccugaccgaccugugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcuccgcguggacgacgccgucugcuacuccaagaucacgagcguggaggccguggccaacuacuccgccaucccgaccaccaucggcgggcugcgguucgagcgcagccacgacucccagggcaagaucagcggcagcccccuggacaucaccgcgauccgggggagcuucuccgucaacuaccgcggccuccggcugagccuguccgagaucacggcgaccugcaccggggaggugaccaacgugagcggcugcuacuccugcaugaccggggccaaggucagcaucaagcuccacuccaacaagaacagcacggcccacgugcgcugcaagggcgacgagaccgccuucuccgugcuggagggcguccacagcuacaccgugagccuguccuucgaccacgccguggucgacgagcagugccagcucaacugcgggggccacgagagccaggugacccugaaggggaaccugaucuuccucgacgugcccaaguucgucgacggcuccuacaugcagacguaccacagcuccgugcccaccggggccaacaucccgagccccaccgacuggcugaacgcccuguucggcaacggccucucccgcuggauccugggggucaucggcgugcugcucgggggccuggcccuguucuuccucaucaugagccuguucaagcugggcaccaagcaggucuuccggucccgcacgaagcucgcguga

SEQ ID NO: 13159 - RNA, 3222 nt, Artificial Sequence
  derived and/or modified CDS sequence (opt1) from SFTSV(QD7)__KR706566.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgcaucggccagugcacggggugccaccuggagugcaucaacggcggggugcggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccuggucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugauguucgcgaucaucaagaagcugaugcggaccaugagcugccucauggggaagcugauggaccgcggccggcaggucauccacgaggagaucggcgagaaccgcgaggggaaccaggacgacgugcggaucgagauggcccgcccccgccgggugcgccacuggauguacucccccgucauccugacguuccucgccaucggccuggccgagagcugcgacgagauggugcacgccgacuccaagcuggcgagcugccggcagggguccggcaacaugaaggagugcgugaccaccgggcgcgcccuccacccggccgucaaccccggccaggaggccugccugcacuucaccgcccccggcagccccgacagcaagugccugaagaucaaggugaagcggaucaaccucaagugcaagaaguccagcuccuacuucgugccggacgcgcgcagccggugcacguccguccgccggugccgcugggccggggacugccagagcggcugcccgccccacuucaccuccaacagcuucuccgacgacugggccgggaagauggaccgggccggccugggguucagcggcugcuccgacggcugcgggggcgcggccugcgggugcuucaacgccgcccccagcugcaucuucuggcgcaaguggguggagaacccccacggcaucaucuggaaggugucccccugcgccgcguggguccccagcgccgugaucgagcugaccaugccguccggggaggugcggaccuuccaccccaugagcggcauccccacgcaggucuucaagggcguguccgugaccuaccucgggagcgacauggaggucuccggccugaccgaccugugcgagaucgaggagcucaagagcaagaagcuggcccuggcccccugcaaccaggccgggaugggcguggugggcaaggucggggagauccagugcagcuccgaggagagcgcgcgcaccaucaagaaggacggcugcaucuggaacgccgaccugguggggaucgagcuccggguggacgacgccgucugcuacuccaagaucacgagcguggaggccguggccaacuacuccgcgaucccgaccaccaucggcgggcugcgcuucgagcggagccacgacucccagggcaagaucagcggcagcccccuggacaucaccgccauccgcgggagcuucuccgucaacuaccggggccuccgccugagccuguccgagaucacggcgaccugcaccggggaggugaccaacgugagcggcugcuacuccugcaugaccggggccaaggucagcaucaagcuccacuccagcaagaacuccacggcccacgugcgcugcaagggcgacgagaccgccuucagcgugcuggagggcguccacagcuacaccgugucccugagcuucgaccacgccguggucgacgagcagugccagcucaacugcgggggccacgagucccaggugacccugaaggggaaccugaucuuccucgacgugcccaaguucgucgacggcagcuacaugcagacguaccacuccaccgugcccaccggggccaacaucccgagccccaccgacuggcugaacgcccuguucggcaacggccucucccgguggauccugggggugaucggcguccugcucgggggccuggcgcuguucuucaugaucaugagccucuucaagcugggcacgaagcaggucuuccgcucccggaccaagcuggccuga

SEQ ID NO: 13160 - RNA, 3222 nt, Artificial Sequence
  derived and/or modified CDS sequence (opt1) from SFTSV(Rodent01/NB/CHN/2014)__KR698343.1__GP
augaugaaggugaucugguucagcucccugaucugccucgugauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcgccggggcggccgcucccaggucagcuacuaccccgcggagaacuccuacagccggugguccgggcugcucagccccugcgacgccgacuggcugggcaugcugguggugaagaaggccaagggguccgacaugaucgucccgggccccagcuacaaggggaagguguucuucgagcgccccaccuucgacggcuacgugggcugggggugcggcuccggcaagagccggacggaguccggggagcucugcagcagcgacuccggcaccagcuccgggcugcugcccagcgaccgcguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgggagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacgcuggaggugaacccgcccgagcagcggaucgggcagugcaccggcugccaccucgagugcgugaacgggggcguccgccugaucacccugaccuccgagcucaagagcgcgacggugugcgccucccacuucugcagcuccgccaccagcgggaagaaguccaccgagauccaguuccacagcggcucccuggucggcaagaccgccauccacgugaagggggcccugguggacggcacggaguucaccuucgaggggagcugcauguuccccgacggcugcgacgcggucgacugcaccuucugccgggaguuccucaagaacccccagugcuaccccgccaagaaguggcuguucaucaucaucgugauccugcucggcuacgccgggcugaugcugcucaccaacgugcugaaggccaucggcgucuggggguccugggugaucgcccccgugaagcugauguucgcgaucaucaagaagcucaugcgcagcgucuccugccugaugggcaagcugauggaccgggggcgccaggugauccacgaggagaucggcgagaaccgggagggcaaccaggacgacgugcgcaucgagauggcccgcccccggcgcguccggcacuggauguacagcccggugauccucacgauccuggccguggggcuggccgagggcugcgacgagaugguccacgccgacuccaagcucgugagcugcaagcagggguccggcaacaugaaggagugcgugaccaccgggcgcgcgcugcugcccgccgucaaccccggccaggaggccugccuccacuucaccgcccccggcagcccggaccugaagugccugaagaucaaggugaagaagaucaaccucaagugcaagaaguccuccagcuacuucgugcccgacgcccggucccgcugcacgagcguccggcgcugccggugggcgggggacugccaguccggcugccccagccacuucaccuccaacagcuucuccgacgacugggccgggaagauggaccgcgccggccugggguucagcggcugcuccgacggcugcgggggcgccgcgugcgggugcuucaacgccgccccgagcugcaucuucuggcggaaguggguggagaacccccacggcaucaucuggaaggugucccccugcgccgccuggguccccagcgcggugaucgagcugaccaugccguccggggaggugcgcaccuuccaccccaugagcggcauccccacgcaggucuucaagggcguguccgugaccuaccucgggagcgacauggaggucuccggccugaccgaccugugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcuccgcguggacgacgccgucugcuacuccaagaucacgagcguggaggccguggccaacuacuccgccaucccgaccaccaucggcgggcugcgguucgagcgcagccacgacucccagggcaagaucagcggcagcccccuggacaucaccgcgauccgggggagcuucuccgucaacuaccgcggccuccggcugagccuguccgagaucacggcgaccugcaccggggaggugaccaacgugagcggcugcuacuccugcaugaucggggccaaggucagcaucaagcuccacuccaacaagaacagcaccgcccacgugcgcugcaagggcgacgagacggccuucuccgugcuggagggcguccacagcuacaccgugagccuguccuucgaccacgccguggucgacgagcagugccagcucaacugcgggggccacgagagccaggugacccugaaggggaaccugaucuuccucgacgugcccaaguucgucgacggcuccuacaugcagaccuaccacagcuccgugcccacgggggccaacaucccgagccccaccgacuggcugaacgcccuguucggcaacggccucucccgcuggauccugggggucaucggcgugcugcucgggggccuggcccuguucuuccucaucaugagccuguucaagcugggcaccaagcaggucuuccggucccgcaccaagcucgcguga

SEQ ID NO: 13161 - RNA, 3222 nt, Artificial Sequence
  derived and/or modified CDS sequence (opt1) from SFTSV(SDLZtick12/2010)__JQ684872.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggauccgcccgaagugcuacggguucagccggaugauggccacccuggaggucaaccagcccgagcagcgcaucggccagugcacggggugccaccuggagugcaucaacggcggggugcggcucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccuggucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccugcugggguacgccggccucaugcugcugaccaacguccucaaggccaucgggaucuggggcuccugggugaucgcccccgugaagcugauguucgcgaucaucaagaagcugaugcggaccgucagcugccucauggggaagcugauggaccgcggccgccaggugauccacgaggagaucggcgagaaccgggaggggaaccaggacgacgugcggaucgagauggcccgcccccgccggguccgccacuggauguacucccccgugauccugacguuccucgccaucggccuggccgagagcugcgacgagauggugcacgccgacuccaagcuggucagcugccggcagggguccggcaacaugaaggagugcgugaccaccgggcgcgcgcuccugccggccgugaaccccggccaggaggccugccugcacuucaccgcccccggcagccccgacagcaagugccucaagaucaaggucaagcggaucaaccugaagugcaagaaguccagcuccuacuucgugccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaagugggucgagaacccccacggcaucaucuggaaggugucccccugcgccgccugggugcccagcgcggucaucgagcucaccaugccguccggggaggugcggaccuuccaccccaugagcggcauccccacccagguguucaagggcgucuccgugaccuaccuggggagcgacauggagguguccggccugaccgaccucugcgagaucgaggagcucaagagcaagaagcuggcccuggcccccugcaaccaggccgggaugggcgucgugggcaaggugggggagauccagugcagcuccgaggagagcgcccgcaccaucaagaaggacggcugcaucuggaacgcggaccuggucgggaucgagcugcggguggacgacgccgugugcuacuccaagaucacgagcgucgaggccguggccaacuacuccgccaucccgaccaccaucggcgggcugcgcuucgagcggagccacgacucccagggcaagaucagcggcagcccccucgacaucaccgcgauccgcgggagcuucuccgugaacuaccggggccugcgccugagccucuccgagaucacggccacgugcaccggggaggucaccaacgugagcggcugcuacuccugcaugaccggggccaaggugagcaucaagcugcacuccagcaagaacuccacggcccacguccgcugcaagggcgacgagaccgcguucagcgugcuggagggcgugcacagcuacaccgucucccucagcuucgaccacgccgugguggacgagcagugccagcugaacugcgggggccacgagucccaggucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgguggauccugggggugaucggcgugcuccucgggggccuggcccuguucuucaugaucaugagccuguucaagcugggcacgaagcaggucuuccgcucccggaccaagcucgcguga

SEQ ID NO: 13162 - RNA, 3222 nt, Artificial Sequence
  derived and/or modified CDS sequence (opt1) from SFTSV(Zhao)__KF374684.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcuggucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugaucgcgcccgugaagcugauguucgccaucaucaagaagcucaugcggagcgucuccugccugaugggcaagcugauggaccgcgggcgccaggugauccacgaggagaucggcgagaaccgggagggcaaccaggacgacgugcggaucgagaugguccgcccccgccgggugcgccacuggauguacagcccggugauccucaccauccuggccaucgggcugacggagggcugcgacgagaugguccacgccgacuccaagcucgugagcugccggcagggguccggcaacaugaaggagugcgugaccaccgggcgcgcccugcugcccgcggucaaccccggccaggaggccugccuccacuucaccgcccccggcagcccggacagcaagugccugaagaucaaggugaagcggaucaaccugaagugcaagaaguccagcuccuacuucgugcccgacgcccgcagccggugcacguccguccgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaaguggguggagaacccccacggcaucaucuggaaggugagccccugcgccgccuggguccccuccgccgugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcucaagagcaagaagcuggcgcuggcccccugcaaccaggccgggaugggcguggugggcaaggucggggagauccagugcuccagcgaggaguccgcccgcaccaucaagaaggacggcugcaucuggaacgccgaccugguggggaucgagcugcggguggacgacgcggucugcuacagcaagaucacguccguggaggccguggccaacuacagcgccaucccgaccaccaucggcgggcuccgcuucgagcggucccacgacagccagggcaaggucuccggcagcccccuggacaucaccgccauccgcggguccuucagcgugaacuaccggggccugcgccucucccugagcgagaucacggcgaccugcaccggggaggugaccaacgucuccggcugcuacagcugcaugaccggggccaagguguccaucaagcugcacagcuccaagaacagcacggcccacgugcgcugcaagggcgacgagaccgccuucagcguccucgagggcgugcacuccuacaccgugagccuguccuucgaccacgcggucguggacgagcagugccagcugaacugcgggggccacgagagccaggugacccucaaggggaaccugaucuuccuggacguccccaaguucguggacggcuccuacaugcagacguaccacagcuccguccccaccggggccaacaucccgagccccaccgacuggcucaacgcccuguucggcaacggccugucccgguggauccucggggugaucggcgugcugcucgggggccuggcccuguucuuccugaucaugagccucuucaagcugggcaccaagcaggucuuccgcucccggacgaagcuggccuga

SEQ ID NO: 13163 - RNA, 3222 nt, Artificial Sequence
  derived and/or modified CDS sequence (opt1) from SFTSV(Zhejiang/01/2011)__KJ597824.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcuggucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugaucgcgcccgugaagcugauguucgccaucaucaagaagcucaugcggagcgucuccugccugaugggcaagcugauggaccgcgggcgccaggugauccacgaggagaucggcgagaaccgggagggcaaccaggacgacgugcggaucgagaugguccgcccccgccgggugcgccacuggauguacagcccggugauccucaccauccuggccaucgggcugacggagggcugcgacgagaugguccacgccgacuccaagcucgugagcugccggcagggguccggcaacaugaaggagugcgugaccaccgggcgcgcccugcugcccgcggucaaccccggccaggaggccugccuccacuucaccgcccccggcagcccggacagcaagugccugaagaucaaggugaagcggaucaaccugaagugcaagaaguccagcuccuacuucgugcccgacgcccgcagccggugcacguccguccgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaaguggguggagaacccccacggcaucaucuggaaggugagccccugcgccgccuggguccccuccgccgugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcucaagagcaagaagcuggcgcuggcccccugcaaccaggccgggaugggcguggugggcaaggucggggagauccagugcuccagcgaggaguccgcccgcaccaucaagaaggacggcugcaucuggaacgccgaccugguggggaucgagcugcggguggacgacgcggucugcuacagcaagaucacguccguggaggccguggccaacuacagcgccaucccgaccaccaucggcgggcuccgcuucgagcggucccacgacagccagggcaagaucuccggcagcccccuggacaucaccgccauccgcggguccuucagcgucaacuaccggggccugcgccucucccugagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcucgagggcguccacuccuacaccgugagccuguccuucgaccacgcgguggucgacgagcagugccagcugaacugcgggggccacgagagccaggugacccucaaggggaaccugaucuuccuggacgugcccaaguucgucgacggcuccuacaugcagacguaccacagcuccgugcccaccggggccaacaucccgagccccaccgacuggcucaacgcccuguucggcaacggccugucccgguggauccucggggucaucggcgugcugcucgggggccuggcccuguucuuccugaucaugagccucuucaagcugggcaccaagcaggucuuccgcucccggacgaagcuggccuga

SEQ ID NO: 13164 - RNA, 3222 nt, Artificial Sequence
  derived and/or modified CDS sequence (opt1) from SFTSV(ZJ2013-06)__KP280204.1__GP
augaugaaggugaucugguucagcucccugaucugccucgugauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcgugaacgggggcguccggcugaucacccugaccuccgagcucaagagcgcgacggugugcgccucccacuucugcagcuccgccaccagcgggaagaaguccaccgagauccaguuccacagcggcucccuggucggcaagaccgccauccacgugaagggggcccugguggacggcacggaguucaccuucgaggggagcugcauguuccccgacggcugcgacgcggucgacugcaccuucugccgcgaguuccucaagaacccccagugcuaccccgccaagaaguggcuguucaucaacaucgugauccugcucggcuacgccgggcugaugcugcucaccaacgugcugaaggccaucggcgucuggggguccugggugaucgcccccgugaagcugauguucgcgaucaucaagaagcucaugcggagcgucuccugccugaugggcaagcugauggaccgcgggcgccaggugauccacgaggagaucggcgagaaccgggagggcaaccaggacgacgugcggaucgagauggcccgcccccgccggguccgccacuggauguacagcccggugauccucacgauccuggccguggggcuggccgagggcugcgacgagaugguccacgccgacuccaagcucgugagcugcaagcagggguccggcaacaugaaggagugcgugaccaccgggcgggcgcugcugcccgccgucaaccccggccaggaggccugccuccacuucaccgcccccggcagcccggacagcaagugccugaagaucaaggugaagaagaucaaccugaagugcaagaaguccagcuccuacuucgugcccgacgcccgcagccggugcacguccguccgccggugccgcugggcgggggacugccagagcggcugccccucccacuucaccagcaacuccuucagcgacgacugggccgggaagauggaccgggccggccucggguucuccggcugcagcgacggcugcgggggcgccgcgugcgggugcuucaacgccgccccguccugcaucuucuggcgcaaguggguggagaacccccacggcaucaucuggaaggugagccccugcgccgccuggguccccuccgcggugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcucaagagcaagaagcuggcccuggcccccugcaaccaggccgggaugggcguggugggcaaggucggggagauccagugcuccagcgaggaguccgcccgcaccaucaagaaggacggcugcaucuggaacgcggaccugguggggaucgagcugcggguggacgacgccgucugcuacagcaagaucacguccguggaggccguggccaacuacagcgccaucccgaccaccaucggcgggcuccgcuucgagcggucccacgacagccagggcaagaucuccggcagcccccuggacaucaccgcgauccgcggguccuucagcgucaacuaccggggccugcgccucucccugagcgagaucacggcgaccugcaccggggaggugaccaacguguccggcugcuacagcugcaugaccggggccaaggucuccaucaagcugcacagcaacaagaacuccacggcccacgugcggugcaagggcgacgagaccgccuucagcgugcucgagggcguccacagcuacaccgugucccugagcuucgaccacgccguggucgacgagcagugccagcugaacugcgggggccacgagucccaggugacccucaaggggaaccugaucuuccuggacgugcccaaguucgucgacggcagcuacaugcagacguaccacuccagcgugcccaccggggccaacaucccgucccccaccgacuggcucaacgcccuguucggcaacggccugagccgcuggauccucggggucaucggcgugcugcucgggggccuggcccuguucuuccugaucaugucccucuucaagcugggcaccaagcaggucuuccgcagccggacgaagcuggcguga

SEQ ID NO: 13165 - RNA, 3222 nt, Artificial Sequence
  derived and/or modified CDS sequence (opt1) from SFTSV(ZJZHSH-AM/China/05/2012)__KR017846.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacauccaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcgcccgugaagcugauguucgccaucaucaagaagcucaugcggagcguguccugccugaugggcaagcugauggaccgcgggcggcaggucauccacgaggagaucggcgagaaccgcgagggcaaccaggacgacgugcggaucgagauggugcgcccccgccggguccgccacuggauguacagcccggugauccucaccauccuggccaucgggcugacggagggcugcgacgagauggugcacgccgacuccaagcucgucagcugccggcagggguccggcaacaugaaggagugcgugaccaccgggcgcgcccugcugcccgcggugaaccccggccaggaggccugccuccacuucaccgcccccggcagcccggacagcaagugccugaagaucaaggucaagcggaucaaccugaagugcaagaaguccagcuccuacuucgugcccgacgcccgcagccggugcacguccgugcgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaagugggucgagaacccccacggcaucaucuggaaggugagccccugcgccgccugggugcccuccgccgucaucgagcugaccaugccgagcggggaggugcggaccuuccaccccauguccggcauccccacccagguguucaagggcgucagcgugacguaccugggguccgacauggaggugagcggccucaccgaccugugcgagaucgaggagcucaagagcaagaagcuggcgcuggcccccugcaaccaggccgggaugggcgucgugggcaaggugggggagauccagugcuccagcgaggaguccgcccgcaccaucaagaaggacggcugcaucuggaacgccgaccuggucgggaucgagcugcggguggacgacgcggugugcuacagcaagaucacguccgucgaggccguggccaacuacagcgccaucccgaccaccaucggcgggcuccgcuucgagcggucccacgacagccagggcaagaucuccggcagcccccuggacaucaccgccauccgcggguccuucagcgugaacuaccggggccugcgccucucccugagcgagaucacggcgaccugcaccggggaggucaccaacguguccggcugcuacagcugcaugaccggggccaagguguccaucaagcugcacagcuccaagaacagcacggcccacguccgcugcaagggcgacgagaccgccuucagcgugcucgagggcgugcacuccuacaccgucagccuguccuucgaccacgcggugguggacgagcagugccagcugaacugcgggggccacgagagccaggucacccucaaggggaaccugaucuuccuggacgugcccaaguucguggacggcuccuacaugcagacguaccacagcuccguccccaccggggccaacaucccgagccccaccgacuggcucaacgcccuguucggcaacggccugucccgguggauccucggggugaucggcguccugcucgggggccuggcccuguucuuccugaucaugagccucuucaagcugggcaccaagcaggucuuccgcucccggacgaagcuggccuga

SEQ ID NO: 13166 - RNA, 3222 nt, Artificial Sequence
  derived and/or modified CDS sequence (opt1) from SFTSV(ZJZHSH-CXD/China/05/2012)__KR017858.1__GP
augaugaaggugaucugguucagcucccugaucugccucgugauccagugcggcggggacaccggccccaucaucugcgccgggccgauccacagcaacaaguccgccggcaucccccaccuccugggguacagcgagaagaucugccagaucgaccgccugauccacguguccagcuggcugcggaaccacucccaguuccagggcuacgugggccagcgcgggggccggagccaggucuccuacuaccccgcggagaacagcuacucccgcuggagcgggcugcucucccccugcgacgccgacuggcugggcaugcugguggugaagaaggccaaggggagcgacaugaucgucccgggccccuccuacaagggcaagguguucuucgagcggcccaccuucgacggguacgugggcugggggugcggcagcggcaagucccgcacggagagcggggagcucugcuccagcgacagcggcaccuccagcgggcugcugcccuccgaccggguccucuggaucggcgacguggccugccagccgaugacccccauccccgaggagaccuuccuggagcucaagagcuucucccagagcgaguuccccgacgugugcaagaucgacgggaucgucuucaaccagugcgagggcgagucccugccgcagcccuucgacguggccuggauggacgugggccacagccacaagaucaucaugcgcgagcacaagacgaaguggguccaggaguccagcuccaaggacuucgugugcuacaaggaggggaccggccccugcagcgaguccgaggagaagaccugcaagaccagcggguccugccggggcgacaugcaguucugcaagguggcggggugcgagcacggcgaggaggccagcgaggccaagugccgcugcucccugguccacaagcccggcgaggugguggucagcuacgggggcaugcgggugcgcccgaagugcuacggguucucccggaugauggccacgcuggaggugaacccgcccgagcagcgcaucggccagugcaccgggugccaccucgagugcaucaacggcggcguccggcugaucacccugaccagcgagcucaagagcgcgacggugugcgccucccacuucugcagcuccgccaccagcgggaagaaguccaccgagauccaguuccacagcggcucccuggucgggaagaccgccauccacgugaagggcgcccugguggacggcacggaguucaccuucgaggggagcugcauguuccccgacggcugcgacgcggucgacugcaccuucugccgcgaguuccucaagaacccccagugcuaccccgccaagaaguggcuguucaucaucaucgugauccugcucggguacgccggccugaugcugcucaccaacgugcugaaggccaucggggucuggggcuccugggugaucgcccccgugaagcuggucuucgcgaucaucaagaagcucaugcgggccgugagcugccugaugggcaagcugauggaccgcgggcgccaggugauccacgaggagaucggcgagaaccgggaggggaaccagaacgacguccggaucgagauggcccgcccccgccgggugcgccacuggauguacuccccggugauccucacgauccuggccaucggcuucgccgaggggugcgacgagaugguccacgcggacagcaagcugguguccugccggcagggcagcgagaacaugaaggagugcgugaccaccggccgcgcccuccugcccgccgucaaccccgggcaggaggccugccugcacuucaccgcccccggcuccccggacagcaagugccucaagaucaaggugaagcggaucaaccugaagugcaagaaguccagcagcuacuucgugcccgacgcgcgcucccggugcacgagcguccgccggugccgcugggccggggacugccaguccggcugcccgccccacuucaccagcaacuccuucagcgacgacugggccgggaagauggaccgggccggccugggcuucuccgggugcagcgacggcugcgggggcgcggccugcgggugcuucaacgccgcccccuccugcaucuucuggcgcaaguggguggagaacccccacggcaucaucuggaaggugagccccugcgccgcgugggucccguccgccgugaucgagcucaccaugcccagcggcgaggugcggaccuuccaccccauguccgggauccccacgcaggucuucaagggcgugagcgugaccuaccugggguccgacauggaggucagcggccugaccgaccucugcgagaucgaggagcugaaguccaagaagcuggcccuggccccgugcaaccaggccggcauggggguggugggcaaggucggggagauccagugcagcuccgaggagagcgcgcgcaccaucaagaaggacggcugcaucuggaacgccgaccucguggggaucgagcugcggguggacgacgccgucugcuacagcaagaucacguccguggaggccguggccaacuacagcgcgauccccaccaccaucggcggccugcgcuucgagcggucccacgacagccaggggaagaucuccggcagcccccucgacaucaccgccauccgcggguccuucagcgucaacuaccggggccugcgccugucccucagcgagaucacggcgaccugcaccggggaggugaccaacguguccggcugcuacagcugcaugaccggcgccaaggucuccaucaagcugcacagcuccaagaacagcacggcgcacgugcgcugcaagggggacgagaccgccuucuccgugcuggagggcguccacagcuacuccgugagccucagcuucgaccacgccguggucgacgagcagugccagcugaacugcgggggccacgagucccaggugacccugcgggggaaccucaucuuccuggacgugcccaaguucgucgacggcagcuacaugcagaccuaccacuccacggugccgaccggcgccaacauccccagccccaccgacuggcugaacgcccucuucgggaacggccugucccgcuggauccugggggucaucggcgugcuccugggcgggcuggcccucuucuuccugaucaugagccuguucaagcucggcaccaagcaggucuuccggucccgcacgaagcuggccuga

SEQ ID NO: 13167 - RNA, 3222 nt, Artificial Sequence
  derived and/or modified CDS sequence (opt1) from SFTSV(ZJZHSH-FDE/China/06/2012)__KR017859.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcgcccgugaagcugauguucgccaucaucaagaagcucaugcggagcguguccugccugaugggcaagcugauggaccgcgggcggcaggucauccacgaggagaucggcgagaaccgcgagggcaaccaggacgacgugcggaucgagauggugcgcccccgccggguccgccacuggauguacagcccggugauccucaccauccuggccaucgggcugacggagggcugcgacgagauggugcacgccgacuccaagcucgucagcugccggcagggguccggcaacaugaaggagugcgugaccaccgggcgcgcccugcugcccgcggugaaccccggccaggaggccugccuccacuucaccgcccccggcagcccggacagcaagugccugaagaucaaggucaagcggaucaaccugaagugcaagaaguccagcuccuacuucgugcccgacgcccgcagccggugcacguccgugcgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaagugggucgagaacccccacggcaucaucuggaaggugagccccugcgccgccugggugcccuccgccgucaucgagcugaccaugccgagcggggaggugcggaccuuccaccccauguccggcauccccacccagguguucaagggcgucagcgugacguaccugggguccgacauggaggugagcggccucaccgaccugugcgagaucgaggagcucaagagcaagaagcuggcgcuggcccccugcaaccaggccgggaugggcgucgugggcaaggugggggagauccagugcuccagcgaggaguccgcccgcaccaucaagaaggacggcugcaucuggaacgccgaccuggucgggaucgagcugcggguggacgacgcggugugcuacagcaagaucacguccgucgaggccguggccaacuacagcgccaucccgaccaccaucggcgggcuccgcuucgagcggucccacgacagccagggcaagaucuccggcagcccccuggacaucaccgccauccgcggguccuucagcgugaacuaccggggccugcgccucucccugagcgagaucacggcgaccugcaccggggaggucaccaacguguccggcugcuacagcugcaugaccggggccaagguguccaucaagcugcacagcuccaagaacagcacggcccacguccgcugcaagggcgacgagaccgccuucagcgugcucgagggcgugcacuccuacaccgucagccuguccuucgaccacgcggugguggacgagcagugccagcugaacugcgggggccacgagagccaggucacccucaaggggaaccugaucuuccuggacgugcccaaguucguggacggcuccuacaugcagacguaccacagcuccguccccaccggggccaacaucccgagccccaccgacuggcucaacgcccuguucggcaacggccugucccgguggauccucggggugaucggcguccugcucgggggccuggcccuguucuuccugaucaugagccucuucaagcugggcaccaagcaggucuuccgcucccggacgaagcuggccuga

SEQ ID NO: 13168 - RNA, 3222 nt, Artificial Sequence
  derived and/or modified CDS sequence (opt1) from SFTSV(ZJZHSH-FZHR/China/07/2013)__KR017862.1__GP
augaugaaggugaucugguucagcucccugaucugccucgugauccagugcggcggggacaccggccccaucaucugcgccgggccgauccacagcaacaagcgcgccggcaucccccaccuccugggguacuccgagaagaucugccagaucgaccggcugauccacgugagcuccuggcugcgcaaccacagccaguuccagggcuacgugggccagcgcgggggccggucccaggucagcuacuaccccgcggagaacuccuacagccggugguccgggcugcucagccccugcgacgccgacuggcugggcaugcugguggugaagaaggccaagggguccgacaugaucgucccgggccccagcuacaagggcaagguguucuucgagcgccccaccuucgacggguacgugggcugggggugcggcuccggcaagagccggacggaguccggggagcucugcagcuccgacagcggcaccagcuccgggcugcugcccagcgaccgcguccucuggaucggcgacguggccugccagccgaugacccccauccccgaggagaccuuccuggagcugaaguccuucagccaguccgaguuccccgacgugugcaagaucgacgggaucgucuucaaccagugcgagggcgagagccucccgcagcccuucgacguggccuggauggacgugggccacucccacaagaucaucaugcgggagcacaagacgaaguggguccaggagagcuccagcaaggacuucgugugcuacaaggaggggaccggccccugcuccgagagcgaggagaagaccugcaagaccuccgggagcugccgcggcgacaugcaguucugcaagguggcggggugcgagcacggcgaggaggccuccgaggccaagugccggugcagccugguccacaagcccggcgaggugguggucuccuacgggggcaugcgcgugcggccgaagugcuacggguucagccgcaugauggccacgcuggaggugaacccgcccgagcagcggaucggccagugcaccgggugccaccucgagugcaucaacggcggcguccgccugaucacccugaccuccgagcucaagagcgcgacggugugcgccagccacuucugcuccagcgccaccuccgggaagaaguccaccgagauccaguuccacuccggcagccuggucgggaagaccgccauccacgugaagggcgcccugguggacggcacggaguucaccuucgagggguccugcauguuccccgacggcugcgacgcggucgacugcaccuucugccgggaguuccucaagaacccccagugcuaccccgccaagaaguggcuguucaucaucaucgugauccugcucggguacgccggccugaugcugcucaccaacgugcugaaggccaucggggucuggggcagcugggugaucgcccccgugaagcuggucuucgcgaucaucaagaagcucaugcgcgccguguccugccugaugggcaagcugauggaccgggggcgccaggugauccacgaggagaucggcgagaaccgggaggggaaccaggacgacguccgcaucgagauggcccgcccccggcgcgugcggcacuggauguacagcccggugauccucacgauccuggccaucggccuggccgaggggugcgacgagaugguccacgcggacuccaagcucgugagcugccgccagggcuccggcaacaugaaggagugcgugaccaccgggcgggcccugcugcccgccgucaaccccggccaggaggccugccuccacuucaccgcccccgggagcccggacuccaagugccugaagaucaaggugaagcgcaucaaccugaagugcaagaaguccagcagcuacuucgugcccgacgcgcggagccgcugcacguccguccggcgcugccggugggccggcgacugccagagcgggugcccgccccacuucaccuccaacagcuucuccgacgacugggccggcaagauggaccgcgccggccucggguucagcggcugcuccgacgggugcggcggggcggccugcggcugcuucaacgccgcccccagcugcaucuucuggcggaaguggguggagaacccccacggcaucaucuggaaggugucccccugcgccgcgugggucccgagcgccgugaucgagcugaccaugcccuccggggaggugcgcaccuuccaccccaugagcggcauccccacgcaggucuucaaggggguguccgugaccuaccugggcagcgacauggaggucuccggccucaccgaccugugcgagaucgaggagcucaagagcaagaagcuggcccuggccccgugcaaccaggccgggaugggcgugguggggaaggucggcgagauccagugcuccagcgaggaguccgcgcggaccaucaagaaggacgggugcaucuggaacgccgaccuggugggcaucgagcugcgcguggacgacgccgucugcuacagcaagaucacgagcguggaggccguggccaacuacuccgcgauccccaccaccaucggcgggcuccgguucgagcgcagccacgacucccagggcaagaucagcgggagcccccuggacaucaccgccauccggggcagcuucuccgucaacuaccgcgggcugcgccucagccuguccgagaucacggcgaccugcaccggcgaggugaccaacgugagcggcugcuacuccugcaugaccggggccaaggucagcaucaagcugcacuccagcaagaacuccacggcccacgugcggugcaagggcgacgagaccgccuucagcgugcucgaggggguccacuccuacagcgugucccugagcuucgaccacgccguggucgacgagcagugccagcugaacugcggcgggcacgagagccaggugacccuccgcggcaaccugaucuuccuggacgugcccaaguucgucgacggcuccuacaugcagaccuaccacagcacggugccgaccggggccaacauccccucccccaccgacuggcucaacgcccuguucggcaacgggcugagccgguggauccucggcgucaucggcgugcugcucgggggccuggcgcuguucuuccugaucaugucccucuucaagcuggggaccaagcaggucuuccgcagccggacgaagcuggccuga

SEQ ID NO: 13169 - RNA, 3222 nt, Artificial Sequence
  derived and/or modified CDS sequence (opt1) from SFTSV(ZJZHSH-HCY/China/06/2012)__KR017855.1__GP
augaugaaggugaucugguuccccagccugaucugccucgugauccagugcuccggcgacaccgggccgaucaucugcgccggccccauccacagcaacaaguccgccaacaucccccaccuccugggguacagcgagaagaucugccagaucgaccgccugauccacguguccagcuggcugcggaaccacucccaguuccagggcuacguggggcagcgcggcggccggagccaggucuccuacuaccccgcggagaacagcuacucccgcuggagcgggcugcucuccccgugcgacgccgacuggcugggcaugcugguggugaagaaggccaaggggagcgacaugaucguccccggccccuccuacaaggggaagguguucuucgagcggcccaccuucgacggcuacgugggcugggggugcggcagcgggaagucccgcacggagagcggcgagcucugcuccagcgacagcggcaccuccagcgggcugcugccguccgaccggguccucuggaucggcgacguggccugccagcccaugacccccauccccgaggagaccuuccuggagcucaagagcuucucccagagcgaguucccggacaucugcaagaucgacgggaucguguucaaccagugcgaguccgagagccugccccagcccuucgacgucgccuggauggacgugggccacucccacaagaucaucaugcgcgagcacaagacgaagugggugcaggagagcuccagcaaggacuucgucugcuacaaggaggggaccggccccugcuccgagagcgaggagaagaccugcaagaccuccggcagcugccgcggggacaugcaguucugcaagguggcgggcugcgagcacggggaggaggccuccgaggccaagugccggugcagccuggugcacaagccgggcgaggucgugguguccuacgggggcaugcggguccgccccaagugcuacggcuucagccggaugauggccacgcuggaggugaacccgcccgagcagcgcaucgggcagugcaccggcugccaccucgagugcaucaacgggggcgugcggcuggucacccugaccagcgagcucaaguccgcgacggugugcgccagccacuucugcuccagcgccaccuccgggaagaaguccaccgagauccaguuccacuccggcagccuggucggcaaggccgccauccacgugaagggggcgcugguggacggcaccgaguucacguucgagggguccugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucugggggagcugggugaucgcgcccgugaagcugauguucgccaucaucaagaagcucaugcgguccgucagcugccugaugggcaagcugauggaccgcgggcgccaggugauccacgaggagaucggcgagaaccgggagggcaaccaggacgacgugcggaucgagaugguccgcccgcgccgggugcgccacuggauguacucccccgugauccucaccauccuggccaucgggcugacggagggcugcgacgagaugguccacgccgacagcaagcucguguccugccggcaggggagcggcaacaugaaggagugcgugaccaccgggcgcgcccugcugcccgcggucaaccccggccaggaggccugccuccacuucaccgccccgggcucccccgacagcaagugccugaagaucaaggugaagcggaucaaccugaagugcaagaaguccagcagcuacuucgugcccgacgcccgcucccggugcacgagcguccgccggugccgcugggccggggacugccaguccggcugcccgagccacuucaccuccaacagcuucuccgacgacugggcggggaagauggaccgggccggccucggguucagcggcugcuccgacggcugcgggggcgccgccugcgggugcuucaacgcggcccccagcugcaucuucuggcgcaaguggguggagaacccccacggcaucaucuggaaggugucccccugcgccgccugggucccgagcgccgugaucgagcugaccaugcccuccggggaggugcggaccuuccaccccaugagcggcauccccacgcaggucuucaagggcguguccgugaccuaccuggggagcgacauggaggucuccggccucaccgaccugugcgagaucgaggagcucaagagcaagaagcuggcgcuggccccgugcaaccaggccgggaugggcguggugggcaaggucggggagauccagugcagcuccgaggagagcgcccgcaccaucaagaaggacggcugcaucuggaacgccgaccugguggggaucgagcugcggguggacgacgcggucugcuacuccaagaucacgagcguggaggccguggccaacuacuccgccauccccaccaccaucggcgggcuccgcuucgagcggagccacgacucccagggcaagaucagcggcagcccccuggacaucaccgccauccgcgggagcuucuccgucaacuaccggggccugcgccucagccuguccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcucgagggcguccacagcuacaccgugucccugagcuucgaccacgcgguggucgacgagcagugccagcugaacugcgggggccacgagucccaggugacccucaaggggaaccugaucuuccuggacgugcccaaguucgucgacggcagcuacaugcagacguaccacuccagcgugccgaccggggccaacauccccucccccaccgacuggcucaacgcccuguucggcaacggccugagccgguggauccucggggucaucggcgugcugcucgggggccuggcccuguucuuccuguucaugucccucuucaagcugggcaccaagcaggucuuccgcagccggacgaagcuggccuga

SEQ ID NO: 13170 - RNA, 3222 nt, Artificial Sequence
  derived and/or modified CDS sequence (opt1) from SFTSV(ZJZHSH-HYC/China/05/2012)__KR017847.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcgcccgugaagcugauguucgccaucaucaagaagcucaugcggagcguguccugccugaugggcaagcugauggaccgcgggcggcaggucauccacgaggagaucggcgagaaccgcaagggcaaccaggacgacgugcggaucgagauggugcgcccccgccggguccgccacuggauguacagcccggugauccucaccauccuggccaucgggcugacggagggcugcgacgagauggugcacgccgacuccaagcucgucagcugccggcagggguccggcaacaugaaggagugcgugaccaccgggcgcgcccugcugcccgcggugaaccccggccaggaggccugccuccacuucaccgcccccggcagcccggacagcaagugccugaagaucaaggucaagcggaucaaccugaagugcaagaaguccagcuccuacuucgugcccgacgcccgcagccggugcacguccgugcgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaagugggucgagaacccccacggcaucaucuggaaggugagccccugcgccgccugggugcccuccgccgucaucgagcugaccaugccgagcggggaggugcggaccuuccaccccauguccggcauccccacccagguguucaagggcgucagcgugacguaccugggguccgacauggaggugagcggccucaccgaccugugcgagaucgaggagcucaagagcaagaagcuggcgcuggcccccugcaaccaggccgggaugggcgucgugggcaaggugggggagauccagugcuccagcgaggaguccgcccgcaccaucaagaaggacggcugcaucuggaacgccgaccuggucgggaucgagcugcggguggacgacgcggugugcuacagcaagaucacguccgucgaggccguggccaacuacagcgccaucccgaccaccaucggcgggcuccgcuucgagcggucccacgacagccagggcaagaucuccggcagcccccuggacaucaccgccauccgcggguccuucagcgugaacuaccggggccugcgccucucccugagcgagaucacggcgaccugcaccggggaggucaccaacguguccggcugcuacagcugcaugaccggggccaagguguccaucaagcugcacagcuccaagaacagcacggcccacguccgcugcaagggcgacgagaccgccuucagcgugcucgagggcgugcacuccuacaccgucagccuguccuucgaccacgcggugguggacgagcagugccagcugaacugcgggggccacgagagccaggucacccucaaggggaaccugaucuuccuggacgugcccaaguucguggacggcuccuacaugcagacguaccacagcuccguccccaccggggccaacaucccgagccccaccgacuggcucaacgcccuguucggcaacggccugucccgguggauccucggggugaucggcguccugcucgggggccuggcccuguucuuccugaucaugagccucuucaagcugggcaccaagcaggucuuccgcucccggacgaagcuggccuga

SEQ ID NO: 13171 - RNA, 3222 nt, Artificial Sequence
  derived and/or modified CDS sequence (opt1) from SFTSV(ZJZHSH-HYJ/China/07/2012)__KR017852.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaaggccgccauccacgucaagggggcgcugguggacggcaccgaguucacguucgaggggagcugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcgcccgugaagcugauguucgccaucaucaagaagcucaugcggagcguguccugccugaugggcaagcugauggaccgcgggcggcaggucauccacgaggagaucggcgagaaccgcgagggcaaccaggacgacgugcggaucgagauggugcgcccccgccggguccgccacuggauguacagcccggugauccucaccauccuggccaucgggcugacggagggcugcgacgagauggugcacgccgacuccaagcucgucagcugccggcagggguccggcaacaugaaggagugcgugaccaccgggcgcgcccugcugcccgcggugaaccccggccaggaggccugccuccacuucaccgcccccggcagcccggacagcaagugccugaaggucaaggugaagcggaucaaccugaagugcaagaaguccagcuccuacuucgugcccgacgcccgcagccggugcacguccguccgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaaguggguggagaacccccacggcaucaucuggaaggugagccccugcgccgccuggguccccuccgccgugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcucaagagcaagaagcuggcgcuggcccccugcaaccaggccgggaugggcguggugggcaaggucggggagauccagugcuccagcgaggaguccgcccgcaccaucaagaaggacggcugcaucuggaacgccgaccugguggggaucgagcugcggguggacgacgcggucugcuacagcaagaucacguccguggaggccguggccaacuacagcgccaucccgaccaccaucggcgggcuccgcuucgagcggucccacgacagccagggcaagaucuccggcagcccccuggacaucaccgccauccgcggguccuucagcgucaacuaccggggccugcgccucucccugagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcucgagggcguccacuccuacaccgugagccuguccuucgaccacgcgguggucgacgagcagugccagcugaacugcgggggccacgagagccaggugacccucaaggggaaccugaucuuccuggacgugcccaaguucgucgacggcuccuacaugcagacguaccacagcuccgugcccaccggggccaacaucccgagccccaccgacuggcucaacgcccuguucggcaacggccugucccgguggauccucggggucaucggcgugcugcucgggggccuggcccuguucuuccugaucaugagccucuucaagcugggcaccaagcaggucuuccgcucccggacgaagcuggccuga

SEQ ID NO: 13172 - RNA, 3222 nt, Artificial Sequence
  derived and/or modified CDS sequence (opt1) from SFTSV(ZJZHSH-LU/China/10/2011)__KR017850.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaugugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcuggucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugaucgcgcccgugaagcugauguucgccaucaucaagaagcucaugcggagcgucuccugccugaugggcaagcugauggaccgcgggcgccaggugauccacgaggagaucggcgagaaccgggagggcaaccaggacgacgugcggaucgagaugguccgcccccgccgggugcgccacuggauguacagcccggugauccucaccauccuggccaucgggcugacggagggcugcgacgagaugguccacgccgacuccaagcucgugagcugccggcagggguccggcaacaugaaggagugcgugaccaccgggcgcgcccugcugcccgcggucaaccccggccaggaggccugccuccacuucaccgcccccggcagcccggacagcaagugccugaagaucaaggugaagcggaucaaccugaagugcaagaaguccagcuccuacuucgugcccgacgcccgcagccggugcacguccguccgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaaguggguggagaacccccacggcaucaucuggaaggugagccccugcgccgccuggguccccuccgccgugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcucaagagcaagaagcuggcgcuggcccccugcaaccaggccgggaugggcguggugggcaaggucggggagauccagugcuccagcgaggaguccgcccgcaccaucaagaaggacggcugcaucuggaacgccgaccugguggggaucgagcugcggguggacgacgcggucugcuacagcaagaucacguccguggaggccguggccaacuacagcgccaucccgaccaccaucggcgggcuccgcuucgagcggucccacgacagccagggcaagaucuccggcagcccccuggacaucaccgccauccgcggguccuucagcgucaacuaccggggccugcgccucucccugagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcucgagggcguccacuccuacaccgugagccuguccuucgaccacgcgguggucgacgagcagugccagcugaacugcgggggccacgagagccaggugacccucaaggggaaccugaucuuccuggacgugcccaaguucgucgacggcuccuacaugcagacguaccacagcuccgugcccaccggggccaacaucccgagccccaccgacuggcucaacgcccuguucggcaacggccugucccgguggauccucggggucaucggcgugcugcucgggggccuggcccuguucuuccugaucaugagccucuucaagcugggcaccaagcaggucuuccgcucccggacgaagcuggccuga

SEQ ID NO: 13173 - RNA, 3222 nt, Artificial Sequence
  derived and/or modified CDS sequence (opt1) from SFTSV(ZJZHSH-SHZ/China/05/2012)__KR017848.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcuggucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugaucgcgcccgugaagcugauguucgccaucaucaagaagcucaugcggagcgucuccugccugaugggcaagcugauggaccgcgggcgccaggugauccacgaggagaucggcgagaaccgggagggcaaccaggacgacgugcggaucgagaugguccgcccccgccgggugcgccacuggauguacagcccggugauccucaccauccuggccaucgggcugacggagggcugcgacgagaugguccacgccgacuccaagcucgugagcugccggcagggguccggcaacaugaaggagugcgugaccaccgggcgcgcccugcugcccgcggucaaccccggccaggaggccugccuccacuucaccgcccccggcagcccggacagcaagugccugaagaucaaggugaagcggaucaaccugaagugcaagaaguccagcuccuacuucgugcccgacgcccgcagccggugcacguccguccgccggugccgcugggccggggacugccagagcggcugccccucccacuucaccagcaacuccuucagcgacgacugggcggggaagauggaccgggccggccucggguucuccggcugcagcgacggcugcgggggcgccgccugcgggugcuucaacgcggccccguccugcaucuucuggcgcaaguggguggagaacccccacggcaucaucuggaaggugagccccugcgccgccuggguccccuccgccgugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcucaagagcaagaagcuggcgcuggcccccugcaaccaggccgggaugggcguggugggcaaggucggggagauccagugcuccagcgaggaguccgcccgcaccaucaagaaggacggcugcaucuggaacgccgaccugguggggaucgagcugcggguggacgacgcggucugcuacagcaagaucacguccguggaggccguggccaacuacagcgccaucccgaccaccaucggcgggcuccgcuucgagcggucccacgacagccagggcaagaucuccggcagcccccuggacaucaccgccauccgcggguccuucagcgucaacuaccggggccugcgccucucccugagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcucgagggcguccacggguacaccgugucccugagcuucgaccacgcgguggucgacgagcagugccagcugaacugcggcgggcacgagucccaggugacccucaagggcaaccugaucuuccuggacgugcccaaguucgucgacgggagcuacaugcagacguaccacuccagcgugcccaccggcgccaacaucccgucccccaccgacuggcucaacgcccuguucggcaacgggcugagccgguggauccucggcgucaucggggugcugcugggcggccucgcccuguucuuccugaucaugucccucuucaagcuggggaccaagcaggucuuccgcagccggacgaagcuggccuga

SEQ ID NO: 13174 - RNA, 3222 nt, Artificial Sequence
  derived and/or modified CDS sequence (opt1) from SFTSV(ZJZHSH-WSH/China/08/2012)__KR017854.1__GP
augaugaaggugaucugguucagcucccugaucugccucgugauccagugcggcggggacaccggccccaucaucugcgccgggccgauccacagcaacaaguccgccggcaucccccaccuccugggguacagcgagaagaucugccagaucgaccgccugauccacguguccagcuggcugcggaaccacucccaguuccagggcuacgugggccagcgcgggggccggagccaggucuccuacuaccccgcggagaacagcuacucccgcuggagcgggcugcucucccccugcgacgccgacuggcugggcaugcugguggugaagaaggccaaggggagcgacaugaucgucccgggccccuccuacaagggcaagguguucuucgagcggcccaccuucgacggguacgugggcugggggugcggcagcggcaagucccgcacggagagcggggagcucugcuccagcgacagcggcaccuccagcgggcugcugcccuccgaccggguccucuggaucggcgacguggccugccagccgaugacccccauccccgaggagaccuuccuggagcucaagagcuucucccagagcgaguuccccgacgugugcaagaucgacgggaucgucuucaaccagugcgagggcgagucccugccgcagcccuucgacguggccuggauggacgugggccacagccacaagaucaucaugcgcgagcacaagacgaaguggguccaggaguccagcuccaaggacuucgugugcuacaaggaggggaccggccccugcagcgaguccgaggagaagaccugcaagaccagcggguccugccggggcgacaugcaguucugcaagguggcggggugcgagcacggcgaggaggccagcgaggccaagugccgcugcucccugguccagaagcccggcgaggugguggucagcuacgggggcaugcgggugcgcccgaagugcuacggguucucccggaugauggccacgcuggaggugaacccgcccgagcagcgcaucggccagugcaccgggugccaccucgagugcaucaacggcggcguccggcugaucacccugaccagcgagcucaagagcgcgacggugugcgccucccacuucugcagcuccgccaccagcgggaagaaguccaccgagauccaguuccacagcggcucccuggucgggaagaccgccauccacgugaagggcgcccugguggacggcacggaguucaccuucgaggggagcugcauguuccccgacggcugcgacgcggucgacugcaccuucugccgcgaguuccucaagaacccccagugcuaccccgccaagaaguggcuguucaucaucaucgugauccugcucggguacgccggccugaugcugcucaccaacgugcugaaggccaucggggucuggggcuccugggugaucgcccccgugaagcugauguucgcgaucaugaagaagcucaugcggagcgucuccugccugaugggcaagcugauggaccgcgggcgccaggugauccacgaggagaucggcgagaaccgggaggggaaccaggacgacgugcggaucgagaugguccgcccccgccgggugcgccacuggauguacagcccggugauccucacgauccuggccaucggccugaccgaggggugcgacgagaugguccacgccgacuccaagcucgugagcugccggcagggcuccggcaacaugaaggagugcgugaccaccgggcgcgcccugcugcccgccgucaaccccggccaggaggcgugccuccacuucacggcccccgggagcccggacuccaagugccugaagaucaaggugaagcggaucaaccugaagugcaagaaguccagcuccuacuucgugcccgacgcccgcagccggugcaccuccguccgccggugccgcugggccggcgacugccagagcgggugcccgccccacuucaccuccaacagcuucuccgacgacugggccggcaagauggaccgggcgggccucggguucagcggcugcuccgacgggugcggcggggccgccugcggcugcuucaacgccgcgcccagcugcaucuucuggcgcaaguggguggagaacccccacggcaucaucuggaaggugucccccugcgccgccugggucccgagcgccgugaucgagcugaccaugcccuccggggaggugcggacguuccaccccaugagcggcauccccacccaggucuucaaggggguguccgugaccuaccugggcagcgacauggaggucuccggccucaccgaccugugcgagaucgaggagcucaagagcaagaagcuggcccuggcgccgugcaaccaggccgggaugggcgugguggggaaggucggcgagauccagugcuccagcgaggagagcgcccgcacgaucaagaaggacgggugcaucuggaacgccgaccuggugggcaucgagcugcggguggacgacgccgucugcuacuccaagaucaccagcguggaggcgguggccaacuacuccgccauccccaccaccaucggcgggcuccgcuucgagcggagccacgacucccagggcaagaucagcgggagcccccuggacaucacggccauccgcggcagcuucuccgucaacuaccgggggcugcgccucagccuguccgagaucaccgcgaccugcaccggcgaggugaccaacgugagcggcugcuacuccugcaugacgggggccaaggucagcaucaagcugcacuccagcaagaacuccaccgcccacgugcgcugcaagggcgacgagaccgccuucagcgugcucgaggggguccacuccuacagcgugagccuguccuucgaccacgccguggucgacgagcagugccagcugaacugcggcgggcacgagagccaggugacccuccggggcaaccugaucuuccuggacgugcccaaguucgucgacggcuccuacaugcagacguaccacagcaccgugccgaccggggcgaacauccccucccccaccgacuggcucaacgcccuguucggcaacgggcugagccgcuggauccucggcgucaucggcgugcugcucgggggccuggcccuguucuuccugaucaugucccucuucaagcuggggacgaagcaggucuuccggagccgcaccaagcuggccuga

SEQ ID NO: 13175 - RNA, 3222 nt, Artificial Sequence
  derived and/or modified CDS sequence (opt1) from SFTSV(ZJZHSH-XAM/China/06/2012)__KR017853.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcuggucacccugaccuccgagcucaagagcgcgacggugugcgccucccacuucugcagcuccgccaccagcgggaagaaguccaccgagauccaguuccacagcggcucccuggucggcaaggccgccauccacgugaagggggcgcugguggacggcaccgaguucacguucgaggggagcugcauguuccccgacggcugcgacgccgucgacugcaccuucugccgcgaguuccucaagaacccccagugcuaccccgccaagaaguggcuguucaucaucaucgugauccugcucggcuacgccgggcugaugcugcucaccaacgugcugaaggccaucggcgucuggggguccugggugaucgcgcccgugaagcuggucuucgccaucaucaagaagcucaugcgggccgugagcugccugaugggcaagcugauggaccgcgggcgccaggugauccacgaggagaucggcgagaaccgggagggcaaccaggacgacguccggaucgagauggcccgcccccgccgggugcgccacuggauguacuccccggugauccucaccauccuggccaucgggcuggcggagggcugcgacgagaugguccacgccgacagcaagcucguguccugccggcaggggagcggcaacaugaaggagugcgugacgaccgggcgcgcccugcugcccgccgucaaccccggccaggaggccugccuccacuucaccgcgcccggcuccccggacagcaagugccugaagaucaaggugaagcggaucaaccugaagugcaagaaguccuccagcuacuucgugcccgacgcccgcucccggugcaccagcguccgccggugccgcugggccggggacugccaguccggcugccccagccacuucacguccaacagcuucuccgacgacugggccgggaagauggaccgggcgggccucggguucagcggcugcuccgacggcugcgggggcgccgccugcgggugcuucaacgccgccccgagcugcaucuucuggcgcaaguggguggagaacccccacggcaucaucuggaaggugucccccugcgcggccuggguccccagcgccgugaucgagcugaccaugccguccggggaggugcggaccuuccaccccaugagcggcauccccacccaggucuucaagggcguguccgugacguaccuggggagcgacauggaggucuccggccucaccgaccugugcgagaucgaggagcucaagagcaagaagcuggcccuggcccccugcaaccaggcggggaugggcguggugggcaaggucggggagauccagugcagcuccgaggagagcgcccgcaccaucaagaaggacggcugcaucuggaacgccgaccugguggggaucgagcugcggguggacgacgccgucugcuacuccaagaucaccagcguggaggccguggcgaacuacuccgccaucccgacgaccaucggcgggcuccgcuucgagcggagccacgacucccagggcaagaucagcggcagcccccuggacaucaccgccauccgcgggagcuucuccgucaacuaccggggccugcgccucagccuguccgagaucaccgccacgugcaccggggaggugaccaacgugagcggcugcuacuccugcaugaccggggcgaaggucagcaucaagcugcacuccagcaagaacuccaccgcccacgugcgcugcaagggcgacgagacggccuucagcgugcucgagggcguccacagcuacaccgugucccugagcuucgaccacgccguggucgacgagcagugccagcugaacugcgggggccacgagucccaggugacccucaaggggaaccugaucuuccuggacgugcccaaguucgucgacggcagcuacaugcagaccuaccacuccagcgugcccacgggggccaacaucccgucccccaccgacuggcucaacgcgcuguucggcaacggccugagccgguggauccucggggucaucggcgugcugcucgggggccuggcccuguucuuccugaucaugucccucuucaagcugggcaccaagcaggucuuccgcagccggaccaagcuggccuga

SEQ ID NO: 13176 - RNA, 3222 nt, Artificial Sequence
  derived and/or modified CDS sequence (opt1) from SFTSV(ZJZHSH-YJX/China/06/2012)__KR017860.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgacgccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcuccgcagcgcgacggucugcgccucccacuucugcagcuccgccaccagcgggaagaaguccaccgagauccaguuccacagcggcucccuggugggcaagaccacgauccacgucaagggggcccugguggacggcaccgaguucaccuucgaggggagcugcauguuccccgacggcugcgacgccguggacugcaccuucugccgggaguuccucaagaacccccagugcuaccccgcgaagaaguggcuguucaucaucaucgucauccugcucggcuacgccgggcugaugcugcucacgaacgugcugaaggccaucggcguguggggguccugggucaucgcccccgugaagcugauguucgccaucaucaagaagcucaugcgcagcguguccugccugaugggcaagcugauggaccgggggcgccaggucauccacgaggagaucggcgagaaccgggagggcaaccaggacgacgugcgcaucgagauggcgcgcccccggcgcgugcggcacuggauguacagcccggucauccucaccauccuggccaucgggcuggccgagggcugcgacgagauggugcacgccgacuccaagcucgugagcugcaagcaggccuccgggaacaugaaggagugcgucaccaccggccgcgcgcugcugcccgccgugaaccccgggcaggaggccugccuccacuucacggcccccggcagcccggacagcaagugccugaagaucaaggugaagcggaucaaccugaagugcaagaaguccagcuccuacuucguccucgacgcccgcagccggugcaccuccgugcgccggugccgcugggcgggcgacugccagagcgggugccccucccacuucaccagcaacuccuucagcgacgacugggccggcaagauggaccgggccgggcugggcuucuccgggugcagcgacggcugcggcggggccgcgugcggcugcuucaacgccgcccccuccugcaucuucuggcgcaaguggguggagaacccgcacgggaucaucuggaaggucagccccugcgccgccugggugcccuccgcggugaucgagcugaccaugcccagcggcgagguccggacguuccacccgauguccgggauccccacccagguguucaagggcgugagcgucaccuaccucggcuccgacauggaggugagcgggcugaccgaccugugcgagaucgaggagcucaagagcaagaagcuggcccuggcccccugcaaccaggccggcauggggguggucggcaaggugggcgagauccagugcuccagcgaggaguccgcccgcacgaucaagaaggacgggugcaucuggaacgcggaccuggugggcaucgagcuccgggucgacgacgccgugugcuacagcaagaucaccuccguggaggccgucgccaacuacagcgccauccccaccaccaucgggggccugcgcuucgagcggucccacgacagccaggggaagaucuccggcagcccgcuggacaucacggcgauccgcggcuccuucagcgugaacuaccgggggcuccgccugucccugagcgaggugaccgcgaccugcaccggcgaggucaccaacguguccgggugcuacagcugcaugacgggcgccaagguguccaucaagcuccacagcuccaagaacagcaccgcccacguccgcugcaagggggacgagaccgccuucagcgugcuggagggcgugcacuccuacaccgucagccuguccuucgaccacgccgugguggacgagcagugccagcucaacugcggcgggcacgagagccaggucacgcugaagggcaaccugaucuuccucgacgugcccaaguucguggacggguccuacaugcagaccuaccacagcuccguccugaccggcgccaacauccccagccccaccgacuggcugaacgcccucuucgggaacggccuguccaaguggauccugggcgugaucgggguccuccugggcgggcuggcccucuucuuccugaucaugagccuguucaagcucggcacgaagcagaucuuccggucccgcaccaagcuggcguga

SEQ ID NO: 13177 - RNA, 3222 nt, Artificial Sequence
  derived and/or modified CDS sequence (opt1) from SFTSV(SPL003A)__AB817988.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacucccccgagcagcgcaucgggcagugcaccggcugccaccucgagugcaucaacgggggcgugcggcugaucacccugaccagcgagcucaaguccgcgacggucugcgccagccacuucugcuccagcgccaccuccgggaagaaguccaccgagauccaguuccacagcggcagccuggugggcaagaccgccauccacgucaagggggcccugguggacggcacggaguucaccuucgagggguccugcauguuccccgacggcugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugauguucgcgaucaucaagaagcucaugcgguccgugagcugccugaugggcaagcugauggaccgcgggcggcaggucauccacgaggagaucggcgagaaccgcgagggcaaccaggacgacgugcggaucgagauggcccgcccccgccgggugcgccacuggauguacucccccgucauccucacgauccuggccaucgggcuggccgagggcugcgacgagauggugcacgccgacagcaagcucguguccugcaagcaggggagcggcaacaugaaggagugcgucaccaccgggcgggcgcugcugccggccgugaaccccggccaggaggccugccuccacuucaccgcccccggcagccccgacuccaagugccugaagaucaaggugaagcgcaucaaccugaagugcaagaaguccagcagcuacuucgucccggacgcccggucccgcugcacgagcgugcggcgcugccggugggcgggggacugccaguccggcugccccagccacuucaccuccaacagcuucuccgacgacugggccgggaagauggaccgcgccggccucggguucagcggcugcuccgacggcugcgggggcgccgcgugcgggugcuucaacgccgcccccagcugcaucuucuggcggaaguggguggagaacccgcacggcaucaucuggaaggucucccccugcgccgccugggugcccagcgcggugaucgagcugaccaugcccuccggggagguccgcaccuuccacccgaugagcggcauccccacccagguguucaagggcguguccgucaccuaccuggggagcgacauggaggugagcggccucaccgaccugugcgagaucgaggagcugaaguccaagaagcuggcccucgcccccugcaaccaggccgggaugggcguggucggcaaggugggggagauccagugcagcuccgaggagagcgcccggaccaucaagaaggacggcugcaucuggaacgcggaccugguggggaucgagcugcgcgucgacgacgccgugugcuacuccaagaucacgagcguggaggccgucgccaacuacuccgccauccccaccaccaucggcgggcuccgguucgagcgcagccacgacucccagggcaagaucagcggcuccccgcuggacaucaccgcgauccgggggagcuucuccgugaacuaccgcggccugcggcucagccuguccgagaucacggccacgugcaccggggaggugaccaacgucagcggcugcuacuccugcaugaccggggcccgcgugagcaucaagcugcacuccagcaagaacagcacggcccacgugcgcugcaagggcgacgagaccgcguucuccguccucgagggcgugcacagcuacaccgugucccugagcuucgaccacgccgucguggacgagcagugccagcugaacugcgggggccacgagucccaggugacccucaaggggaaccugaucuuccuggacguccccaaguucguggacggcagcuacaugcagacguaccacuccagcgugcccaccggggccaacauccccuccccgaccgacuggcucaacgcccuguucggcaacggccugagccgguggauccucggggucaucggcgugcugcucgggggccuggcccuguucuuccugaucaugucccucuucaagcugggcaccaagcaggucuuccgcagccggacgaagcuggcguga

SEQ ID NO: 13178 - RNA, 3222 nt, Artificial Sequence
  derived and/or modified CDS sequence (opt1) from SFTSV(SPL004A)__AB817989.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucuccgggggcgugcggcugaucacccugaccagcgagcucaaguccgcgacggucugcgccagccacuucugcuccagcgccaccuccgggaagaaguccaccgagauccaguuccacuccggcagccuggugggcaaggccgccauccacgucaagggggcgcugguggacggcaccgaguucacguucgagggguccugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcgugugggggagcugggucaucgcgcccgugaagcugauguucgccaucaugaagaagcucaugcgguccgugagcugccugaugggcaagcugauggaccgcgggcggcaggucauccacgaggagaucggcgagaaccgcgagggcaaccaggacgacgugcggaucgagauggcccgcccccgccgggugcgccacuggauguacuccccggucauccucaccauccuggccaucgggcuggccgagggcugcgacgagauggugcacgcggacagcaagcucguguccugccggcaggggagcggcaacaugaaggagugcgucacgaccgggcgcgcccugcugcccgccgugaaccccggccaggaggccugccuccacuucaccgcccccggcagcccggacuccaagugccugaagaucaaggugaagcggaucaaccugaagugcaagaaguccagcagcuacuucguccccgacgcgcgcucccggugcaccagcgugcgccggugccgcugggccggggacugccaguccggcugccccagccacuucacguccaacagcuucuccgacgacugggccgggaagauggaccgggccggccucggguucagcggcugcuccgacggcugcgggggcgcggccugcgggugcuucaacgccgccccgagcugcaucuucuggcgcaaguggguggagaacccccacggcaucaucuggaaggucucccccugcgccgcgugggugcccagcgccgugaucgagcugaccaugccguccggggagguccggaccuuccaccccaugagcggcauccccacccagguguucaagggcguguccgucacguaccuggggagcgacauggaggugagcggccucaccgaccugugcgagaucgaggagcugaaguccaagaagcuggcccucgcccccugcaaccaggccgggaugggcguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgaucccgacgaccaucggcgggcuccgcuucgagcggagccacgacucccagggcaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggggccaaggugagcaucaagcugcacuccagcaagaacagcaccgcgcacgugcgcugcaaggaggacgagacggccuucuccguccucgagggcgugcacagcuacaccgugucccugagcuucgaccacgccgucguggacgagcagugccagcugaacugcggcgggcacgagucccacgugacccucaagggcaaccugaucuuccuggacguccccaaguucguggacgggagcuacaugcagaccuaccacuccagcgugcccacgggcgccaacaucccgucccccaccgacuggcucaacgcccuguucgggaacggccugagccgguggauccucggcgucaugggggugcugcugggcgggcucgcgcuguucuuccugaucaugucccucuucaagcugggcaccaagcaggucuuccgcagccggaccaagcuggccuga

SEQ ID NO: 13179 - RNA, 3222 nt, Artificial Sequence
  derived and/or modified CDS sequence (opt1) from SFTSV(SPL005A)__AB817990.1__GP
augaugaaggugaucugguucagcucccugaucugccucgucauccagugcagcggcgacgccucccccaucaucugcgccgggccgauccacagcaacaaguccgcgaacaucccccaccuccugggcuacagcgagaagaucugccagaucgaccgccucauccacguguccagcuggcugcggaaccacucccaguuccagggguacgugggccagcgcgggggccggagccaggucuccuacuuccccgccgagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggguacgugggcuggggcugcgggagcggcaagucccgcaccgagagcggggagcucugcagcuccgacagcggcacguccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgaguccgagagccucccgcagccccuggacgucgcguggauggacguggggcacucccacaagaucaucaugcgcgagcacaagaccaagugggugcaggagagcuccagcaaggacuucgucugcuacaaggagggcacggggcccugcuccgagagcgaggagaagaccugcaagaccuccggcagcugccggggcgacaugcaguucugcaagguggccgggugcgagcacggcgaggaggccuccgaggccaagugccgcugcagccuggugcacaagcccggggaggucguggugagcuacggcgggaugcggguccgcccgaagugcuacggcuucucccggaugauggcgacccucgaggugaacccccuggagcagcgcaucggccagugcacggggugccaccuggagugcaucaacggcggggugcggcucaucacccugaccagcgagcugaaguccgccaccgucugcgccagccacuucugcuccagcgccacguccggcaagaaguccaccgagauccaguuccacagcgggagccucgugggcaagaccgccauccacgucaagggcgcgcugguggacgggaccgaguucacguucgagggcuccugcauguuccccgacgggugcgacgccguggacugcaccuucugccgcgaguuccugaagaacccccagugcuacccggccaagaaguggcuguucaucaucaucgucauccugcugggcuacgccggccucaugcugcugaccaacgugcucaaggccaucgggguguggggcagcugggucaucgcgcccgugaagcugauguucgccaucaucaagaagcugaugcgguccgugagcugccucauggggaagcugauggaccgcggccggcaggucauccacgaggagaucggggagaaccgcgagggcaaccaggacgacgugcggaucgagauggcccgcccccgccgggugcgccacuggauguacucccccgucauccugaccauccucgccaucggccuggccgaggggugcgacgagauggugcacgcggacagcaagcugguguccugcaagcagggcgggggcaacaugaaggagugcgucacgaccgggcgggcccuccugccggccgugaaccccggccaggaggccugccugcacuucaccgcccccggcagccccgacagcaagugccucaagaucaaggugaagcgcaucaaccugaagugcaagaaguccagcuccuacuucgucccggacgcgcggagccgcugcaccuccgugcggcgcugccggugggccggggacugccagagcggcugccccucccacuucacgagcaacuccuucagcgacgacugggccgggaagauggaccgcgccggccugggguucuccggcugcagcgacggcugcgggggcgcggccugcgggugcuucaacgccgcccccuccugcaucuucuggcggaaguggguggagaacccgcacggcaucaucuggaaggucagccccugcgccgcgugggugcccuccgccgugaucgagcucaccaugcccagcggggagguccgcaccuuccacccgauguccggcauccccacccagguguucaagggcgugagcgucacguaccugggguccgacauggaggugagcggccugaccgaccugugcgagaucgaggagcucaagagcaagaagcuggcccuggcccccugcaaccaggccgggaugggcguggucggcaaggugggggagauccagugcuccagcgaggaguccgcgcggaccaucaagaaggacggcugcaucuggaacgccgaccucguggggaucgagcugcgcgucgacgacgccgugugcuacagcaagaucaccuccguggaggccgucgccaacuacagcgcgauccccacgaccaucggcgggcugcgguucgagcgcucccacgacagccagggcaagaucuccggcagcccgcucgacaucaccgccauccggggguccuucagcgugaacuaccgcggccugcggcugucccucagcgagaucaccgccacgugcaccggggaggugaccaacgucuccggcugcuacagcugcaugaccggggccaagguguccaucaagcugcacagcuccaagaacagcaccgcgcacgugcgcugcaagggcgacgagacggccuucagcguccuggagggcgugcacuccuacaccgugagccucuccuucgaccacgccgucguggacgagcagugccagcugaacugcgggggccacgagagccaggugacccugaaggggaaccucaucuuccuggacguccccaaguucguggacggcuccuacaugcagaccuaccacagcuccgugcccacgggggccaacauccccagcccgaccgacuggcugaacgcccucuucggcaacggccugucccgcuggauccugggggucaucggcgugcuccucgggggccuggcgcuguucuuccugaucaugagccuguucaagcugggcaccaagcaggucuuccggucccgcaccaagcuggccuga

SEQ ID NO: 13180 - RNA, 3222 nt, Artificial Sequence
  derived and/or modified CDS sequence (opt1) from SFTSV(SPL010A)__AB817991.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacucccccgagcagcgcaucgggcagugcaccggcugccaccucgagugcaucaacgggggcgugcggcugaucacccugaccagcgagcucaaguccgcgacggucugcgccagccacuucugcuccagcgccaccuccgggaagaaguccaccgagauccaguuccacagcggcagccuggugggcaagaccgccauccacgucaagggggcccugguggacggcacggaguucaccuucgagggguccugcauguuccccgacggcugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugauguucgcgaucaucaagaagcucaugcgguccgugagcugccugaugggcaagcugauggaccgcgggcggcaggucauccacgaggagaucggcgagaaccgcgagggcaaccaggacgacgugcggaucgagauggcccgcccccgccgggugcgccacuggauguacucccccgucauccucacgauccuggccaucgggcuggccgagggcugcgacgagauggugcacgccgacagcaagcucguguccugcaagcaggggagcggcaacaugaaggagugcgucaccaccgggcgggcgcugcugccggccgugaaccccggccaggaggccugccuccacuucaccgcccccggcagccccgacuccaagugccugaagaucaaggugaagcgcaucaaccugaagugcaagaaguccagcagcuacuucgucccggacgcccggucccgcugcacgagcgugcggcgcugccggugggcgggggacugccaguccggcugccccagccacuucaccuccaacagcuucuccgacgacugggccgggaagauggaccgcgccggccucggguucagcggcugcuccgacggcugcgggggcgccgcgugcgggugcuucaacgccgcccccagcugcaucuucuggcggaaguggguggagaacccgcacggcaucaucuggaaggucucccccugcgccgccugggugcccagcgcggugaucgagcugaccaugcccuccggggagguccgcaccuuccacccgaugagcggcauccccacccagguguucaagggcguguccgucacguaccuggggagcgacauggaggugagcggccucaccgaccugugcgagaucgaggagcugaaguccaagaagcuggcccucgcccccugcaaccaggccgggaugggcguggucggcaaggugggggagauccagugcagcuccgaggagagcgcccggaccaucaagaaggacggcugcaucuggaacgcggaccugguggggaucgagcugcgcgucgacgacgccgugugcuacuccaagaucacgagcguggaggccgucgccaacuacuccgccauccccaccaccaucggcgggcuccgguucgagcgcagccacgacucccagggcaagaucagcggcuccccgcuggacaucaccacgauccgggggagcuucuccgugaacuaccgcggccugcggcucagccuguccgagaucaccgcgaccugcaccggggaggugaccaacgucagcggcugcuacuccugcaugacgggggcccgcgugagcaucaagcugcacuccagcaagaacagcaccgcccacgugcgcugcaagggcgacgagaccgccuucuccguccucgagggcgugcacagcuacaccgugucccugagcuucgaccacgcggucguggacgagcagugccagcugaacugcgggggccacgagucccaggugacgcucaaggggaaccugaucuuccuggacguccccaaguucguggacggcagcuacaugcagaccuaccacuccagcgugcccaccggggccaacauccccuccccgaccgacuggcucaacgcccuguucggcaacggccugagccgguggauccucggggucaucggcgugcugcucgggggccuggcccuguucuuccugaucaugucccucuucaagcugggcacgaagcaggucuuccgcagccggaccaagcuggccuga

SEQ ID NO: 13181 - RNA, 3222 nt, Artificial Sequence
  derived and/or modified CDS sequence (opt1) from SFTSV(SPL030A)__AB817992.1__GP
augaugaaggugaucugguucagcucccugaucugccucgucauccagugcagcggcgacaccucccccaucaucugcgccgggccgauccacagcaacaaguccgccagcaucccccaccuccugggcuacuccgagaagaucugccagaucgaccgccucauccacgugagcuccuggcugcggaaccacagccaguuccagggguacgugggccagcgcgggggccggucccaggucagcuacuuccccgcggagaacuccuacagccgcugguccggccugcucagccccugcgacgccgacuggcuggggaugcugguggugaagaaggccaagggcuccgacaugaucgucccggggcccagcuacaagggcaagguguucuucgagcggcccaccuucgacggguacgugggcuggggcugcggguccggcaagagccgcacggagagcggggagcucugcuccagcgacuccggcaccagcuccggccugcugcccagcgaccggguccucuggaucggggacguggccugccagccgaugacccccauccccgaggagaccuuccuggagcugaaguccuucagccaguccgaguuccccgacaucugcaagaucgacggcaucguguucaaccagugcgagagcgagucccucccgcagccccuggacgucgccuggauggacguggggcacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccggggcgacaugcaguucugcaagguggcggggugcgagcacggcgaggaggccagcgaggccaagugccgcugcagccuggugcacaagcccggggaggucgugguguccuacggcgggaugcggguccgcccgaagugcuacggcuucagccggaugauggccacgcucgaggugaacccgcccgagcugcgcaucggccagugcaccgggugccaccuggagugcaucaacggcggggugcggcucaucacccugaccuccgagcucaagagcgcgacggucugcgccucccacuucugcagcuccgccaccagcggcaagaaguccaccgagauccaguuccacagcgggucccuggugggcaagaccgccauccacgucaagggcgcccugguggacgggacggaguucaccuucgagggcagcugcauguuccccgacgggugcgacgcgguggacugcaccuucugccgcgaguuccugaagaacccccagugcuaccccgccaagaaguggcuguucaucaucaucgucauccugcugggcuacgccggccucaugcugcugaccaacgugcucaaggccaucgggguguggggcuccugggucaucgcccccgugaagcugauguucgcgaucaucaagaagcugaugcggagcguguccugccucauggggaagcugauggaccgcggccggcaggucauccacgaggagaucggggagaaccgcgagggcaaccaggacgacgugcggaucgagauggcccgcccccgccgggugcgccacuggauguacagcccggucauccugacgauccucgccaucggccuggccgaggggugcgacgagauggugcacgccgacuccaagcuggugagcugcaagcagggcgggggcaacaugaaggagugcgucaccaccgggcgggcgcuccugcccgccgugaaccccggccaggaggccugccugcacuucaccgcccccggcagcccggacuccaagugccucaagauccgcgugaagcggaucaaccugaagugcaagaaguccagcagcuacuucguccccgacgcccgcucccggugcacgagcgugcgccggugccgcugggcgggggacugccaguccggcugccccagccacuucaccuccaacagcuucuccgacgacugggccgggaagauggaccgggccggccugggguucagcggcugcuccgacggcugcgggggcgccgcgugcgggugcuucaacgccgccccgagcugcaucuucuggcgcaaguggguggagaacccccacggcaucaucuggaaggucucccccugcgccgccugggugcccagcgcggugaucgagcucaccaugccguccggggagguccggaccuuccaccccaugagcggcauccccacccagguguucaagggcguguccgucaccuaccuggggagcgacauggaggugagcggccugaccgaccugugcgagaucgaggagcucaaguccaagaagcuggcccuggcccccugcaaccaggccgggaugggcguggucggcaaggugggggagauccagugcaacagcgaggaguccgcccgcaccaucaagaaggacggcugcaucuggaacgcggaccucguggggaucgagcugcgggucgacgacgccgugugcuacagcaagaucacguccguggaggccgucgccaacuacagcgccaucccgaccaccaucggcgggcugcgcuucgagcggucccacgacagccagggcaagaucuccggcagcccccucgacaucaccgcgauccgcggguccuucagcgugaacuaccggggccugcgccugucccucagcgagaucacggccacgugcaccggggaggugaccaacgucuccggcugcuacagcugcaugaccggggccaagguguccaucaagcugcacagcuccaagaacagcacggcccacgugcgcugcaagggcgacgagaccgcguucagcguccuggagggcgugcacuccuacaccgugagccucuccuucgaccacgccgucguggacgagcagugccagcugaacugcgggggccacgagagccaggugacccugaaggggaaccucaucuuccuggacguccccaaguucguggacggcuccuacaugcagacguaccacagcuccgugcccaccggggccaacaucccgagccccaccgacuggcugaacgcccucuucggcaacggccugucccgguggauccugggggucaucggcgugcuccucgggggccuggcccuguucuuccugaucaugagccuguucaagcucggcaccaagcaggucuuccgcucccggacgaagcuggcguga

SEQ ID NO: 13182 - RNA, 3222 nt, Artificial Sequence
  derived and/or modified CDS sequence (opt1) from SFTSV(SPL053A)__AB985292.1__GP
augaugaaggugaucugguucagcucccugaucugccucgucauccagugcagcggcgacaccgggcccaucaucugcgccggcccgauccacuccaacaagggggccaacaucccccaccuccugggcuacagcgagaagaucugccagaucgaccgccugauccacguguccagcuggcugcggaaccacucccaguuccagggguacgugggccagcgcggcgggcggagccaggucuccuacuuccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcaucuccgacagcgggaccagcuccggccugcugcccagcgaccggguccucuggaucggggacguggccugccagccgaugacccccauccccgaggagaccuuccuggagcugaaguccuucagccaguccgaguuccccgacaucugcaagaucgacggcaucguguucaaccagugcgagagcgagucccucccgcagcccuucgacgucgccuggauggacguggggcacagccacaagaucaucaugcgcgagcacaagacgaagugggugcaggaguccagcuccaaggacuucgucugcuacaaggagggcaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggguccgcccgaagugcuacggguucucccggaugauggccacgcuggaggugaacagccccgagcagcgcaucggccagugcaccgggugccaccucgagugcaucaacggcggggugcggcugaucacccugaccagcgagcucaaguccgcgacggucugcgccagccacuucugcuccagcgccaccuccggcaagaaguccaccgagauccaguuccacagcggcagccugguggggaagaccgccauccacgucaagggcgcccugguggacgggacggaguucaccuucgagggcuccugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggguguggggcagcugggucaucgcccccgugaagcugauguucgcgaucaucaagaagcucaugcgguccgugagcugccugauggggaagcugauggaccgcggccggcaggucauccacgaggagaucggcgagaaccgcgaggggaaccaggacgacgugcggaucgagauggcccgcccccgccgggugcgccacuggauguacucccccgucauccucacgauccuggccaucggccuggccgaggggugcgacgagauggugcacgccgacagcaagcucguguccugcaagcagggcagcgggaacaugaaggagugcgucaccaccggccgggcgcugcugccggccgugaaccccggccaggaggccugccuccacuucaccgcccccgggucccccgacagcaagugccugaagaucaaggugaagcgcaucaaccugaagugcaagaaguccagcagcuacuucgucccggacgcccggucccgcugcacgagcgugcggcgcugccggugggcgggcgacugccaguccgggugccccagccacuucaccuccaacagcuucuccgacgacugggccggcaagauggaccgcgccgggcucggcuucagcggcugcuccgacgggugcggcggggccgcgugcggcugcuucaacgccgcccccagcugcaucuucuggcggaaguggguggagaacccgcacgggaucaucuggaaggucucccccugcgccgccugggugcccagcgcggugaucgagcugaccaugcccuccggcgagguccgcaccuuccacccgaugagcggcauccccacccagguguucaaggggguguccgucaccuaccugggcagcgacauggagguguccgggcucaccgaccugugcgagaucgaggagcucaagagcaagaagcuggcccuggcccccugcaaccaggccggcaugggcguggucgggaaggugggcgagauccagugcagcuccgaggagagcgcccggaccaucaagaaggacgggugcaucuggaacgcggaccuggugggcaucgagcugcgcgucgacgacgccgugugcuacuccaagaucacgagcguggaggccgucgccaacuacuccgccauccccaccaccaucgggggccuccgguucgagcgcagccacgacucccagggcaagaucagcggguccccgcuggacaucaccgcgauccggggcagcuucuccgugaacuaccgcgggcugcggcucagccuguccgagaucacggccacgugcaccggcgaggugaccaacgucagcgggugcuacuccugcaugaccggcgcccgcgugagcaucaagcugcacuccagcaagaacuccacggcccacgugcgcugcaagggcgacgagaccgcguucagcguccucgagggggugcacagcuacaccgugucccugagcuucgaccacgccgucguggacgagcagugccagcugaacugcggcgggcacgagucccaggugacccucaagggcaaccugaucuuccuggacguccccaaguucguggacgggagcuacaugcagacguaccacuccagcgugcccaccggcgccaacauccccuccccgaccgacuggcucaacgcccuguucggcaacgggcugagccgguggauccucggcgucaucggggugcugcugggcggccucgcccuguucuuccugaucaugucccucuucaagcuggggaccaagcaggucuuccgcagccggacgaagcuggcguga

SEQ ID NO: 13183 - RNA, 3222 nt, Artificial Sequence
  derived and/or modified CDS sequence (opt1) from SFTSV(SPL054A)__AB985293.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccucauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuucauggagcugaaguccuucagccaguccgaguuccccgacaucugcaagaucgacgggaucguguucaaccagugcgagagcgagucccugccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccucgugcacaagcccggcgaggucguggugagcuacgggggcaugcggguccgcccgaagugcuacggcuucagccggaugauggccacgcuggaggugaacccgcccgagcagcgcaucgggcagugcaccggcugccaccuggagugcaucaacgggggcgugcggcucaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccugaagaacccccagugcuaccccgccaagaaguggcuguucaucaucaucgucauccugcugggcuacgccgggcucaugcugcugaccaacgugcucaaggccaucggcguguggggguccugggucaucgcccccgugaagcugauguucgcgaucaucaagaagcugaugcggagcguguccugccucaugggcaagcugauggaccgcgggcggcaggucauccacgaggagaucggcgagaacggcgaggggaaccaggacgacgugcgcaucgagaucgcccggccccgccgcgugcggcacuggauguacagcccggucauccugacgauccucgccaucggccuggccgaggggugcgacgagauggugcacgccgacuccaagcuggugagcugcaagcagggcuccgggaacaugaaggagugcgucaccaccggccgcgcgcuccugcccgccgugaaccccggccaggaggccugccugcacuucaccgcccccgggagcccggacagcaagugccucaagaucaaggugaagcggaucaaccugaagugcaagaaguccagcuccuacuucguccccgacgcccgcagccggugcacguccgugcgccggugccgcugggcgggcgacugccagagcgggugccccucccacuucaccagcaacuccuucagcgacgacugggccggcaagauggaccgggccgggcugggcuucuccggcugcagcgacgggugcggcggggccgcgugcggcugcuucaacgccgccccguccugcaucuucuggcgcaaguggguggagaacccccacgggaucaucuggaaggucagccccugcgccgccugggugcccuccgcggugaucgagcucaccaugccgagcggcgagguccggaccuuccaccccauguccggcauccccacccagguguucaagggggugagcgucaccuaccugggcuccgacauggaggugagcgggcugaccgaccucugcgagaucgaggagcucaagagcaagaagcuggcccuggcccccugcaaccaggccggcaugggcguggucgggaaggugggcgagauccagugcuccagcgaggaguccgcccgcaccaucaagaaggacgggugcaucuggaacgcggaccuggugggcaucgagcugcgggucgacgacgccgugugcuacagcaagaucacguccguggaggccgucgccaacuacagcgccaucccgaccaccaucgggggccugcgcuucgagcggucccacgacagccagggcaagaucuccgggagcccccucgacaucaccgcgauccgcggcuccuucagcgugaacuaccgggggcugcgccugucccucagcgagaucacggccacgugcaccggcgaggugaccaacgucuccgggugcuacagcugcaugaccggcgccaagguguccaucaagcugcacagcuccaagaacagcacggcccacgugcggugcaagggcgacgagaccgcguucagcguccuggagggggugcacuccuacaccgugagccucuccuucgaccacgccgucguggacgagcagugccagcugaacugcggcgggcacgagagccaggugacccugaagggcaaccucaucuuccuggacgucccccgcuucguggacggguccuacaugcagacguaccacagcuccgugcccaccggcgccaacaucccgagccccaccgacuggcugaacgcccucuucggcaacgggcugucccgcuggauccugggcgucaucggggugcuccugggcggccuggcccucuucuuccugaucaugagccuguucaagcucgggaccaagcaggucuuccggucccgcacgaagcuggcguga

SEQ ID NO: 13184 - RNA, 3222 nt, Artificial Sequence
  derived and/or modified CDS sequence (opt1) from SFTSV(SPL055A)__AB985294.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacucccccgagcagcgcaucgggcagugcaccggcugccaccucgagugcaucaacgggggcgugcggcugaucacccugaccagcgagcucaaguccgcgacggucugcgccagccacuucugcuccagcgccaccuccgggaagaaguccaccgagauccaguuccacagcggcagccuggugggcaagaccgccauccacgucaagggggcccugguggacggcacggaguucaccuucgagggguccugcauguuccccgacggcugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugauguucgcgaucaucaagaagcucaugcgguccgugagcugccugaugggcaagcugauggaccgcgggcggcaggucauccacgaggagaucggcgagaaccgcgagggcaaccaggacgacgugcggaucgagguggcccgcccccgccggguccgccacuggauguacucccccgugauccucacgauccuggccaucgggcuggccgagggcugcgacgagauggugcacgccgacagcaagcucgucuccugcaagcaggggagcggcaacaugaaggagugcgugaccaccgggcgggcgcugcugccggccgugaaccccggccaggaggccugccuccacuucaccgcccccggcagccccgacuccaagugccugaagaucaaggucaagcgcaucaaccugaagugcaagaaguccagcagcuacuucgugccggacgcccggucccgcugcacgagcgugcggcgcugccggugggcgggggacugccaguccggcugccccagccacuucaccuccaacagcuucuccgacgacugggccgggaagauggaccgcgccggccucggguucagcggcugcuccgacggcugcgggggcgccgcgugcgggugcuucaacgccgcccccagcugcaucuucuggcggaagugggucgagaacccgcacggcaucaucuggaaggugucccccugcgccgccugggugcccagcgcggucaucgagcugaccaugcccuccggggaggugcgcaccuuccacccgaugagcggcauccccacccagguguucaagggcgucuccgugaccuaccuggggagcgacauggaggugagcggccucaccgaccugugcgagaucgaggagcugaaguccaagaagcuggcccucgcccccugcaaccaggccgggaugggcgucgugggcaaggugggggagauccagugcagcuccgaggagagcgcccggaccaucaagaaggacggcugcaucuggaacgcggaccuggucgggaucgagcugcgcguggacgacgccgugugcuacuccaagaucacgagcgucgaggccguggccaacuacuccgccauccccaccaccaucggcgggcuccgguucgagcgcagccacgacucccagggcaagaucagcggcuccccgcuggacaucaccgcgauccgggggagcuucuccgugaacuaccgcggccugcggcucagccuguccgagaucacggccacgugcaccggggaggucaccaacgugagcggcugcuacuccugcaugaccggggcccgcgugagcaucaagcugcacuccagcaagaacagcacggcccacguccgcugcaagggcgacgagaccgcguucuccgugcucgagggcgugcacagcuacaccgucucccugagcuucgaccacgccgugguggacgagcagugccagcugaacugcgggggccacgagucccaggucacccucaaggggaaccugaucuuccuggacgugcccaaguucguggacggcagcuacaugcagacguaccacuccagcguccccaccggggccaacauccccuccccgaccgacuggcucaacgcccuguucggcaacggccugagccgguggauccucggggugaucggcguccugcucgggggccuggcccuguucuuccugaucaugucccucuucaagcugggcaccaagcaggucuuccgcagccggacgaagcuggcguga

SEQ ID NO: 13185 - RNA, 3222 nt, Artificial Sequence
  derived and/or modified CDS sequence (opt1) from SFTSV(SPL057A)__AB985295.1__GP
augaugaaggugaucugguucagcucccugaucugccucgugauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugccgcaucgacgggaucguguucaaccagugcgagagcgagucccucccgcagcccuucgacgucgccuggauggacgugggccacagccacaagaucaucaugcgggagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacgcuggaggugaacccgcccgagcagcggaucgggcagugcaccggcugccaccucgagugcgugaacgggggcguccgccugaucacccugaccuccgagcucaagagcgcgacggugugcgccucccacuucugcagcuccgccaucagcgggaagaaguccaccgagauccaguuccacagcggcucccuggucggcaagaccgccauccacgugaagggggcccugguggacggcaccgaguucacguucgaggggagcugcauguuccccgacggcugcgacgcggucgacugcaccuucugccgggaguuccucaagaacccccagugcuaccccgccaagaaguggcuguucaucaucaucgugauccugcucggcuacgccgggcugaugcugcucaccaacgugcugaaggccaucggcgucuggggguccugggugaucgcccccgugaagcugauguucgcgaucaugaagaagcucaugcgcagcgucuccugccugaugggcaagcugauggaccgggggcgccaggugauccacgaggagaucggcgagaaccgggagggcaaccaggacgacgugcgcaucgagauggcccgcccccggcgcguccggcacuggauguacagcccggugauccucaccauccuggccguggggcuggccgagggcugcgacgagaugguccacgccgacuccaagcucgugagcugcaagcagggguccggcaacaugaaggagugcgugacgaccgggcgcgcgcugcugcccgccgucaaccccggccaggaggccugccuccacuucaccgcccccggcagcccggacagcaagugccugaagaucaaggugaagaagaucaaccugaagugcaagaaguccagcuccuacuucgugcccgacgcccggagccgcugcaccuccguccggcgcugccggugggcgggggacugccagagcggcugccccucccacuucacgagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggugagccccugcgccgccuggguccccuccgcggugaucgagcugaccaugccgagcggggaggugcgcaccuuccaccccauguccggcauccccacccaggucuucaagggcgugagcgugacguaccugggguccgacauggaggucagcggccucaccgaccugugcgagaucgaggagcucaagagcaagaagcuggcccuggcccccugcaaccaggccgggaugggcguggugggcaaggucggggagauccagugcuccagcgaggaguccgcccggaccaucaagaaggacggcugcaucuggaacgcggaccugguggggaucgagcugcgcguggacgacgccgucugcuacagcaagaucaccuccguggaggccguggccaacuacagcgccaucccgacgaccaucggcgggcuccgguucgagcgcucccacgacagccagggcaagaucuccggcagcccccuggacaucaccgcgauccggggguccuucagcgucaacuaccgcggccugcggcucucccugagcgagaucaccgccacgugcaccggggaggugaccaacguguccggcugcuacagcugcaugaccggggccaaggucuccaucaagcugcacagcaacaagaacuccaccgcccacgugcgcugcaagggcgacgagacggcguucagcgugcucgagggcguccacagcuacaccgugucccugagcuucgaccacgccguggucgacgagcagugccagcugaacugcgggggccacgagucccaggugacccucaaggggaaccugaucuuccuggacgugcccaaguucgucgacggcagcuacaugcagaccuaccacuccagcgugcccacgggggccaacaucccgucccccaccgacuggcucaacgcccuguucggcaacggccugagccgcuggauccucggggucaucggcgugcugcucgggggccuggcccuguucuuccugaucaugucccucuucaagcugggcaccaagcaggucuuccggagccgcaccaagcuggcguga

SEQ ID NO: 13186 - RNA, 3222 nt, Artificial Sequence
  derived and/or modified CDS sequence (opt1) from SFTSV(SPL062A)__AB985297.1__GP
augaugaaggugaucugguucagcucccugaucugccucgugauccgcugcagcggcgggaccggccccaucaucugcgccgggccgauccacuccaacaagagcgccaacaucccccaccuccugggcuacuccgagaagaucugccagaucgaccggcugauccacgugagcuccuggcugcgcaaccacagccaguuccagggguacgugggccagcggggcgggcgcucccaggucagcuacuuccccgcggagaacuccuacagccggugguccggccugcucagccccugcgacgccgacuggcuggggaugcugguggugaagaaggcccgcggcuccgacaugaucgucccggggcccagcuacaagggcaagguguucuucgagcggcccaccuucgacggcuacgugggguggggcugcggguccggcaagagccgcacggaguccggcgagcucugcagcagcgacuccgggaccagcuccggccugcugcccagcgaccggguccucuggaucggggacguggccugccagccgaugacccccauccccgaggagaccuuccuggagcugaaguccuucagccaguccgaguuccccgacaucugcaagaucgacggcaucguguucaaccagugcgagagcgagucccucccgcagcccuucgacgucgccuggauggacguggggcacagccacaagaucaucaugcgcgagcacaagacgaagugggugcaggaguccagcuccaaggacuucgucugcuacaaggagggcaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggguccgcccgaagugcuacggguucagccggaugauggccacgcuggaggugaacccgcccgagcagcgcaucggccagugcaccgggugccaccucgagugcaucaacggcggggugcggcugaucacccugaccuccgagcucaagagcgcgacggucugcgccucccacuucugcagcuccgccaccagcggcaagaaguccaccgagauccaguuccacagcggcucccugguggggaagaccgccauccacgucaagggcgcccugguggacgggacggaguucaccuucgagggcagcugcauguuccccgacggcugcgacgcgguggacugcaccuucugccgcgaguuccucaagaacccccagugcuaccccgccaagaaguggcuguucaucaucaucgccauccugcucggguacgccggccugaugcugcucaccaacguccugaaggccaucgggguguggggcuccugggugaucgcgcccgucaagcugauguucgccaucaucaagaagcucaugcggagcguguccugccugauggggaagcugauggaccgcggccgccaggugauccacgaggagaucggcgagaaccgggaggggaaccaggacgacguccgcaucgagauggcccggccccgccgggugcgccacuggauguacagcccggugauccucacgauccuggccaucggccuggccgaggggugcgacgagaugguccacgcggacuccaagcucgugagcugcaagcagggcuccgggaacaugaaggagugcgugaccaccggccgggcccugcugcccgccgucaaccccggccaggaggccugccuccacuucaccgcccccgggagcccggacagcaagugccugaagaucaaggugaagcgcaucaaccugaagugcaagaaguccagcuccuacuucgugcccgacgcgcggagccgcugcacguccguccggcgcugccggugggccggcgacugccagagcgggugccccucccacuucaccagcaacuccuucagcgacgacugggccggcaagauggaccgcgccgggcucggcuucuccggcugcagcgacgggugcggcggggcggccugcggcugcuucaacgccgccccguccugcaucuucuggcggaaguggguggagaacccccacgggaucaucuggaaggugagccccugcgccgcguggguccccuccgccgugaucgagcugaccaugccgagcggcgaggugcgcaccuuccaccccauguccggcauccccacgcaggucuucaagggggugagcgugaccuaccugggcuccgacauggaggucagcgggcucaccgaccugugcgagaucgaggagcucaagagcaagaagcuggcccuggcccccugcaaccaggccggcaugggcgugguggggaaggucggcgagauccagugcuccagcgaggaguccgcgcggaccaucaagaaggacgggugcaucuggaacgccgaccuggugggcaucgagcugcgcguggacgacgccgucugcuacagcaagaucacguccguggaggccguggccaacuacagcgcgaucccgaccaccaucgggggccuccgguucgagcgcucccacgacagccagggcaagaucuccgggagcccccuggacaucaccgccauccggggcuccuucagcgucaacuaccgcgggcugcgccucucccugagcgagaucacggcgaccugcaccggcgaggugaccaacguguccgggugcuacagcugcaugaccggcgccaaggucuccaucaagcugcacagcuccaagaacagcacggcccacgugcggugcaagggcgacgagaccgccuucagcgugcucgaggggguccacuccuacaccgugagccuguccuucgaccacgccguggucgacgagcagugccagcugaacugcggcgggcacgagagccaggugacccucaagggcaaccugaucuuccuggacgugcccaaguucgucgacggguccuacaugcagacguaccacagcuccgugcccaccggcgccaacaucccgagccccaccgacuggcucaacgcccuguucggcaacgggcugucccgcuggauccucggcgugaucgggguccugcugggcggccucgcgcuguucuuccugaucaugagccucuucaagcuggggaccaagcaggucuuccggucccgcacgaagcuggccuga

SEQ ID NO: 13187 - RNA, 3222 nt, Artificial Sequence
  derived and/or modified CDS sequence (opt1) from SFTSV(SPL066A)__AB985298.1__GP
augaugaaggugaucugguucagcucccugaucugccucgugauccagugcagcggcgacgccucccccaucaucugcgccgggccgauccacagcaacaaguccgcgaacaucccccaccuccugggcuacagcgagaagaucugccagaucgaccgccugauccacguguccagcuggcugcggaaccacucccaguuccagggguacgugggccagcgcgggggccggagccaggucuccuacuuccccgccgagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggguacgugggcuggggcugcgggagcggcaagucccgcaccgagagcggggagcucugcagcuccgacagcggcacguccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgaguccgagagccugccgcagcccuucgacgucgcguggauggacguggggcacucccacaagaucaucaugcgcgagcacaagaccaagugggugcaggagagcuccagcaaggacuucgucugcuacaaggagggcacggggcccugcuccgagagcgaggagaagaccugcaagaccuccggcagcugccggggcgacaugcaguucugcaagguggccgggugcgagcacggcgaggaggccuccgaggccaagugccgcugcagccuggugcacaagcccggggaggucguggugagcuacggcgggaugcggguccgcccgaagugcuacggcuucucccggaugauggcgacccuggaggugaacccgcccgagcagcgcaucggccagugcacggggugccaccucgagugcaucaacggcggggugcggcugaucacccugaccagcgagcucaaguccgccaccgucugcgccagccacuucugcuccagcgccacguccggcaagaaguccaccgagauccaguuccacuccgggagccuggugggcaaggccgcgauccacgucaagggcgcccugguggacgggaccgaguucaccuucgagggcuccugcauguuccccgacgggugcgacgccguggacugcacguucugccgcgaguuccucaagaacccccagugcuaccccgccaagaaguggcuguucaucaucaucgucauccugcucggcuacgccggccugaugcugcucaccaacgugcugaaggcgaucgggguguggggcagcugggucaucgcccccgugaagcugauguucgccaucaucaagaagcucauccgguccgugagcugccugauggggaagcugauggaccgcggccggcaggucauccacgaggagaucggggagaacggcgagggcaaccaggacgacgugcgcaucgagauggcccggccccgccgcgugcggcacuggauguacuccccggucauccucaccauccuggccaucgggcuggcggagggcugcgacgagauggugcacgccgacagcaagcucguguccugcaagcaggggagcggcaacaugaaggagugcgucaccacggggcgcgcccugcugcccgccgugaaccccggccaggaggccugccuccacuucaccgcgcccggcagcccggacuccaagugccugaagaucaaggugaagcggaucaaccugaagugcaagaaguccagcagcuacuucguccccgacgcccgcucccggugcaccagcgugcgccggugccgcugggccggggacugccaguccggcugccccagccacuucaccuccaacagcuucuccgacgacugggccgggaagauggaccgggcgggccucggguucagcggcugcuccgacggcugcgggggcgccgccugcgggugcuucaacgccgccccgagcugcaucuucuggcgcaaguggguggagaacccccacggcaucaucuggaaggucucccccugcgcggccugggugcccagcgccgugaucgagcugacgaugccguccggggagguccggaccuuccaccccaugagcggcauccccacccagaucuucaagggcguguccgugaccuaccuggggagcgacauggaggucagcggccucacggaccugugcgagaucgaggagcugcgcuccaagaagcuggcccucgcccccugcaaccaggcggggaugggcguggugggcaaggucggggagauccagugcagcuccgaggagagcgcccggaccaucaagaaggacggcugcaucuggaacgccgaccugguggggaucgagcugcgcguggacgacgccgucugcuacuccaagaucaccagcguggaggccguggcgaacuacuccgccaucccgaccacgaucggcgggcuccgguucgagcgcagccacgacucccagggcaagaucagcggcagcccccuggacaucaccgccauccgggggagcuucuccgucaacuaccgcggccugcggcucagccuguccgagaucaccgcgaccugcacgggggaggugaccaacgugagcggcugcuacuccugcaugaccggggccaaggucagcaucaagcugcacuccagcaagaacagcaccgcccacgugcgcugcaagggcgacgagaccgccuucuccgugcucgagggcguccacagcuacacggugucccugagcuucgaccacgccguggucgacgagcagugccagcugaacugcgggggccacgagucccaggugacccucaaggggaaccugaucuuccuggacgugcccaaguucgucgacggcagcuacaugcagaccuaccacuccagcgugcccaccggggccaacaucccgucccccacggacuggcucaacgcgcuguucggcaacggccugagccgcuggauccucggggugaucggcguccugcucgggggccuggcccuguucuuccugaucaugucccucuucaagcugggcaccaagcaggucuuccggagccgcaccaagcuggccuga

SEQ ID NO: 13188 - RNA, 3222 nt, Artificial Sequence
  derived and/or modified CDS sequence (opt1) from SFTSV(SPL070A)__AB985301.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccucauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuucauggagcugaaguccuucagccaguccgaguuccccgacaucugcaagaucgacgggaucguguucaaccagugcgagagcgagucccugccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccucgugcacaagcccggcgaggucguggugagcuacgggggcaugcggguccgcccgaagugcuacggcuucagccggaugauggccacgcuggagguguccccgcccgagcagcgcaucgggcagugcaccggcugccaccuggagugcaucaacgggggcgugcggcucaucacccugaccagcgagcugaaguccgcgacggucugcgccagccacuucugcuccagcgccaccuccgggaagaaguccaccgagauccaguuccacagcggcagccucgugggcaagaccgccauccacgucaagggggcccugauggacggcacggaguucaccuucgagggguccugcauguuccccgacggcugcgacgcgguggacugcaccuucugccgcgaguuccugaagaacccccagugcuaccccgccaagaaguggcuguucaucaucaucgugauccugcugggcuacgccgggcucaugcugcugaccaacguccucaaggccaucggcgugugggggagcugggugaucgcccccgucaagcugauguucgcgaucaucaagaagcugaugcgguccgugagcugccucaugggcaagcugauggaccgcgggcgccaggugauccacgaggagaucggcgagaacggcgaggggaaccaggacgacguccggaucgagauggcccggccccgccgcgugcggcacuggauguacuccccggugauccugacgauccucgccaucggccuggccgaggggugcgacgagaugguccacgccgacagcaagcugguguccugcaagcagggcagcgggaacaugaaggagugcgugaccaccggccgcgcgcuccugcccgccgucaaccccggccaggaggccugccugcacuucaccgcccccgggagcccggacuccaagugccucaagaucaaggugaagcggaucaaccugaagugcaagaaguccagcagcuacuucgugcccgacgcccgcucccggugcacgagcguccgccggugccgcugggcgggcgacugccaguccgggugccccagccacuucaccuccaacagcuucuccgacgacugggccggcaagauggaccgggccgggcugggcuucagcggcugcuccgacgggugcggcggggccgcgugcggcugcuucaacgccgccccgagcugcaucuucuggcgcaaguggguggagaacccccacgggaucaucuggaaggugucccccugcgccgccuggguccccagcgcggugaucgagcucaccaugccguccggcgaggugcggaccuuccaccccaugagcggcauccccacgcaggucuucaaggggguguccgugaccuaccugggcagcgacauggaggucaccgggcugaccgaccucugcgagaucgaggagcucaagagcaagaagcuggcccuggcccccugcaaccaggccggcaugggcgugguggggaaggucggcgagauccagugcuccagcgaggaguccgcccgcacgaucaagaaggacgggugcaucuggaacgcggaccuggugggcaucgagcugcggguggacgacgccgucugcuacagcaagaucaccuccguggaggccguggccaacuacagcgccaucccgaccaccaucgggggccugcgcuucgagcggucccacgacagccagggcaagaucuccgggagcccccucgacaucacggcgauccgcggcuccuucagcgucaacuaccgggggcugcgccugucccucagcgagaucaccgcgaccugcaccggcgaggugaccaacguguccgggugcuacagcugcaugacgggcgccaaggucuccaucaagcugcacagcuccaagaacagcaccgcccacgugcggugcaagggcgacgagaccgccuucagcgugcuggaggggguccacuccuacaccgugagccucuccuucgaccacgccguggucgacgagcagugccagcugaacugcggcgggcacgagagccaggugacgcugaagggcaaccucaucuuccuggacgugcccaaguucgucgacggguccuacaugcagaccuaccacagcuccgugcccaccggcgccaacaucccgagccccaccgacuggcugaacgcccucuucggcaacgggcugucccgcuggauccugggcgugaucgggguccuccugggcggccuggcccucuucuuccugaucaugagccuguucaagcucgggacgaagcaggucuuccgcccccggaccaagcuggcguga

SEQ ID NO: 13189 - RNA, 3222 nt, Artificial Sequence
  derived and/or modified CDS sequence (opt1) from SFTSV(SPL071A)__AB985302.1__GP
augaugaaggugaucugguucagcucccugaucugccucaucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggugagcuacuuccccgcggagaacuccuacagccgcugguccgggcugcucagccccugcgacgccgacuggcugggcaugcuggucgugaagaaggccaagggguccgacaugaucgugccgggccccagcuacaaggggaaggucuucuucgagcggcccaccuucgacggcuacgugggcugggggugcggcuccggcaagagccgcacggaguccggggagcucugcagcagcgacuccggcaccagcuccgggcugcugcccagcgaccgggugcucuggaucggcgacgucgccugccagccgaugacccccauccccgaggagaccuuccuggagcugaaguccuucagccaguccgaguuccccgacaucugcaagaucgacgggaucguguucaaccagugcgagagcgagucccucccgcagcccuucgacguggccuggauggacgucggccacagccacaagaucaucaugcgcgagcacaagacgaagugggugcaggaguccagcuccaaggacuucgugugcuacaaggaggggaccggccccugcagcgaguccgaggagaagaccugcaagaccagcggcuccugccgcggggacaugcaguucugcaaggucgcgggcugcgagcacggggaggagacgagcgaggccaagugccggugcucccuggugcacaagcccggcgagguggucgugagcuacgggggcaugcgggugcgcccgaagugcuacggcuucagccggaugauggccacccuggaggucaacccgcccgagcagcgcaucgggcagugcaccggcugccaccucgagugcaucaacgggggcgugcggcugaucacccugacguccgagcucaagagcgccaccgugugcgcgucccacuucugcagcuccgccaccagcgggaagaaguccaccgagauccaguuccacagcggcucccuggucggcaagacggccauccacgugaagggggcccuggucgacggcaccgaguucaccuucgaggggagcugcauguuccccgacggcugcgacgccguggacugcaccuucugccgcgaguuccucaagaacccccagugcuaccccgcgaagaaguggcuguucaucaucaucgugauccugcucggcuacgccgggcugaugcugcucacgaacguccugaaggccaucggcguguggggguccugggugaucgcccccgucaagcugauguucgccaucaucaagaagcucaugcggagcguguccugccugaugggcaagcugauggaccgcgggcgccaggugauccacgaggagaucggcgagaaccgggagggcaaccaggacgacguccggaucgagauggcgcgcccccgccgggugcgccacuggauguacagcccggugauccucgccauccuggccaucgggcuggccgagggcugcgacgagaugguccacgccgacuccaagcucgugagcugcaagcagggguccggcaacaugaaggagugcgugaccaccgggcgggcgcugcugcccgccgucaaccccggccaggaggccugccuccacuucaccgcccccggcagcccggacagcaagugccugaagaucaaggugaagcgcaucaaccugaagugcaagaaguccagcuccuacuucgugcccgacgcccggagccgcugcacguccguccggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggugagccccugcgccgccuggguccccuccgcggugaucgagcugaccaugccgagcggggaggugcgcaccuuccaccccauguccggcauccccacgcaggucuucaagggcgugagcgugaccuaccugggguccgacauggaggucagcggccucaccgaccugugcgagaucgaggagcucaagagcaagaagcuggcccuggcccccugcaaccaggccgggaugggcguggugggcaaggucggggagauccagugcuccagcgaggaguccgcccggaccaucaagaaggacggcugcaucuggaacgcggaccugguggggaucgagcugcgcguggacgacgccgucugcuacagcaagaucacguccguggaggccguggccaacuacagcgccaucccgaccaccaucggcgggcuccgguucgagcgcucccacgacagccagggcaagaucuccggcagcccccuggacaucaccgcgauccggggguccuucagcgucaacuaccgcggccugcggcucucccugagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcucgagggcguccacuccuacaccgugagccuguccuucgaccacgccguggucgacgagcagugccagcugaacugcgggggccacgagagccaggugacccucaaggggaaccugaucuuccuggacgugcccaaguucgucgacggcuccuacaugcagacguaccacagcuccgugcccaccggggccaacaucccgagccccaccgacuggcucaacgcccuguucggcaacggccugucccgcuggauccucggggugaucggcguccugcucgggggccuggcccuguucuuccugaucaugagccucuucaagcugggcaccaagcaggucuuccggucccgcacgaagcuggcguga

SEQ ID NO: 13190 - RNA, 3222 nt, Artificial Sequence
  derived and/or modified CDS sequence (opt1) from SFTSV(SPL077A)__AB985304.1__GP
augaugaaggugaucugguucagcucccugaucugccucgucacccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccacguucgacggcuacgugggcugggggugcggcuccgggaagucccgcaccgaguccggcgagcucugcagcagcgacuccggcaccagcuccgggcugcugcccagcgaccggguccucuggaucggcgacguggccugccagccgaugacccccauccccgaggagacguuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagaccaagugggugcaggaguccagcuccaaggacuucgucugcuacaaggaggggaccggccccugcagcgaguccgaggagaagaccugcaagacgagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacccuggaggugaacccgcccgagcagcgcaucgggcagugcaccggcugccaccucgagugcaucaacgggggcgugcggcugaucacccugacguccgagcucaagagcgcgaccgucugcgccucccacuucugcagcuccgccaccagcgggaagaaguccaccgagauccaguuccacagcggcucccuggugggcaagacggccauccacgucaagggggcccugguggacggcaccgaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucacgaacgugcugaaggccaucggcguguggggguccugggucaucgcccccgugaagcugauguucgcgauccucaagaagcugaugcggagcguguccugccugaugggcaagcucauggaccgcgggcggcaggucauccacgaggagaucggcgagaaccgcgagggcaaccaggacgacgugcggaucgagauggcccgcccccgccgggugcgccacuggauguacagcccggucauccugaccauccuggccaucgggcucgccgagggcugcgacgagauggugcacgccgacuccaagcuggugagcugcaagcagggguccggcaacaugaaggagugcgucaccaccgggcgggcgcugcuccccgccgugaaccccggccaggaggccugccugcacuucacggcccccggcagcccggacagcaagugccugaagaucaaggugaagcgcaucaaccucaagugcaagaaguccagcuccuacuucguccccgacgcccggagccgcugcaccuccgugcggcgcugccggugggcgggggacugccagagcggcugccccucccacuucaccagcaacuccuucagcgacgacugggccgggaagauggaccgcgccggccugggguucuccggcugcagcgacggcugcgggggcgccgcgugcgggugcuucaacgccgccccguccugcaucuucuggcggaaguggguggagaacccccacggcaucaucuggaaggucagccccugcgccgccugggugcccuccgcggugaucgagcugaccaugccgagcggggagguccgcacguuccaccccauguccagcauccccacccagguguucaagggcguguccgucaccuaccucggcagcgacauggaggugagcgggcugaccgaccugugcgagaucgaggagcugaaguccaagaagcucgcccuggcccccugcaaccaggccggcauggggguggucggcaaggugggcgagauccagugcagcuccgaggagagcgcccggacgaucaagaaggacgggugcaucuggaacgcggaccuggugggcaucgagcuccgcgucgacgacgccgugugcuacuccaagaucaccagcguggaggccgucgccaacuacuccgccaucccgaccaccaucgggggccugcgguucgagcgcagccacgacucccaggggaagaucagcggcagcccccuggacaucacggcgauccggggcagcuucuccgugaacuaccgcgggcuccggcugagccuguccgagaucaccgcgaccugcaccggcgaggugaccaacgucagcgggugcuacuccugcaugacgggcgccaaggugagcaucaagcuccacuccagcaagaacagcaccgcccacgugcgcugcaagggggacgagaccgccuucuccguccuggagggcgugcacagcuacaccgugucccugagcuucgaccacgccgucguggacgagcagugccagcucaacugcggcgggcacgagucccaggugacgcugaagggcaaccugaucuuccucgacguccccaaguucguggacgggagcuacaugcagaccuaccacuccagcgugcccaccggcgccaacaucccgucccccaccgacuggcugaacgcccuguucgggaacggccucagccgcuggauccugggcgucaucggggugcugcucggcgggcuggcccuguucuuccucaucaugucccuguucaagcagggcacgaagcaggucuuccggagccgcaccaagcuggcguga

SEQ ID NO: 13191 - RNA, 3222 nt, Artificial Sequence
  derived and/or modified CDS sequence (opt1) from SFTSV(SPL084A)__AB985307.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacaccgggcugaugcugcucacgaacgugcugaaggccaucggcguguggggguccugggucaucgcccccgugaagcugauguucgccauccucaagaagcugaugcggagcguguccugccugaugggcaagcucauggaccgcgggcggcaggucauccacgaggagaucggcgagaaccgcgagggcaaccaggacgacgugcggaucgagauggcgcgcccccgccgggugcgccacuggauguacagcccggucauccugaccauccuggccaucgggcucgccgagggcugcgacgagauggugcacgccgacuccaagcuggugagcugcaagcagggguccggcaacaugaaggagugcgucaccaccgggcgggcccugcuccccgcggugaaccccggccaggaggccugccugcacuucacggcccccggcagcccggacagcaagugccugaagaucaaggugaagcgcaucaaccucaagugcaagaaguccagcuccuacuucguccccgacgcccggagccgcugcaccuccgugcggcgcugccggugggccggggacugccagagcggcugccccucccacuucaccagcaacuccuucagcgacgacugggcggggaagauggaccgcgccggccugggguucuccggcugcagcgacggcugcgggggcgccgccugcgggugcuucaacgcggccccguccugcaucuucuggcggaaguggguggagaacccccacggcaucaucuggaaggucagccccugcgccgccugggugcccuccgccgugaucgagcugaccaugccgagcggggagguccgcacguuccaccccauguccggcauccccacccagguguucaagggcgugagcgucaccuaccucggguccgacauggaggugagcggccugaccgaccugugcgagaucgaggagcucaagagcaagaagcuggcgcuggcccccugcaaccaggccgggaugggcguggucggcaaggugggggagauccagugcuccagcgaggaguccgcccggacgaucaagaaggacggcugcaucuggaacgccgaccugguggggaucgagcuccgcgucgacgacgcggugugcuacagcaagaucaccuccguggaggccgucgccaacuacagcgccaucccgaccaccaucggcgggcugcgguucgagcgcucccacgacagccagggcaagaucuccggcagcccccuggacaucacggccauccggggguccuucagcgugaacuaccgcggccuccggcugucccugagcgagaucaccgcgaccugcaccggggaggugaccaacgucuccggcugcuacagcugcaugacgggggccaagguguccaucaagcuccacagcuccaagaacagcaccgcccacgugcgcugcaagggcgacgagaccgccuucagcguccaggagggcgugcacuccuacaccgugagccuguccuucgaccacgcggucguggacgagcagugccagcugaacugcgggggccacgagagccaggugacgcucaaggggaaccugaucuuccuggacguccccaaguucguggacggcuccuacaugcagaccuaccacagcuccgugcccaccggggccaacaucccgagccccaccgacuggcucaacgcccuguucggcaacggccugucccgcuggauccucggggucaucggcgugcugcucgggggccuggcccuguucuuccugaucaugagccucuucaagcugggcacgaagcaggucuuccggucccgcaccaagcuggccuga

SEQ ID NO: 13192 - RNA, 3222 nt, Artificial Sequence
  derived and/or modified CDS sequence (opt1) from SFTSV(SPL086A)__AB985308.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucaugcggagcguguccugccugaugggcaagcugauggaccgcgggcggcaggucauccacgaggagaucggcgagaaccgcgagggcaaccaggacgacgugcggaucgagauggcccgcccccgccgggugcgccacuggauguacagcccggucauccucacgauccuggccaucgggcuggccgagggcugcgacgagauggugcacgccgacuccaagcucgugagcugcaagcagggguccggcaacaugaaggagugcgucaccaccgggcgggcgcugcugcccgccgugaaccccggccaggaggccugccuccacuucaccgcccccggcagcccggacagcaagugccugaagaucaaggugaagcgcaucaaccugaagugcaagaaguccagcuccuacuucguccccgacgcccggagccgcugcacguccgugcggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggucagccccugcgccgccugggugcccuccgcggugaucgagcugaccaugccgagcggggagguccgcaccuuccaccccauguccggcauccccacccagguguucaagggcgugagcgucaccuaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccggaccaucaagaaggacggcugcaucuggaacgcggaccugguggggaucgagcugcgcgucgacgacgccgugugcuacagcaagaucacguccguggaggccgucgccaacuacagcgccaucccgaccaccaucggcgggcuccgguucgagcgcucccacgacagccagggcaagaucuccggcagcccccuggacaucaccgcgauccggggguccuucagcgugaacuaccgcggccugcggcucucccugagcgagaucacggccacgugcaccggggaggugaccaacgucuccggcugcuacagcugcaugaccggggcccgcguguccaucaagcugcacagcuccaagaacagcacggcccacgugcgcugcaagggcgacgagaccgcguucagcguccucgagggcgugcacuccuacaccgugagccuguccuucgaccacgccgucguggacgagcagugccagcugaacugcgggggccacgagagccaggugacccucaaggggaaccugaucuuccuggacguccccaaguucguggacggcuccuacaugcagacguaccacagcuccgugcccaccggggccaacaucccgagccccaccgacuggcucaacgcccuguucggcaacggccugucccgguggauccucggggucaucggcgugcugcucgggggccuggcccuguucuuccugaucaugagccucuucaagcugggcaccaagcaggucuuccgcucccggacgaagcuggcguga

SEQ ID NO: 13193 - RNA, 3222 nt, Artificial Sequence
  derived and/or modified CDS sequence (opt1) from SFTSV(SPL087A)__AB985309.1__GP
augaugaaggugaucugguucagcucccugaucugccucgugauccagugcagcggcgacuccgggcccaucaucugcgccggcccgauccacagcaacaaguccgccgacaucccccaccuccugggguacagcgagaagaucugccagaucgaccgccugauccacguguccagcuggcugcggaaccacucccaguuccagggcuacguggggcagcgcggcggccggagccaggucuccuacuaccccgcggagaacagcuacucccgcuggagcgggcugcucucccccugcgacgccgacuggcugggcaugcugguggugaagaaggccaaggggagcgacaugaucgucccgggccccuccuacaaggggaagguguucuucgagcggcccaccuucgacggcuacgugggcugggggugcggcagcgggaagucccgcagcgagagcggcgagcucugcuccagcgacuccggcaccagcuccgggcugcugcccagcgaccggguccucuggaucggcgacguggccugccagccgaugacgcccauccccgaggagaccuuccuggagcugaaguccuucagccaguccgaguuccccgacaucugcaagaucgacgggaucguguucaaccagugcgagggcgagagccucccgcagcccuucgacgucgccuggauggacguggggcacucccacaagaucaucaugcgcgagcacaagaccaagugggugcaggagagcuccagcaaggacuucgucugcuacaaggagggcaccggccccugcuccgagagcgaggagaagacgugcaagaccuccgggagcugccggggcgacacccaguucugcaagguggcggggugcgagcacggcgaggaggccuccgaggccaagugccgcugcagccuggugcacaagcccggggaggucguggugagcuacggcggcaugcggguccgcccgaagugcuacggguucucccggaugauggccacccuggaggugagcccgcccgagcagcgcaucggccagugcacggggugccaccucgagugcaucaacggcggggugcggcugaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccucaagaacccccagugcuaccccgccaagaaguggcuguucaucaucaucgucauccugcucggguacgccggccugaugcugcucaccaacgugcugaaggccaucgggguguggggcuccugggucaucgcccccgugaagcugauguucgcgaucaucaagaagcucaugcggaccgugagcugccugauggggaagcugauggaccgcggccggcaggucauccacgaggagaucggcgagaaccgcgaggggaaccgggacgacauccgcaucgagauggcccgcccccggcgcgugcggcacuggauguacuccccggugauccucacgauccuggccaucggccuggccgaggggugcgacgagaugguccacgccgacagcaagcucguguccugccgccagggcagcgggaacaugaaggagugcgugaccaccggccgggcgcugcugcccgccgucaaccccggccaggaggccugccuccacuucaccgcccccgggagcccggacuccaagugccugaagaucaaggugaagcgcaucaaccugaagugcaagaaguccagcagcuacuucgugcccgacgcccggucccgcugcacgagcguccggcgcugccggugggcgggcgacugccaguccgggugcccgccccacuucaccagcaacuccuucagcgacgacugggccggcaagauggaccgcgccgggcucggcuucuccggcugcagcgacgggugcggcggggccgcgugcggcugcuucaacgccgcccccuccugcaucuucuggcggaaguggguggagaacccccacgggaucaucuggaaggugagccccugcgccgccugggucccguccgcggugaucgagcugaccaugcccagcggcgaggugcgcaccuuccaccccauguccggcauccccacgcaggucuucaagggggugagcgugaccuaccugggcuccgacauggaggucagcgggcucaccgaccugugcgagaucgaggagcucaagagcaagaagcuggcccuggccccgugcaaccaggccggcaugggcgugguggggaaggucggcgagauccagugcuccagcgaggaguccgcccggaccaucaagaaggacgggugcaucuggaacgcggaccuggugggcaucgagcugcgcguggacgacgccgucugcuacagcaagaucacguccguggaggccguggccaacuacagcgccauccccaccaccaucgggggccuccgguucgagcgcucccacgacagccagggcaagaucuccgggagcccccuggacaucaccgcgauccggggcuccuucagcgucaacuaccgcgggcugcgccucucccugagcgagaucacggcgaccugcaccggcgaggugaccaacguguccgggugcuacagcugcaugaccggcgccaaggucuccaucaagcugcacagcuccaagaacagcacggcccacgugcggugcaagggcgacgagaccgccuucagcgugcucgaggggguccacuccuacaccgugagccuguccuucgaccacgccguggucgacgagcgcugccagcugaacugcggcgggcacgagagccaggugacccucaagggcaaccugaucuuccuggacgugcccaaguucgucgacggguccuacaugcagacguaccacagcaccgugccgaccggcgccaacauccccucccccaccgacuggcucaacgcccuguucggcaacgggcugagccgguggauccucggcgugaucgggguccugcugggcggccucgcccuguucuuccugaucaugucccucuucaagcuggggacgaagcaggucuuccgcagccggaccaagcuggcguga

SEQ ID NO: 13194 - RNA, 3222 nt, Artificial Sequence
  derived and/or modified CDS sequence (opt1) from SFTSV(SPL090A)__AB985311.1__GP
augaugaaggugaucugguuccccagccugaucugccucgugauccgcugcuccggcgggaccggcccgaucaucugcgccgggcccauccacagcaacaaguccgccaacaucccccaccuccugggcuacagcgagaagaucugccagaucgaccggcugauccacguguccagcuggcugcgcaaccacucccaguuccagggguacgugggccagcggggcgggcgcagccaggucuccuacuuccccgcggagaacagcuacucccgguggagcggccugcucuccccgugcgacgccgacuggcuggggaugcugguggugaagaaggcccgcggcagcgacaugaucguccccgggcccuccuacaagggcaagguguucuucgagcggcccaccuucgacggcuacgugggguggggcugcgggagcggcaagucccgcacggagagcggcgagcucugcuccagcgacagcgggaccuccagcggccugcugccguccgaccggguccucuggaucggggacguggccugccagcccaugacccccauccccgaggagaccuuccuggagcucaagagcuucucccagagcgaguucccggacaucugcaagaucgacggcaucguguucaaccagugcgaguccgagagccugccccagcccuucgacgucgccuggauggacguggggcacucccacaagaucaucaugcgcgagcacaagacgaagugggugcaggagagcuccagcaaggacuucgucugcuacaaggagggcaccggccccugcuccgagagcgaggagaagaccugcaagaccuccgggagcugccggggcgacaugcaguucugcaagguggcggggugcgagcacggcgaggaggccuccgaggccaagugccgcugcagccuggugcacaagccgggggaggucgugguguccuacggcggcaugcggguccgccccaagugcuacggguucagccggaugauggccacgcuggaggugaacccgcccgagcagcgcaucggccagugcaccgggugccaccucgagugcaucaacggcggggugcggcugaucacccugaccagcgagcucaaguccgcgacggucugcgccagccacuucugcuccagcgccaccuccggcaagaaguccaccgagauccaguuccacuccggcagccugguggggaagaccgccauccacgucaagggcgcccugguggacgggacggaguucaccuucgagggcuccugcauguuccccgacggcugcgacgcgguggacugcaccuucugccgcgaguuccucaagaacccccagugcuaccccgccaagaaguggcuguucaucaucaucgccauccugcucggguacgccggccugaugcugcucaccaacguccugaaggccaucgggguguggggcagcugggugaucgcgcccgucaagcugauguucgccaucaucaagaagcucaugcgguccgugagcugccugauggggaagcugauggaccgcggccgccaggugauccacgaggagaucggcgagaaccgggaggggaaccaggacgacguccgcaucgagauggcccggccgcgccgggugcgccacuggauguacucccccgugauccucacgauccuggccaucggccuggccgaggggugcgacgagaugguccacgcggacagcaagcucguguccugcaagcagggcagcgggaacaugaaggagugcgugaccaccggccgggcccugcugcccgccgucaaccccggccaggaggccugccuccacuucaccgccccggggucccccgacagcaagugccugaagaucaaggugaagcgcaucaaccugaagugcaagaaguccagcagcuacuucgugcccgacgcgcggucccgcugcacgagcguccggcgcugccggugggccggcgacugccaguccgggugcccgagccacuucaccuccaacagcuucuccgacgacugggccggcaagauggaccgcgccgggcucggcuucagcggcugcuccgacgggugcggcggggcggccugcggcugcuucaacgccgcccccagcugcaucuucuggcggaaguggguggagaacccccacgggaucaucuggaaggugucccccugcgccgcgugggucccgagcgccgugaucgagcugaccaugcccuccggcgaggugcgcaccuuccaccccaugagcggcauccccacgcaggucuucaaggggguguccgugaccuaccugggcagcgacauggaggucuccgggcucaccgaccugugcgagaucgaggagcucaagagcaagaagcuggcccuggccccgugcaaccaggccggcaugggcgugguggggaaggucggcgagauccagugcagcuccgaggagagcgcgcggaccaucaagaaggacgggugcaucuggaacgccgaccuggugggcaucgagcugcgcguggacgacgccgucugcuacuccaagaucacgagcguggaggccguggccaacuacuccgcgauccccaccaccaucgggggccuccgguucgagcgcagccacgacucccagggcaagaucagcgggagcccccuggacaucaccgccauccggggcagcuucuccgucaacuaccgcgggcugcgccucagccuguccgagaucacggcgaccugcaccggcgaggugaccaacgugagcgggugcuacuccugcaugaccggcgccaaggucagcaucaagcugcacuccagcaagaacuccacggcccacgugcggugcaagggcgacgagaccgccuucagcgugcucgaggggguccacagcuacaccgugucccugagcuucgaccacgccguggucgacgagcagugccagcugaacugcggcgggcacgagucccaggugacccucaagggcaaccugaucuuccuggacgugcccaaguucgucgacgggagcuacaugcagacguaccacuccagcgugccgaccggcgccaacauccccucccccaccgacuggcucaacgcccuguucggcaacgggcugagccgcuggauccucggcgugaucgggguccugcugggcggccucgcgcuguucuuccugaucaugucccucuucaagcuggggaccaagcaggucuuccggagccgcacgaagcuggccuga

SEQ ID NO: 13195 - RNA, 3222 nt, Artificial Sequence
  derived and/or modified CDS sequence (opt1) from SFTSV(SPL097A)__AB985312.1__GP
augaugaaggugaucugguucagcucccugaucugccucgugauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaagcaggggaccggccccugccccgagagcgaggagaagaccugcaagaccuccggcagcugccgcggggacaugcaguucugcaagguggcgggcugcgagcacggggaggaggccuccgaggccaagugccggugcagccuggugcacaagccgggcgaggucgugguguccuacgggggcaugcggguccgccccaagugcuacggcuucagccggaugauggccacgcuggaggugaacccgcccgagcagcgcaucgggcagugcaccggcugccaccucgagugcgugaacgggggcguccggcugaucacccugaccagcgagcucaaguccgcgacggugugcgccagccacuucugcuccagcgccaccuccgggaagaagaacaccgagauccaguuccacagcggcucccuggucggcaagaccgccauccacgugaagggggcccugcucgacggcacggaguucaccuucgaggggagcugcauguuccccgacggcugcgacgcgguggacugcaccuucugccgcgaguuccugaagaacccccagugcuaccccgccaagaaguggcuguucaucaucaucgucauccuccugggcuacgccgggcugaugcuccugaccaacgugcugaaggccaucggcguguggggguccugggucaucgcccccgugaagcucauguucgcgaucaucaagaagcugaugcggagcguguccugccugaugggcaagcucauggaccgcgggcggcaggucauccacgaggagaucggcgagaaccgcgagggcaaccaggacgacgugcggaucgagauggcccgcccgcgccgggugcgccacuggauguacagccccgucauccugacgauccuggccguggggcucgccgagggcugcgacgagauggugcacgccgacuccaagcuggucagcugcaagcagggguccggcaacaugaaggagugcgugaccaccgggcgggcgcugcuccccgccgugaaccccggccaggaggccugccugcacuucaccgccccgggcagccccgacuccaagugccugaagaucaaggucaagaagaucaaccucaagugcaagaaguccagcagcuacuucgugcccgacgcccgcagccggugcacguccgugcgccggugccgcugggcgggggacugccagagcggcugcccgucccacuucaccagcaacuccuucagcgacgacugggccgggaagauggaccgggccggccugggguucuccggcugcagcgacggcugcgggggcgccgcgugcgggugcuucaacgccgcccccuccugcaucuucuggcgcaagugggucgagaacccccacggcaucaucuggaaggugagccccugcgccgccugggugccguccgcggucaucgagcugaccaugcccagcggggaggugcggaccuuccaccccauguccggcauccccacccagguguucaagggcgucagcgugaccuaccucggguccgacauggaggugagcggccugaccgaccugugcgagaucgaggagcugaaguccaagaagcucgcccuggccccgugcaaccaggccgggaugggcgucgugggcaaggugggggagauccagugcagcagcgaggaguccgcccgcaccaucaagaaggacggcugcaucuggaacgcggaccuggucgggaucgagcuccggguggacgacgccgugugcuacagcaagaucacguccgucgaggccguggccaacuacagcgccauccccaccaccaucggcgggcugcgcuucgagcggucccacgacagccagggcaagaucuccggcagcccccuggacaucaccgcgauccgcggguccuucagcgugaacuaccggggccuccgccugucccugagcgagaucacggccacgugcaccggggaggucaccaacguguccggcugcuacagcugcaugaccggggccaagguguccaucaagcuccacagcaacaagaacuccacggcccacguccggugcaagggcgacgagaccgcguucagcgugcuggagggcgugcacuccuacaccgucagccugagcuucgaccacgccgugguggacgagcagugccagcucaacugcgggggccacgagucccaggucacccugaaggggaaccugaucuuccucgacgugcccaaguucguggacggcagcuacaugcagacguaccacuccagcgucccgaccggggccaacauccccucccccaccgacuggcugaacgcccuguucggcaacggccucagccgcuggauccugggggugaucggcguccugcucgggggccuggcccuguucuuccucaucaugucccuguucaagcugggcaccaagcaggucuuccgcagccggacgaagcucgcguga

SEQ ID NO: 13196 - RNA, 3222 nt, Artificial Sequence
  derived and/or modified CDS sequence (opt1) from SFTSV(SPL100A)__AB985313.1__GP
augaugaaggugaucugguucagcucccugaucugccucgugauccagugcagcggcgacaccgggcccaucaucugcgccggcccgauccacuccaacaagagcgccgacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaagcaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcgugaacgggggcguccggcugaucacccugaccuccgagcucaagagcgcgacggugugcgccucccacuucugcagcuccgccaccagcgggaagaaguccaccgagauccaguuccacagcggcucccuggucggcaagaccgccauccacgugaagggggcccugcucgacggcacggaguucaccuucgaggggagcugcauguuccccgacggcugcgacgcgguggacugcaccuucugccgcgaguuccugaagaacccccagugcuaccccgccaagaaguggcuguucaucaucaucgucauccuccugggcuacgccgggcugaugcuccugaccaacgugcugaaggccaucgccguguggggcuccugggucaucgcgcccgugaagcucauguucgccaucaucaagaagcugaugcggagcguguccugccugauggggaagcucauggaccgcggccggcaggucauccacgaggagaucggggagaaccgcgagggcaaccaggacgacgugcggaucgagauggcccgcccccgccgggugcgccacuggauguacagcccggucauccugacggugcuggccgugggccucgccgaggggugcgacgagaugguccacgcggacuccaagcuggugagcugcaagcagggcuccgggaacaugaaggagugcgugaccaccggccgggcccugcuccccgccgucaaccccgggcaggaggccugccugcacuucaccgcccccggcagcccggacagcaagugccugaagaucaaggugaagaagaucaaccucaagugcaagaaguccagcuccuacuucgugcccgacgcgcgcagccggugcacguccguccgccggugccgcugggccggcgacugccagagcgggugccccucccacuucaccagcaacuccuucagcgacgacugggccggcaagauggaccgggccgggcugggcuucuccgggugcagcgacggcugcggcggggcggccugcggcugcuucaacgccgccccguccugcaucuucuggcgcaaguggguggagaacccccacgggaucaucuggaaggugagccccugcgccgcguggguccccuccgccgugaucgagcugaccaugccgagcggcgaggugcggaccuuccaccccauguccgggauccccacgcaggucuucaagggcgugagcgugaccuaccucggcuccgacauggaggucagcgggcugaccgaccugugcgagaucgaggagcucaagagcaagaagcuggcccuggcccccugcaaccaggccggcauggggguggugggcaaggucggcgagauccagugcuccagcgaggaguccgcgcgcaccaucaagaaggacgggugcaucuggaacgccgaccuggugggcaucgagcuccggguggacgacgccgucugcuacagcaagaucacguccguggaggccguggccaacuacagcgcgaucccgaccaccaucgggggccugcgcuucgagcggucccacgacagccaggggaagaucuccggcagcccccuggacaucaccgccauccgcggcuccuucagcgucaacuaccgggggcuccgccugucccugagcgagaucacggcgaccugcaccggcgaggugaccaacguguccgggugcuacagcugcaugaccggcgccaaggucuccaucaagcuccacagcaacaagaacuccacggcccacgugcggugcaagggggacgagaccgccuucagcgugcuggagggcguccacagcuacaccgugucccugagcuucgaccacgccguggucgacgagcagugccagcucaacugcggcgggcacgagucccaggugacccugaagggcaaccugaucuuccucgacgugcccaaguucgucgacgggagcuacaugcagacguaccacuccagcgugcccaccggcgccaacaucccgucccccaccgacuggcugaacgcccuguucgggaacggccucagccgcuggauccugggcgucaucggggugcugcucggcgggcuggcgcuguucuuccucaucaugucccuguucaagcugggcaccaagcaggucuuccgcagccggacgaagcucgccuga

SEQ ID NO: 13197 - RNA, 3222 nt, Artificial Sequence
  derived and/or modified CDS sequence (opt1) from SFTSV(SPL106A)__AB985316.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgauccucaagaagcugaugcggagcguguccugccugaugggcaagcucauggaccgcgggcggcaggucauccacgaggagaucggcgagaaccgcgagggcaaccaggacgacgugcggaucgagauggcccgcccccgccgggugcgccacuggauguacagcccggucauccugacgauccuggccaucgggcucgccgagggcugcgacgagguggugcacgccgacuccaagcuggucagcugcaagcagggguccggcaacaugaaggagugcgugaccaccgggcgggcgcugcuccccgccgugaaccccggccaggaggccugccugcacuucaccgcccccggcagcccggacagcaagugccugaagaucaaggucaagcgcaucaaccucaagugcaagaaguccagcuccuacuucgugcccgacgcccggagccgcugcacguccgugcggcgcugccggugggcgggggacugccagagcggcugccccucccacuucaccagcaacuccuucagcgacgacugggccgggaagauggaccgcgccggccugggguucuccggcugcagcgacggcugcgggggcgccgcgugcgggugcuucaacgccgccccguccugcaucuucuggcggaagugggucgagaacccccacggcaucaucuggaaggugagccccugcgccgccugggugcccuccgcggucaucgagcugaccaugccgagcggggaggugcgcaccuuccaccccauguccggcauccccacccagguguucaagggcgucagcgugaccuaccucggguccgacauggaggugagcggccugaccgaccugugcgagaucgaggagcucaagagcaagaagcuggcccuggcccccugcaaccaggccgggaugggcgucgugggcaaggugggggagauccagugcuccagcgaggaguccgcccggaccaucaagaaggacggcugcaucuggaacgcggaccuggucgggaucgagcuccgcguggacgacgccgugugcuacagcaagaucacguccgucgaggccguggccaacuacagcgccaucccgaccaccaucggcgggcugcgguucgagcgcucccacgacagccagggcaagaucuccggcagcccccuggacaucaccgcgauccggggguccuucagcgugaacuaccgcggccuccggcugucccugagcgagaucacggccacgugcaccggggaggucaccaacguguccggcugcuacagcugcaugaucggggccaagguguccaucaagcuccacagcuccaagaacagcaccgcccacguccgcugcaagggcgacgagacggcguucagcgugcuggagggcgugcacuccuacaccgucagccuguccuucgaccacgccgugguggacgagcagugccagcucaacugcgggggccacgagagccaggucacccugaaggggaaccugaucuuccucgacgugcccaaguucguggacggcuccuacaugcagaccuaccacagcuccguccccacgggggccaacaucccgagccccaccgacuggcugaacgcccuguucggcaacggccucucccgcuggauccugggggugaucggcguccugcucgggggccuggcccuguucagccucaucaugucccuguucaagcugggcaccaagcagguccuccggagccgcaccaagcuggcguga

SEQ ID NO: 13198 - RNA, 3222 nt, Artificial Sequence
  derived and/or modified CDS sequence (opt1) from SFTSV(SPL117A)__AB985321.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuaccgggggaagguguucuucgagcgccccaccuucgacggcuacgugggcugggggugcggcuccggcaagagccggacggaguccggggagcucugcagcagcgacuccggcaccagcuccgggcugcugcccagcgaccgcguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgggagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcgcguccggccgaagugcuacggcuucagccgcaugauggccacgcuggaggugaacccgcccgagcagcggaucgggcagugcaccggcugccaccucgagugcaucaacgggggcgugcgccugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgggaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucaugcgcagcguguccugccugaugggcaagcugauggaccgggggcgccaggucauccacgaggagaucggcgagaaccgggagggcaaccaggacgacgugcgcaucgagauggcccgcccccggcgcgugcggcacuggauguacagcccggucauccucacgauccuggccaucgggcuggccgagggcugcgacgagauggugcacgccgacuccaagcucgugagcugcaagcagggguccggcaacaugaaggagugcgucaccaccgggcgcgcgcugcugcccgccgugaaccccggccaggaggccugccuccacuucaccgcccccggcagcccggacagcaagugccugaagaucaaggugaagcggaucaaccugaagugcaagaaguccagcuccuacuucguccccgacgcccgcagccggugcacguccgugcgccggugccgcugggcgggggacugccagagcggcugccccucccacuucaccagcaacuccuucagcgacgacugggccgggaagauggaccgggccggccucggguucuccggcugcagcgacggcugcgggggcgccgcgugcgggugcuucaacgccgccccguccugcaucuucuggcgcaaguggguggagaacccccacggcaucaucuggaaggucagccccugcgccgccugggugcccuccgcggugaucgagcugaccaugccgagcggggagguccggaccuuccaccccauguccggcauccccacccagguguucaagggcgugagcgucaccuaccugggguccgacauggaggugagcggccucaccgaccugugcgagaucgaggagcucaagagcaagaagcuggcccuggcccccugcaaccaggccgggaugggcguggucggcaaggugggggagauccagugcuccagcgaggaguccgcccgcaccaucaagaaggacggcugcaucuggaacgcggaccugguggggaucgagcugcgggucgacgacgccgugugcuacagcaagaucacguccguggaggccgucgccaacuacagcgccaucccgaccaccaucggcgggcuccgcuucgagcggucccacgacagccagggcaagaucuccggcagcccccuggacaucaccgcgauccgcggguccuucagcgugaacuaccggggccugcgccucucccugagcgagaucacggccacgugcaccggggaggugaccaacgucuccggcugcuacagcugcaugaccggggccaagguguccaucaagcugcacagcuccaagaacagcacggcccacgugcgcugcaagggcgacgagaccgcguucagcguccucgagggcgugcacuccuacaccgugagccuguccuucgaccacgccgucguggacgagcagugccagcugaacugcgggggccacgagagccaggugacccucaaggggaaccugaucuuccuggacguccccaaguucguggacggcuccuacaugcagacguaccacagcuccgugcccaccggggccaacaucccgagccccaccgacuggcucaacgcccuguucggcaacggccugucccgguggauccucggggucaucggcgugcugcucgggggccuggcccuguucuuccugaucaugagccucuucaagcugggcaccaagcaggucuuccgcucccggacgaagcuggcguga

SEQ ID NO: 13199 - RNA, 3222 nt, Artificial Sequence
  derived and/or modified CDS sequence (opt1) from SFTSV(SPL120A)__AB985322.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccccagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgauccucaagaagcugaugcggagcguguccugccugaugggcaagcucauggaccgcgggcggcaggucauccacgaggagaucggcgagaaccgcgagggcaaccaggacgacgugcggaucgagauggcccgcccccgccgggugcgccacuggauguacagcccggucauccugacgauccuggccaucgggcucgccgagggcugcgacgagguggugcacgccgacuccaagcuggucagcugcaagcagggguccggcaacaugaaggagugcgugaccaccgggcgggcgcugcuccccgccgugaaccccggccaggaggccugccugcacuucaccgcccccggcagcccggacagcaagugccugaagaucaaggucaagcgcaucaaccucaagugcaagaaguccagcuccuacuucgugcccgacgcccggagccgcugcacguccgugcggcgcugccggugggcgggggacugccagagcggcugccccucccacuucaccagcaacuccuucagcgacgacugggccgggaagauggaccgcgccggccugggguucuccggcugcagcgacggcugcgggggcgccgcgugcgggugcuucaacgccgccccguccugcaucuucuggcggaagugggucgagaacccccacggcaucaucuggaaggugagccccugcgccgccugggugcccuccgcggucaucgagcugaccaugccgagcggggaggugcgcaccuuccaccccauguccggcauccccacccagguguucaagggcgucagcgugaccuaccucggguccgacauggaggugagcggccugaccgaccugugcgagaucgaggagcucaagagcaagaagcuggcccuggcccccugcaaccaggccgggaugggcgucgugggcaaggugggggagauccagugcuccagcgaggaguccgcccggaccaucaagaaggacggcugcaucuggaacgcggaccuggucgggaucgagcuccgcguggacgacgccgugugcuacagcaagaucacguccgucgaggccguggccaacuacagcgccaucccgaccaccaucggcgggcugcgguucgagcgcucccacgacagccagggcaagaucuccggcagcccccuggacaucaccgcgauccggggguccuucagcgugaacuaccgcggccuccggcugucccugagcgagaucacggccacgugcaccggggaggucaccaacguguccggcugcuacagcugcaugaccggggccaagguguccaucaagcuccacagcuccaagaacagcacggcccacguccgcugcaagggcgacgagaccgcguucagcgugcuggagggcgugcacuccuacaccgucagccuguccuucgaccacgccgugguggacgagcagugccagcucaacugcgggggccacgagagccaggucacccugaaggggaaccugaucuuccucgacgugcccaaguucguggacggcuccuacaugcagacguaccacagcuccguccccaccggggccaacaucccgagccccaccgacuggcugaacgcccuguucggcaacggccucucccgcuggauccugggggugaucggcguccugcucgggggccuggcccuguucagccucaucaugucccuguucaagcugggcaccaagcaggucuuccggagccgcacgaagcucgcguga

SEQ ID NO: 13200 - RNA, 3222 nt, Artificial Sequence
  derived and/or modified CDS sequence (opt1) from SFTSV(SPL121A)__AB985323.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagccccaaggacuucgucugcuacaaggaggggaccggccccugcuccgagagcgaggagaagaccugcaagaccuccggcagcugccgcggggacaugcaguucugcaagguggcgggcugcgagcacggggaggaggccuccgaggccaagugccggugcagccuggugcacaagccgggcgaggucgugguguccuacgggggcaugcggguccgccccaagugcuacggcuucagccggaugauggccacgcuggaggugaacagccccgagcagcgcaucgggcagugcaccggcugccaccucgagugcaucaacgggggcgugcggcugaucacccugaccuccgagcucaagagcgcgacggucugcgccucccacuucugcagcuccgccaccagcgggaagaaguccaccgagauccaguuccacagcggcucccuggugggcaagaccgccauccacgucaagggggcccugguggacggcacggaguucaccuucgaggggagcugcauguuccccgacggcugcgacgcgguggacugcaccuucugccgcgaguuccucaagaacccgcagugcuaccccgccaagaaguggcuguucaucaucaucgucauccugcucggcuacgccgggcugaugcugcucaccaacgugcugaaggccaucggcguguggggguccugggucaucgcccccgugaagcugauguucgcgaucaucaagaagcucaugcggagcguguccugccugaugggcaagcugauggaccgcgggcggcaggucauccacgaggagaucggcgagaaccgcgagggcaaccaggacgacgugcggaucgagauggcccgcccccgccgggugcgccacuggauguacagcccggucauccucacgauccuggccaucgggcuggccgagggcugcgacgagauggugcacgccgacuccaagcucgugagcugcaagcagggguccggcaacaugaaggagugcgucaccaccgggcgggcgcugcugcccgccgugaaccccggccaggaggccugccuccacuucaccgcccccggcagcccggacagcaagugccugaaggugaaggucaagcgcaucaaccugaagugcaagaaguccagcuccuacuucgugcccgacgcccggagccgcugcacguccgugcggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaagugggucgagaacccccacggcaucaucuggaaggugagccccugcgccgccugggugcccuccgcggucaucgagcugaccaugccgagcggggaggugcgcaccuuccaccccauguccggcauccccacccagguguucaagggcgucagcgugaccuaccugggguccgacauggaggugagcggccucaccgaccugugcgagauggaggagcucaagagcaagaagcuggcccuggcccccugcaaccaggccgggaugggcgucgugggcaaggugggggagauccagugcuccagcgaggaguccgcccggaccaucaagaaggacggcugcaucuggaacgcggaccuggucgggaucgagcugcgcguggacgacgccgugugcuacagcaagaucacguccgucgaggccguggccaacuacagcgccaucccgaccaccaucggcgggcuccgguucgagcgcucccacgacagccagggcaagaucuccggcagcccccuggacaucaccgcgauccggggguccuucagcgugaacuaccgcggccugcggcucucccugagcgagaucacggccacgugcaccggggaggucaccaacguguccggcugcuacagcugcaugaccggggcccgcguguccaucaagcugcacagcuccaagaacagcacggcccacguccgcugcaagggcgacgagaccgcguucagcgugcucgagggcgugcacuccuacaccgucagccuguccuucgaccacgccgugguggacgagcagugccagcugaacugcgggggccacgagagccaggucacccucaaggggaaccugaucuuccuggacgugcccaaguucguggacggcuccuacaugcagacguaccacagcuccguccccaccggggccaacaucccgagccccaccgacuggcucaacgcccuguucggcaacggccugucccgguggauccucggggugaucggcguccugcucgggggccuggcccuguucuuccugaucaugagccucuucaagcugggcaccaagcaggucuuccgcucccggacgaagcuggcguga

SEQ ID NO: 13201 - RNA, 3222 nt, Artificial Sequence
  derived and/or modified CDS sequence (opt1) from SFTSV(SPL124A)__AB985324.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacucccccgagcagcgcaucgggcagugcaccggcugccaccucgagugcaucaacgggggcgugcggcugaucacccugaccagcgagcucaaguccgcgacggucugcgccagccacuucugcuccagcgccaccuccgggaagaaguccaccgagauccaguuccacagcggcagccuggugggcaagaccgccauccacgucaagggggcccugguggacggcacggaguucaccuucgagggguccugcauguuccccgacggcugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugauguucgcgaucaucaagaagcucaugcgguccgugagcugccugaugggcaagcugauggaccgcgggcggcaggucauccacgaggagaucggcgagaaccgcgagggcaaccaggacgacgugcggaucgagauggcccgcccccgccgggugcgccacuggauguacucccccgucauccucacgauccuggccaucgggcuggccgagggcugcgacgagauggugcacgccgacagcaagcucguguccugcaagcaggggagcggcaacaugaaggagugcgucaccaccgggcgggcgcugcugccggccgugaaccccggccaggaggccugccuccacuucaccgcccccggcagccccgacuccaagugccugaagauccgcgugaagcggaucaaccugaagugcaagaaguccagcagcuacuucgucccggacgcccgcucccggugcacgagcgugcgccggugccgcugggcgggggacugccaguccggcugccccagccacuucaccuccaacagcuucuccgacgacugggccgggaagauggaccgggccggccucggguucagcggcugcuccgacggcugcgggggcgccgcgugcgggugcuucaacgccgcccccagcugcaucuucuggcgcaaguggguggagaacccgcacggcaucaucuggaaggucucccccugcgccgccugggugcccagcgcggugaucgagcugaccaugcccuccggggagguccggaccuuccacccgaugagcggcauccccacccagguguucaagggcguguccgucaccuaccuggggagcgacauggaggugagcggccucaccgaccugugcgagaucgaggagcugaaguccaagaagcuggcccucgcccccugcaaccaggccgggaugggcguggucggcaaggugggggagauccagugcagcuccgaggagagcgcccgcaccaucaagaaggacggcugcaucuggaacgcggaccugguggggaucgagcugcgggucgacgacgccgugugcuacuccaagaucacgagcguggaggccgucgccaacuacuccgccauccccaccaccaucggcgggcuccgcuucgagcggagccacgacucccagggcaagaucagcggcuccccgcuggacaucaccgcgauccgcgggagcuucuccgugaacuaccggggccugcgccucagccuguccgagaucacggccacgugcaccggggaggugaccaacgucagcggcugcuacuccugcaugaccggggcccgcgugagcaucaagcugcacuccagcaagaacagcacggcccacgugcggugcaagggcgacgagaccgcguucuccguccucgagggcgugcacagcuacaccgugucccugagcuucgaccacgccgucguggacgagcagugccagcugaacugcgggggccacgagucccaggugacccucaaggggaaccugaucuuccuggacguccccaaguucguggacggcagcuacaugcagacguaccacuccagcgugcccaccggggccaacauccccuccccgaccgacuggcucaacgcccuguucggcaacggccugagccgcuggauccucggggucaucggcgugcugcucgggggccuggcccuguucuuccugaucaucucccucuucaagcugggcaccaagcaggucuuccggagccgcacgaagcuggcguga

SEQ ID NO: 13202 - RNA, 3222 nt, Artificial Sequence
  derived and/or modified CDS sequence (opt1) from SFTSV(SPL128A)__AB985325.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacucccccgagcagcgcaucgggcagugcaccggcugccaccucgagugcaucaacgggggcgugcggcugaucacccugaccagcgagcucaaguccgcgacggucugcgccagccacuucugcuccagcgccaccuccgggaagaaguccaccgagauccaguuccacagcggcagccuggugggcaagaccgccauccacgucaagggggcccugguggacggcacggaguucaccuucgagggguccugcauguuccccgacggcugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugauguucgcgaucaucaagaagcucaugcgguccgugagcugccugaugggcaagcugauggaccgcgggcggcaggucauccacgaggagaucggcgagaaccgcgagggcaaccaggacgacgugcggaucgagauggcccgcccccgccgggugcgccacuggauguacucccccgucauccucacgauccuggccaucgggcuggccgagggcugcgacgagauggugcacgccgacagcaagcucguguccugcaagcaggggagcggcaacaugaaggagugcgucaccaccgggcgggcgcugcugccggccgugaaccccggccaggaggccugccuccacuucaccgcccccggcagccccgacuccaagugccugaagauccgcgugaagcggaucaaccugaagugcaagaaguccagcagcuacuucgucccggacgcccgcucccggugcacgagcgugcgccggugccgcugggcgggggacugccaguccggcugccccagccacuucaccuccaacagcuucuccgacgacugggccgggaagauggaccgggccggccucggguucagcggcugcuccgacggcugcgggggcgccgcgugcgggugcuucaacgccgcccccagcugcaucuucuggcgcaaguggguggagaacccgcacggcaucaucuggaaggucucccccugcgccgccugggugcccagcgcggugaucgagcugaccaugcccuccggggagguccggaccuuccacccgaugagcggcauccccacccagguguucaagggcguguccgucaccuaccuggggagcgacauggaggugagcggccucaccgaccugugcgagaucgaggagcugaaguccaagaagcuggcccucgcccccugcaaccaggccgggaugggcguggucggcaaggugggggagauccagugcagcuccgaggagagcgcccgcaccaucaagaaggacggcugcaucuggaacgcggaccugguggggaucgagcugcgggucgacgacgccgugugcuacuccaagaucacgagcguggaggccgucgccaacuacuccgccauccccaccaccaucggcgggcuccgcuucgagcggagccacgacucccagggcaagaucagcggcuccccgcuggacaucaccgcgauccgcgggagcuucuccgugaacuaccggggccugcgccucagccuguccgagaucacggccacgugcaccggggaggugaccaacgucagcggcugcuacuccugcaugaccggggcccgcgugagcaucaagcugcacuccagcaagaacagcacggcccacgugcggugcaagggcgacgagaccgcguucuccguccucgagggcgugcacagcuacaccgugucccugagcuucgaccacgccgucguggacgagcagugccagcugaacugcgggggccacgagucccaggugacccucaaggggaaccugaucuuccuggacguccccaaguucguggacggcagcuacaugcagacguaccacuccagcgugcccaccggggccaacauccccuccccgaccgacuggcucaacgcccuguucggcaacggccugagccgcuggauccucggggccaucggcguccugcucgggggccuggcgcuguucuuccugaucaucucccucuucaagcugggcaccaagcaggucuuccggagccgcacgaagcuggccuga

SEQ ID NO: 13203 - RNA, 3222 nt, Artificial Sequence
  derived and/or modified CDS sequence (opt1) from SFTSV(SPL129A)__AB985326.1__GP
augaugaaggugaucugguucagcucccugaucugccucgucauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuaccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacgggggcaugcggguccgcccgaagugcuacggcuucagccggaugauggccacgcuggaggugaacccgcccgagcagcgcaucgggcagugcaccggcugccaccucgagugcaucuccgggggcgugcggcugaucacccugaccagcgagcucaaguccgcgacggucugcgccagccacuucugcuccagcgccaccuccgggaagaaguccaccgagauccaguuccacuccggcagccuggugggcaaggccgccauccacgucaagggggcgcugguggacggcaccgaguucacguucgagggguccugcauguuccccgacggcugcgacgccguggacugcaccuucugccgcgaguuccucaagaacccccagugcuaccccgccaagaaguggcuguucaucaucaucgucauccugcucggcuacgccgggcugaugcugcucaccaacgugcugaaggccaucggcgugugggggagcugggucaucgcgcccgugaagcugauguucgccaucaugaagaagcucaugcgguccgugagcugccugaugggcaagcugauggaccgcgggcggcaggucauccacgaggagaucggcgagaaccgcgagggcaaccgggacgacgugcgcaucgagauggcccgcccccggcgcgugcggcacuggauguacuccccggucauccucaccauccuggccaucgggcuggccgagggcugcgacgagauggugcacgcggacagcaagcucguguccugccgccaggggagcggcaacaugaaggagugcgucacgaccgggcgggcccugcugcccgccgugaaccccggccaggaggccugccuccacuucaccgcccccggcagcccggacuccaagugccugaagaucaaggugaagcgcaucaaccugaagugcaagaaguccagcagcuacuucguccccgacgcgcggucccgcugcaccagcgugcggcgcugccggugggccggggacugccaguccggcugccccagccacuucacguccaacagcuucuccgacgacugggccgggaagauggaccgcgccggccucggguucagcggcugcuccgacggcugcgggggcgcggccugcgggugcuucaacgccgccccgagcugcaucuucuggcggaaguggguggagaacccccacggcaucaucuggaaggucucccccugcgccgcgugggugcccagcgccgugaucgagcugaccaugccguccggggagguccgcaccuuccaccccaugagcggcauccccacccagguguucaagggcguguccgucacguaccuggggagcgacauggaggugagcggccucaccgaccugugcgagaucgaggagcugaaguccaagaagcuggcccucgcccccugcaaccaggccgggaugggcguggucggcaaggugggggagauccagugcagcuccgaggagagcgcgcggaccaucaagaaggacggcugcaucuggaacgccgaccugguggggaucgagcugcgcgucgacgacgccgugugcuacuccaagaucaccagcguggagacggucgccaacuacuccgccaucccgaccaccaucggcgggcuccgguucgagcgcagccacgacucccagggcaagaucagcggcagcccccuggacaucaccgcgauccgggggagcuucuccgugaacuaccgcggccugcgccucagccuguccgagaucacggcgaccugcaccggggaggugaccaacgucagcggcugcuacuccugcaugaccggggccaaggugagcaucaagcugcacuccagcaagaacagcacggcccacgugcggugcaaggaggacgagaccgccuucuccguccucgagggcgugcacagcuacaccgugucccugagcuucgaccacgccgucguggacgagcagugccagcugaacugcggcgggcacgagucccacgugacccucaagggcaaccugaucuuccuggacguccccaaguucguggacgggagcuacaugcagacguaccacuccagcgugcccaccggcgccaacaucccgucccccaccgacuggcucaacgcccuguucgggaacggccugagccgcuggauccucggcgucaugggggugcugcugggcgggcucgcccuguucuuccugaucaugucccucuucaagcugggcaccaagcaggucuuccggagccgcacgaagcuggcguga

SEQ ID NO: 13204 - RNA, 3222 nt, Artificial Sequence
  derived and/or modified CDS sequence (opt1) from SFTSV(YG1)__AB817987.1__GP
augaugaaggugaucugguucagcucccugaucugccucgugauccagugcagcggcgacaccgggcccaucaucugcgccggcccgauccacuccaacaagagcgccaacaucccccaccuccugggguacuccgagaagaucugccagaucgaccgccugauccacgugagcuccuggcugcggaaccacagccaguuccagggcuacguggggcagcgcggcggccggucccaggucagcuacuuccccgcggagaacuccuacagccgcugguccgggcugcucagccccugcgacgccgacuggcugggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcucugcagcagcgacuccggcaccagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagagcgagucccucccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggcuccugccgcggggacaugcaguucugcaagguggcgggcugcgagcacggggaggagacgagcgaggccaagugccggugcucccuggugcacaagcccggcgaggucguggugagcuacgggggcaugcggguccgcccgaagugcuacggcuucagccggaugauggccacccuggaggugaacccgcccgagcagcgcaucgggcagugcaccggcugccaccucgagugcaucaacgggggcgugcggcugaucacccugacguccgagcucaagagcgccaccgucugcgcgucccacuucugcagcuccgccaccagcgggaagaaguccaccgagauccaguuccacagcggcucccuggugggcaagacggccauccacgucaagggggcccugguggacggcaccgaguucaccuucgaggggagcugcauguuccccgacggcugcgacgccguggacugcaccuucugccgcgaguuccucaagaacccccagugcuaccccgcgaagaaguggcuguucaucaucaucgucauccugcucggcuacgccgggcugaugcugcucacgaacgugcugaaggccaucggcaucuggggguccugggugaucgcccccgucaagcugauguucgccaucaucaagaagcucaugcggagcguguccugccugaugggcaagcugauggaccgcgggcgccaggugauccacgaggagaucggcgagaaccgggagggcaaccaggaggacguccggaucgagauggcgcgcccccgccgggugcgccacuggauguacagcccggugauccucgccauccuggccaucgggcuggccgagggcugcgacgagaugguccacgccgacuccaagcucgugagcugcaagcagggguccggcaacaugaaggagugcgugaccaccgggcgggcgcugcugcccgccgucaaccccggccaggaggccugccuccacuucaccgcccccggcagcccggacagcaagugccugaagaucaaggugaagcgcaucaaccugaagugcaagaaguccagcuccuacuucgugcccgacgcccggagccgcugcacguccguccggcgcugccggugggcgggggacugccagagcggcugccccucccacuucaccagcaacuccuucagcgacgacugggccgggaagauggaccgcgccggccucggguucuccggcugcagcgacggcugcgggggcgccgcgugcgggugcuucaacgccgccccguccugcaucuucuggcggaaguggguggagaacccccacggcaucaucuggaaggugagccccugcgccgccuggguccccuccgcggugaucgagcugaccaugccgagcggggaggugcgcaccuuccaccccauguccggcauccccacgcaggucuucaagggcgugagcgugaccuaccugggguccgacauggaggucagcggccucaccgaccugugcgagaucgaggagcucaagagcaagaagcuggcccuggcccccugcaaccaggccgggaugggcguggugggcaaggucggggagauccagugcuccagcgaggaguccgcccggaccaucaagaaggacggcugcaucuggaacgcggaccugguggggaucgagcugcgcguggacgacgccgucugcuacagcaagaucacguccguggaggccguggccaacuacagcgccaucccgaccaccaucggcgggcuccgguucgagcgcucccacgacagccagggcaagaucuccggcagcccccuggacaucaccgcgauccggggguccuucagcgucaacuaccgcggccugcggcucucccugagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcucgagggcguccacuccuacaccgugagccuguccuucgaccacgccguggucgacgagcagugccagcugaacugcgggggccacgagagccaggugacccucaaggggaaccugaucuuccuggacgugcccaaguucgucgacggcuccuacaugcagacguaccacagcuccgugcccaccggggccaacaucccgagccccaccgacuggcucaacgcccuguucggcaacggccugucccgcuggauccucggggugaucggcguccugcucgggggccuggcccuguucuuccugaucaugagccucuucaagcugggcaccaagcaggucuuccggucccgcacgaagcuggcguga

SEQ ID NO: 13205 - RNA, 3222 nt, Artificial Sequence
  derived and/or modified CDS sequence (opt1) from SFTSV(SDTA_1)__KX641913.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggcccgggagagcgacaugaucgucccgggccccuccuacaaggggaagguguucuucgagcgccccaccuucgacggcuacgugggcugggggugcggcagcgggaagucccggaccgagagcggcgagcucugcagcuccgacagcggcacguccagcgggcugcugcccuccgaccgcguccucuggaucggcgacguggccugccagcugaugaccccgauccccgaggagaccuuccuggagcucaagagcuucucccagagcgaguuccccgacaucugcaagaucgacgggaucguguucaaccagugcgagggcgagucccugccccagccguucgacgucgccuggauggacguggggcacagccacaagaucaucaugcgggagcacaagaccaagugggugcaggaguccagcuccaaggacuucgucugcuacaaggagggcacgggccccugcagcgaguccgaggagaaggcgugcaagaccagcggguccugccgcggcgacaugcaguucugcaagguggccgggugcgagcacggcgaggagaccagcgaggccaagugccggugcucccuggugcacaagcccggggaggucguggugagcuacggcggcaugcgcguccggcccaagugcuacggguucagccgcaugauggccacccucgaggugaacccgcccgagcagcggaucggccagugcacggggugccaccuggagugcaucaacggcggggugcgccugaucacccucaccuccgagcugcggagcgcgaccgucugcgccucccacuucugcagcuccgccagcuccggcaagaaguccacggagauccacuuccacuccggcagccugguggggaagaccgccauccacgucaagggcgcccucguggacgggaccgaguucaccuucgagggcuccugcauguuccccgacggcugcgacgcgguggacugcacguucugccgcgaguuccugaagaacccccagugcuacccggccaagaaguggcuguucaucaucaucgucauccuccugggguacgccggccugaugcuccugaccaacgugcugaaggccaucgggguguggggcagcugggucaucgcccccgugaagcucauguucgcgaucaucaagaagcugaugcggaccguguccugccuggucgggaagcucauggaccgcggccgccaggugauccacgaggagaucggcgagaacggggagggcaaccaggacgacgugcggaucgagaucgcccgcccccggcgcguccggcacuggauguacagccccgugauccugaccauccuggccaucgggcucgccgagggcugcgacgagauggugcacgccgacuccaagcuggucagcugccgccagggguccggcaacaugaaggagugcaucacgaccggccgggcgcugcucccggccgugaaccccgggcaggaggccugccugcacuucaccgcccccggcagccccgacagcaagugccugaagaucaaggugaagcgcaucaaccucaagugcaagaaguccagcuccuacuucgucccggacgcccggagccgcugcaccuccgugcggcgcugccggugggcgggggacugccagagcggcugcccgccccacuucacguccaacagcuucuccgacgacugggccgggaagauggaccgcgccggccugggcuucagcgggugcuccgacggcugcgggggcgccgcgugcgggugcuucaacgccgcccccagcugcaucuucuggcggaaguggguggagaacccccacggcaucaucuggaaggucucccccugcgccgccugggugcccagcgcggugaucgagcugaccaugccguccggcgagguccgcaccuuccaccccaugagcgggauccccacccagguguucaagggcguguccgucacguaccucgggagcgacauggagguguccggccugaccgaccugugcgagaucgaggagcucaagagcaagaagcuggcccuggcccccugcaaccaggccggcauggggguggucggcaaggugggggagauccagugcagcuccgaggagagcgcccggaccaucaagaaggacggcugcaucuggaacgcggaccugguggggaucgagcuccgcgucgacgacgccgugugcuacuccaagaucaccagcguggaggccgucgccaacuacuccgccaucccgacgaccaucggcggccugcgguucgagcgcagccacgacucccaggggaagaucagcggcagcccccuggacaucaccgcgauccgggggagcuucuccgugaacuaccgcggccuccgccugagccuguccgagaucaccgccacgugcaccggggaggugaccaacgucagcggcugcuacuccugcaugaccggcgccaaggugagcaucaagcuccacuccagcaagaacuccaccgcccacgugcggugcaagggggacgagacggcguucagcguccuggagggcgugcacagcuacaucgugucccugagcuucgaccacgccgucguggacgagcagugccagcucaacugcgggggccacgagucccaggugacccugaaggggaaccugaucuuccucgacguccccaaguucguggacggcagcuacaugcagaccuaccacuccaccgugcccacgggcgccaacaucccgagccccaccgacuggcugaacgcccuguucgggaacggccucucccgcuggauccugggggucaucggcgugcugcucggcgggcuggcccuguucuuccucaucauguuccugcugaagcucggcaccaagcaggucuuccggagccgcaccaagcuggcguga

SEQ ID NO: 13206 - RNA, 3222 nt, Artificial Sequence
  derived and/or modified CDS sequence (opt1) from SFTSV(SDTA_2)__KX641914.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcacaugaucggccagugcaccgggugccaccucgagugcaucaacggcggggugcgccugaucacgcugaccuccgagcuccggagcgccaccgucugcgccucccacuucugcagcuccgccagcuccggcaagaaguccaccgagauccacuuccacuccggcagccugguggggaagacggccauccacgucaagggcgcgcugguggacgggaccgaguucaccuucgagggcuccugcauguuccccgacggcugcgacgccguggacugcaccuucugccgcgaguuccucaagaacccccagugcuaccccgccaagaaguggcuguucaucaucaucgucauccugcucggguacgccggccugaugcugcucacgaacgugcugaaggccaucgggguguggggcagcugggucaucgcgcccgugaagcugauguucgccaucaucaagaagcucaugcggaccguguccugccuggucgggaagcugauggaccgcggccgccaggugauccacgaggagaucggcgagaacggggagggcaaccaggacgacgugcggaucgagauggcccggccccgccgcguccggcacuggauguacagcccggugauccucaccauccuggccaucgggcuggccgagggcugcgacgagauggugcacgcggacuccaagcucgucagcugccgccagggguccggcaacaugaaggagugcaucaccacgggccgggcccugcugcccgccgugaaccccgggcaggaggccugccuccacuucaccgcccccggcagcccggacagcaagugccugaagaucaaggugaagcgcaucaaccugaagugcaagaaguccagcuccuacuucguccccgacgcgcggagccgcugcaccuccgugcggcgcugccggugggccggggacugccagagcggcugcccgccccacuucaccuccaacagcuucuccgacgacugggccgggaagauggaccgcgccggccucggcuucagcgggugcuccgacggcugcgggggcgcggccugcgggugcuucaacgccgcccccagcugcaucuucuggcggaaguggguggagaacccccacggcaucaucuggaaggucucccccugcgccgcgugggugccgagcgccgugaucgagcugacgaugcccuccggcgagguccgcaccuuccaccccaugagcgggauccccacccagguguucaagggcguguccgucaccuaccuggggagcgacauggagguguccggccucacggaccugugcgagaucgaggagcucaagagcaagaagcuggcccuggccccgugcaaccaggccggcauggggguggucggcaaggugggggagauccagugcagcuccgaggagagcgcgcggaccaucaagaaggacggcugcaucuggaacgccgaccugguggggaucgagcugcgcgucgacgacgccgugugcuacuccaagaucaccagcguggaggccgucgccaacuacuccgcgauccccaccacgaucggcggccuccgguucgagcgcagccacgacucccaggggaagaucagcggcagcccccuggacaucaccgccauccgggggagcuucuccgugaacuaccgcggccugcggcucagccuguccgagaucaccgcgaccugcacgggggaggugaccaacgucagcggcugcuacuccugcaugaccggcgccaaggugagcaucaagcugcacuccagcaagaacuccaccgcccacgugcgcugcaagggggacgagaccgccuucagcguccucgagggcgugcacagcuacaucgugucccugagcuucgaccacgccgucguggacgagcagugccagcugaacugcgggggccacgagucccaggugacgcucaaggggaaccugaucuuccuggacguccccaaguucguggacggcagcuacaugcagaccuaccacuccaccgugccgaccggcgccaacauccccagccccacggacuggcucaacgcccuguucgggaacggccugucccgcuggauccucggggucaucggcgugcugcugggcgggcucgcgcuguucuuccugaucauguuccuccugaagcugggcaccaagcaggucuuccggagccgcaccaagcucgccuga

SEQ ID NO: 13207 - RNA, 3222 nt, Artificial Sequence
  derived and/or modified CDS sequence (opt1) from SFTSV(SDTA_3)__KX641915.1__GP
augaugaaggugaucugguucagcucccugaucugccucgugauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccagcuccggcaagaaguccaccgagauccacuuccacuccggcagccugguggggaagacggccauccacgucaagggcgcgcugguggacgggaccgaguucaccuucgagggcuccugcauguuccccgacggcugcgacgccguggacugcaccuucugccgggaguuccucaagaacccccagugcuaccccgccaagaaguggcuguucaucaucaucgucauccugcucggguacgccggccugaugcugcucacgaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgaggucgcccgcccccgccgggugcgccacuggauguacagcccggugauccucaccauccuggccaucgggcuggccgagggcugcgacgagaugguccacgcggacuccaagcucgugagcugccggcagggguccggcaacaugaaggagugcaucaccacgggccgcgcccugcugcccgccgugaaccccgggcaggaggccugccuccacuucaccgcccccggcagcccggacagcaagugccugaagaucaaggucaagcggaucaaccugaagugcaagaaguccagcuccuacuucgugcccgacgcgcgcagccggugcaccuccgugcgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugccgagcgccgucaucgagcugacgaugcccuccggcgaggugcggaccuuccaccccaugagcgggauccccacccagguguucaagggcgucuccgugaccuaccuggggagcgacauggagguguccggccucacggaccugugcgagaucgaggagcucaagagcaagaagcuggcccuggccccgugcaaccaggccggcaugggggucgugggcaaggugggggagauccagugcagcuccgaggagagcgcgcgcaccaucaagaaggacggcugcaucuggaacgccgaccuggucgggaucgagcugcggguggacgacgccgugugcuacuccaagaucaccagcgucgaggccguggccaacuacuccgcgauccccaccacgaucggcggccuccgcuucgagcggagccacgacucccaggggaagaucagcggcagcccccuggacaucaccgccauccgcgggagcuucuccgugaacuaccggggccugcgccucagccuguccgagaucaccgcgaccugcacgggggaggucaccaacgugagcggcugcuacuccugcaugaccggcgccaaggugagcaucaagcugcacuccagcaagaacuccaccgcccacguccgcugcaagggggacgagaccgccuucagcgugcucgagggcgugcacagcuacaucgucucccugagcuucgaccacgccgugguggacgagcagugccagcugaacugcgggggccacgagucccaggucacgcucaaggggaaccugaucuuccuggacgugcccaaguucguggacggcagcuacaugcagaccuaccacuccaccgucccgaccggcgccaacauccccagccccacggacuggcucaacgcccuguucgggaacggccugucccgguggauccucggggugaucggcguccugcugggcgggcucgcgcuguucuuccugaucauguuccuccugaagcugggcaccaagcaggucuuccgcagccggaccaagcucgccuga

SEQ ID NO: 13208 - RNA, 3222 nt, Artificial Sequence
  derived and/or modified CDS sequence (opt1) from SFTSV(SDTA_4)__KX641916.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccaccagcggcaagaaguccacggagauccacuuccacagcggcucccugguggggaagaccgccauccacgucaagggcgcgcugguggacgggaccgaguucaccuucgagggcagcugcaucuuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcuccugggucaucgcgcccgugaagcugaucuucgccaucaugaagaagcucaugcgcaccgugagcugccuggucgggaagcugauggaccggggccgccaggugauccacgaggagaucggcgagaacggggagggcaaccaggacgacgugcggaucgagauggcccgcccccgccggguccgccacuggauguacuccccggugauccucaccauccuggccaucgggcuggccgagggcugcgacgagauggugcacgcggacagcaagcucgucuccugccggcaggggagcggcaacaugaaggagugcaucacgaccggcggggcccugcugcccgccgugaaccccggccaggaggccugccuccacuucaccgcccccggguccccggacagcaagugccugaagaucaaggugaagcgcaucaaccugaagugcaagaaguccagcagcuacuucguccccgacgcgcggucccgcugcaccagcgugcggcgcugccggugggccggcgacugccaguccgggugcccgccccacuucacgagcaacuccuucagcgacgacugggccggcaagauggaccgcgccggccucggguucuccggcugcagcgacgggugcggcggggcggccugcggcugcuucaacgccgcccccuccugcaucuucuggcggaaguggguggagaacccccacggcaucaucuggaaggucagccccugcgccgcgugggugccguccgccgugaucgagcugaccaugcccagcggggagguccgcaccuuccaccccauguccggcauccccacccagguguucaagggggugagcgucacguaccugggcuccgacauggaggugagcggccucaccgaccugugcgagaucgaggagcugaaguccaagaagcuggcccucgccccgugcaaccaggccgggaugggcguggucgggaaggugggcgagauccagugcagcagcgaggaguccgcgcggaccaucaagaaggacgggugcaucuggaacgccgaccuggugggcaucgagcugcgcgucgacgacgccgugugcuacagcaagaucaccuccguggaggccgucgccaacuacagcgcgauccccacgaccaucggcgggcuccgguucgagcgcucccacgacagccagggcaagaucuccgggagcccccuggacaucaccgccauccggggcuccuucagcgugaacuaccgcgggcugcggcucucccugagcgagaucaccgccacgugcaccggcgaggugaccaacgucuccggcugcuacagcugcaugaccggggccaagguguccaucaagcugcacagcuccaagaacagcaccgcgcacgugcgcugcaagggcgacgagacggccuucuccguccucgagggggugcacagcuacaucgugagccuguccuucgaccacgccgucguggacgagcagugccagcugaacugcggcgggcacgagagccaggugacccucaagggcaaccugaucuuccuggacguccccaaguucguggacggcuccuacaugcagaccuaccacagcaccgugccgacgggggccaacauccccucccccaccgacuggcucaacgcccuguucggcaacgggcugagccgcuggauccucggcgucaucggcgugcugcucgggggccuggcgcuguucuuccugaucauguuccuccugaagcuggggaccaagcaggucuuccggucccgcaccaagcucgccuga

SEQ ID NO: 13209 - RNA, 3222 nt, Artificial Sequence
  derived and/or modified CDS sequence (opt1) from SFTSV(HBGS13_human_2015)__KY440773.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggcaucgccgagagcugcgacgagaugguccacgccgacuccaagcuggugagcugccggcagggguccggcaacaugaaggagugcgugaccaccgggcgcgcgcugcucccggccgucaaccccggccaggaggccugccugcacuucaccgcccccggcagccccgacagcaagugccugcggaucaaggugaagcgcaucaaccucaagugcaagaaguccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcugaccaugccguccggggaggugcgcaccuuccaccccaugagcggcauccccacgcaggucuucaagggcguguccgugaccuaccucgggagcgacauggaggucuccggccugaccgaccugugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcuccgcguggacgacgccgucugcuacuccaagaucacgagcguggaggccguggccaacuacuccgccaucccgaccaccaucggcgggcugcgguucgagcgcagccacgacucccagggcaagaucagcggcagcccccuggacaucaccgcgauccgggggagcuucuccgucaacuaccgcggccuccgccugagccuguccgagaucacggcgaccugcaccggggaggugaccaacgugagcggcugcuacuccugcaugaccggggccaaggucagcaucaagcuccacuccagcaagaacuccacggcccacgugcggugcaagggcgacgagaccgccuucagcgugcuggagggcguccacagcuacaccgugucccugagcuucgaccacgccguggucgacgagcagugccagcucaacugcgggggccacgagucccaggugacccugaaggggaaccugaucuuccucgacgugcccaaguucgucgacggcagcuacaugcagacguaccacuccaccgugcccaccggggccaacaucccgagccccaccgacuggcugaacgcccuguucggcaacggccucucccgcuggauccugggggugaugggcguccugcucgggggccuggcccuguucaucaucaucaugagccucuucaagcugggcacgaagcaggucuuccggucccgcaccaagcuggcguga

SEQ ID NO: 13210 - RNA, 3222 nt, Artificial Sequence
  derived and/or modified CDS sequence (opt1) from SFTSV(HBMC16_human_2015)__KY440776.1__GP
augaugaaggugaucugguucagcucccuggucugccucgugauccagugcagcggcgacuccgggcccaucaucugcgccggcccgauccacagcaacaaguccgccgggaucccccaccugcugggcuacagcgagaagaucugccagaucgaccgccucauccacguguccagcuggcugcggaaccacucccaguuccagggguacgucggccagcgcggcgggcggagccagguguccuacuaccccgcggagaacagcuacucccgcuggagcggccugcucucccccugcgacgccgacuggcuggggaugcugguggucaagaaggccaagggcagcgacaugaucgugccggggcccuccuacaagggcaagguguucuucgagcggcccaccuucgacggcuacgucggguggggcugcgggagcggcaagucccgcaccgagagcggcgagcucugcagcuccgacagcgggacguccagcggccugcugcccuccgaccgggugcucuggaucggggacguggccugccagccgaugacccccauccccgaggagaccuuccuggagcugaagagcuucucccagagcgaguuccccgacaucugcaagaucgacggcaucgucuucaaccagugcgagggggagucccucccgcagcccuucgacguggccuggauggacgugggccacagccacaagaucaucaugcgcgagcacaagaccaaguggguccaggaguccagcuccaaggacuucgugugcuacaaggagggcacggggcccugcagcgaguccgaggagaaggcgugcaagaccagcggcuccugccggggggacaugcaguucugcaagguggccggcugcgagcacggggaggaggccagcgaggccaagugccgcugcucccugguccacaagcccggcgaggugguggucagcuacggcgggaugcgggugcgcccgaagugcuacggcuucagccggaugauggcgaccauggaggugaacccccccgagcagcgcaucgggcagugcaccggcugccaccuggagugcaucaacgggggcguccggcucaucacgcugaccuccgagcugaagagcgccaccgugugcgccucccacuucugcagcuccgccaccagcggcaagaaguccacggagauccacuuccacagcgggucccucgucggcaaggccgcgauccacgugaagggggcccugguggacggcaccgaguucaccuucgagggcagcugcauguuccccgacgggugcaacgccgucgacugcaccuucugccgcgaguuccugaagaacccgcagugcuaccccgccaagaaguggcucuucaucaucaucgugauccugcugggcuacgccgggcucaugcugcugacgaacgugcucaaggcgaucggcgucuggggguccugggugaucgcccccgugaagcugauguucgccaucaugaagaagcugaugcggaccgucagcugccucgugggcaagcugauggaccgcggccggcaggugauccacgaggagaucggggagaacggcgaggggaaccaggacgacguccgcaucgagauggcccggccccgccgcgugcggcacuggauguacuccccggugauccugaccauccucgccaucggccuggcggaggggugcgacgagaugguccacgccgacagcaagcugguguccugccgccagggcagcggcaacaugaaggagugcgugaccacggggcgggcccuccugcccgccgucaaccccggccaggaggccugccugcacuucaccgcgcccggguccccggacagcaagugccucaagaucaaggugaagcgcaucaaccugaagugcaagaagagcuccagcuacuucgugcccgacgcccggucccgcugcaccagcguccggcgcugccggugggccggcgacugccaguccgggugccccccgcacuucaccagcaacuccuucagcgacgacugggccggcaagauggaccgcgcgggccugggguucuccggcugcagcgacgggugcggcggggccgccugcggcugcuucaacgccgcccccuccugcaucuucuggcggaaguggguggagaacccccacggcaucaucuggaaggugagccccugcgcggccugggucccguccgccgugaucgagcucacgaugcccagcggggaggugcgcaccuuccaccccauguccggcauccccacccaggucuucaagggggugagcgugaccuaccugggcuccgacauggaggucagcggccugacggaccucugcgagaucgaggagcugaaguccaagaagcuggcccuggccccgugcaaccaggcggggaugggcgugguggggaaggucggcgagauccagugcagcagcgaggaguccgcccggaccaucaagaaggacgggugcaucuggaacgccgaccucgugggcaucgagcugcgcguggacgacgccgucugcuacagcaagaucaccuccguggaggccguggcgaacuacagcgccauccccaccacgaucggcgggcugcgguucgagcgcucccacgacagccagggcaagaucuccgggagcccccucgacaucaccgccauccggggcuccuucagcgucaacuaccgcgggcugcggcugucccucagcgagaucaccgccaccugcacgggcgaggugaccaacguguccggcugcuacagcugcaugaccggggcgaaggucuccaucaagcugcacagcuccaagaacagcaccgcccacgugcgcugcaagggcgacgagaccgccuucuccgugcuggaggggguccacagcuacacggugagccucuccuucgaccacgccguggucgacgagcagugccagcugaacugcggcgggcacgagagccaggugacccugaagggcaaccucaucuuccuggacgugcccaaguucgucgacggcuccuacaugcagaccuaccacagcaccgugccgacgggggccaacauccccucccccaccgacuggcugaacgcgcucuucggcaacgggcugagccgcuggauccugggcgucaucggcgugcuccuggggggccuggcccucuucuuccugaucauguuccuguucaagcucgggaccaagcagguguuccggucccgcaccaagcuggccuga

SEQ ID NO: 13211 - RNA, 3222 nt, Artificial Sequence
  derived and/or modified CDS sequence (opt1) from SFTSV(HBMC5_human_2016)__KY440770.1__GP
augaugaaggugaucugguucagcucccuggugugccucgugauccagugcagcggcgacuccgggcccaucaucugcgccggcccgauccacagcaacaaguccgccgggaucccccaccuccugggcuacagcgagaagaucugccagaucgaccgccucauccacguguccagcuggcugcggaaccacucccaguuccagggguacgucggccagcgcggcgggcggagccagguguccuacuaccccgcggagaacagcuacucccgcuggagcggccugcucucccccugcgacgccgacuggcuggggaugcugguggucaagaaggccaagggcagcgacaugaucgugccggggcccuccuacaagggcaaggugcuguucgagcggcccaccuucgacggcuacgucggguggggcugcgggagcggcaagucccgcaccgagagcggcgagcugugcagcuccgacagcgggacguccagcggccugcuccccuccgaccgggugcuguggaucggggacguggccugccagccgaugacccccauccccgaggagaccuuccuggagcucaagagcuucucccagagcgaguuccccgacaucugcaagaucgacggcaucgucuucaaccagugcgagggggagucccugccgcagcccuucgacguggccuggauggacgugggccacagccacaagaucaucaugcgcgagcacaagaccaaguggguccaggaguccagcuccaaggacuucgugugcuacaaggagggcacggggcccugcagcgaguccgaggagaaggcgugcaagaccagcggcuccugccgcggggacaugcaguucugcaagguggccggcugcgagcacggggaggaggccagcgaggccaagugccggugcucccugguccacaagcccggcgaggugguggucagcuacggcgggaugcgggugcgcccgaagugcuacggcuucagccggaugauggcgaccauggaggugaacccgcccgagcagcgcaucgggcagugcaccggcugccaccucgagugcaucaacgggggcguccggcugaucacgcugaccuccgagcucaagagcgccaccgugugcgccucccacuucugcagcuccgccaccagcggcaagaaguccacggagauccacuuccacagcgggucccuggucggcaaggccgcgauccacgugaagggggcccugguggacggcaccgaguucaccuucgagggcagcugcauguuccccgacgggugcaacgccgucgacugcaccuucugccgcgaguuccucaagaacccccagugcuaccccgccaagaaguggcuguucaucaucaucgugauccugcucggcuacgccgggcugaugcugcucacgaacgugcugaaggcgaucggcgucuggggguccugggugaucgcccccgugaagcugauguucgccaucaugaagaagcucaugcggaccgucagcugccuggugggcaagcugauggaccgcggccgccaggugauccacgaggagaucggggagaacggcgaggggaaccaggacgacguccggaucgagauggcccggccccgccgcgugcggcacuggauguacuccccggugauccucaccauccuggccaucggccuggcggaggggugcgacgagaugguccacgccgacagcaagcucguguccugccgccagggcagcggcaacaugaaggagugcgugaccacggggcgggcccugcugcccgccgucaaccccggccaggaggccugccuccacuucaccgcgcccggguccccggacagcaagugccugaagaucaaggugaagcgcaucaaccugaagugcaagaaguccagcagcuacuucgugcccgacgcccggucccgcugcaccagcguccggcgcugccggugggccggcgacugccaguccgggugcccgccccacuucaccagcaacuccuucagcgacgacugggccggcaagauggaccgcgcgggccucggguucuccggcugcagcgacgggugcggcggggccgccugcggcugcuucaacgccgcccccuccugcaucuucuggcggaaguggguggagaacccccacggcaucaucuggaaggugagccccugcgcggccugggucccguccgccgugaucgagcugacgaugcccagcggggaggugcgcaccuuccaccccauguccggcauccccacccaggucuucaagggggugagcgugaccuaccugggcuccgacauggaggucagcggccucacggaccugugcgagaucgaggagcugaaguccaagaagcuggcccucgccccgugcaaccaggcggggaugggcgugguggggaaggucggcgagauccagugcagcagcgaggaguccgcccggaccaucaagaaggacgggugcaucuggaacgccgaccuggugggcaucgagcugcgcguggacgacgccgucugcuacagcaagaucaccuccguggaggccguggcgaacuacagcgccauccccaccacgaucggcgggcuccgguucgagcgcucccacgacagccagggcaagaucuccgggagcccccuggacaucaccgccauccggggcuccuucagcgucaacuaccgcgggcugcggcucucccugagcgagaucaccgcgaccugcacgggcgaggugaccaacguguccggcugcuacagcugcaugaccggggccaaggucuccaucaagcugcacagcuccaagaacagcaccgcccacgugcgcugcaagggcgacgagaccgccuucuccgugcucgaggggguccacagcuacacggugagccuguccuucgaccacgccguggucgacgagcagugccagcugaacugcggcgggcacgagagccaggugacccucaagggcaaccugaucuuccuggacgugcccaaguucgucgacggcuccuacaugcagaccuaccacagcaccgugccgacgggggccaacauccccucccccaccgacuggcucaacgcgcuguucggcaacgggcugagccgcuggauccucggcgucaucggcgugcugcucgggggccuggcccuguucuuccugaucauguuccucuucaagcuggggaccaagcaggucuuccggucccgcaccaagcuggccuga

SEQ ID NO: 13212 - RNA, 3222 nt, Artificial Sequence
  derived and/or modified CDS sequence (opt1) from SFTSV(HB29)__KP202164.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccagcuccggcaagaaguccaccgagauccacuuccacuccggcagccugguggggaagacggccauccacgucaagggcgcgcugguggacgggaccgaguucaccuucgagggcuccugcauguuccccgacggcugcgacgccguggacugcaccuucugccgggaguuccucaagaacccccagugcuaccccgccaagaaguggcuguucaucaucaucgucauccaccugggguacgccggccucaugcugcugacgaacgugcucaaggccaucgggguguggggcagcugggucaucgcgcccgugaagcugauguucgccaucaucaagaagcugaugcgcaccguguccugccucgucgggaagcugauggaccggggccgccaggugauccacgaggagaucggcgagaacggggagggcaaccaggacgacgugcggaucgagauggcccgcccccgccggguccgccacuggauguacagcccggugauccugaccauccucgccaucgggcuggccgagggcugcgacgagauggugcacgcggacuccaagcuggucagcugccggcagggguccggcaacaugaaggagugcaucaccacgggccgcgcccuccugcccgccgugaaccccgggcaggaggccugccugcacuucaccgcccccggcagcccggacagcaagugccucaagaucaaggugaagcggaucaaccugaagugcaagaaguccagcuccuacuucguccccgacgcgcgcagccggugcaccuccgugcgccggugccgcugggccggggacugccagagcggcugcccgccccacuucaccuccaacagcuucuccgacgacugggccgggaagauggaccgggccggccugggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcucacgaugcccuccggcgagguccggaccuuccaccccaugagcgggauccccacccagguguucaagggcguguccgucaccuaccuggggagcgacauggagguguccggccugacggaccucugcgagaucgaggagcucaagagcaagaagcuggcccuggccccgugcaaccaggccggcauggggguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgauccccaccacgaucggcggccugcgcuucgagcggagccacgacucccaggggaagaucagcggcagcccccucgacaucaccgccauccgcgggagcuucuccgugaacuaccggggccugcgccugagccucuccgagaucaccgcgaccugcacgggggaggugaccaacgucagcggcugcuacuccugcaugaccggcgccaaggugagcaucaagcugcacuccagcaagaacaacaccgcgcacgugcgcugcaagggggacgagaccgccuucuccguccuggagggcgugcacagcuacaucgugagccucuccuucgaccacgccgucguggacgagcagugccagcugaacugcgggggccacgagagccaggugacgcugaaggggaaccucaucuuccuggacguccccaaguucguggacggcuccuacaugcagaccuaccacagcaccgugccgaccggcgccaacauccccucccccacggacuggcugaacgcccucuucgggaacggccugagccgguggauccugggggucaucggcgugcuccugggcgggcuggcccucuucuuccugaucauguuccugcucaagcugggcaccaagcaggucuuccgcucccggaccaagcuggccuga

SEQ ID NO: 13213 - RNA, 3222 nt, Artificial Sequence
  derived and/or modified CDS sequence (opt1) from SFTSV(HNXY_115)__KC292312.1__GP
augaugaaggugaucugguucagcucccugaucuacuucgugauccagugcagcggcgacuccgggagcaucaucugcgccggccccauccacuccaacaagagcgccgacaucccgcaccuccugggguacuccgagaagaucugccagaucgaccgccugauccacgugagcuccuggcuccggaaccacagccaguuccagggcuacguggggcagcgcggcggccggucccaggucagcuacuaccccgcggagaacuccuacagccgcugguccgggcugcugagccccugcgacgccgacuggcucggcaugcugguggugaagaaggccaagggguccgacaugaucguccccggcccgagcuacaaggggaagguguucuucgagcggcccaccuucgacggcuacgugggcugggggugcggcuccggcaagagccgcaccgagagcggggagcugugcuccagcgacuccggcacgagcuccgggcuccugcccagcgaccggguccuguggaucggcgacguggccugccagcccaugaccccgauccccgaggagaccuuccucgagcugaaguccuucagccaguccgaguuccccgacaucugcaagaucgacgggaucguguucaaccagugcgagggcgagagccugccccagccguucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaagaccugcaagaccuccgggagcugccggggcgacaugcaguucugcaagguggcggggugcgagcacggcgaggaggccuccgaggccaagugccgcugcagccucgugcacaagcccggggaggucguggugagcuacggcggcaugcggguccgccccaagugcuacggguucucccggaugauggccacccuggaggugaaccagccggagcagcgcaucggccagugcacggggugccaccuggagugcaucaacggcggggugcggcucaucacccugaccagcgagcugaaguccgcgaccgucugcgccagccacuucugcuccagcgccacguccggcaagaaguccaccgagauccaguuccacagcggcagccucguggggaagaccgccauccacgucaagggcgcccugguggacgggaccgaguucacguucgagggcuccugcauguuccccgacggcugcgacgcgguggacugcaccuucugccgcgaguuccugaagaacccccagugcuaccccgccaagaaguggcuguucaucaucaucgucauccugcugggguacgccggccucaugcugcugaccaacgugcucaaggccaucgggaucuggggcagcugggugaucgccccggucaagcugaucuucgcgaucaucaagaagcugaugcggaccguguccugccucauggggaagcugauggaccgcggccgccaggugauccacgaggagaucggcgagaaccgggaggggaaccaggacgacguccggaucgagauggcccgcccccgccgggugcgccacuggauguacagccccgugauccugacgauccucgccaucggccuggccgaguccugcgacgagaugguccacgccgacagcaagcugguguccugccggcaggggagcggcaacaugaaggagugcgugaccaccgggcgcgcgcuccugcccgccgucaacccgggccaggaggccugccugcacuucaccgcccccggcagccccgacuccaagugccucaagaucaaggugaagcggaucaaccugaagugcaagaaguccagcagcuacuucgugcccgacgcccgcucccggugcacgagcguccgccggugccgcugggcgggggacugccaguccggcugcccgccccacuucaccagcaacuccuucagcgacgacugggccgggaagauggaccgggccggccugggguucuccggcugcagcgacggcugcgggggcgccgcgugcgggugcuucaacgccgcccccuccugcaucuucuggcgcaaguggguggagaacccgcacggcaucaucuggaaggugagccccugcgccgccuggguccccuccgcggugaucgagcucaccaugcccagcggggaggugcggaccuuccacccgauguccggcauccccacgcaggucuucaagggcgugagcgugaccuaccugggguccgacauggaggucagcggccugaccgaccucugcgagaucgaggagcucaagagcaagaagcuggcccuggcccccugcaaccaggccgggaugggcguggugggcaaggucggggagauccagugcuccagcgaggaguccgcccgcaccaucaagaaggacggcugcaucuggaacgcggaccucguggggaucgagcugcggguggacgacgccgucugcuacagcaagaucacguccguggaggccguggccaacuacagcgccauccccaccaccaucggcgggcugcgcuucgagcggucccacgacagccagggcaagaucuccggcagcccgcucgacaucaccgcgauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucagcgugcuggagggcguccacuccuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagacguaccacagcaccgugcccaccggggccaacauccccuccccgaccgacuggcugaacgcccucuucggcaacggccugagccgguggauccugggggugaucggcguccuccucgggggccuggcccuguucuucaugaucaugucccuguucaagcugggcacgaagcaggucuuccgcagccggaccaagcucgcguga

SEQ ID NO: 13214 - RNA, 3222 nt, Artificial Sequence
  derived and/or modified CDS sequence (opt1) from SFTSV(HNXY_144)__KC292307.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaugggcguccuccucgggggccuggcccuguucuucaugaucaugagccuguucaagcugggcacgaagcaggucuuccgcucccggaccaagcucgcguga

SEQ ID NO: 13215 - RNA, 3222 nt, Artificial Sequence
  derived and/or modified CDS sequence (opt1) from SFTSV(HNXY_157)__KC292305.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccuccggaucaaggugaagcgcaucaaccugaagugcaagaaguccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcugcgcguggacgacgccgucugcuacuccaagaucacgagcguggaggccguggccaacuacuccgccaucccgaccaccaucggcgggcugcgguucgagcgcagccacgacucccagggcaagaucagcggcagcccccucgacaucaccgcgauccgggggagcuucuccgucaacuaccgcggccugcgccugagccucuccgagaucacggcgaccugcaccggggaggugaccaacgugagcggcugcuacuccugcaugaccggggccaaggucagcaucaagcugcacuccagcaagaacuccacggcccacgugcggugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgcugggugcugggggucaugggcgugcuccucgggggccuggcccuguucuucaugaucaugagccuguucaagcugggcacgaagcaggucuuccggucccgcaccaagcucgcguga

SEQ ID NO: 13216 - RNA, 3222 nt, Artificial Sequence
  derived and/or modified CDS sequence (opt1) from SFTSV(HNXY_170)__KC292304.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccuccggaucaaggugaagcgcaucaaccugaagugcaagaaguccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcugcgcguggacgacgccgucugcuacuccaagaucacgagcguggaggccguggccaacuacuccgccaucccgaccaccaucggcgggcugcgguucgagcgcagccacgacucccagggcaagaucagcggcagcccccucgacaucaccgcgauccgggggagcuucuccgucaacuaccgcggccugcgccugagccucuccgagaucacggcgaccugcaccggggaggugaccaacgugagcggcugcuacuccugcaugaccggggccaaggucagcaucaagcugcacuccagcaagaacuccacggcccacgugcggugcaagggcgacgagaccgccuucagcgugcuggagggcguccacagcuacaccgugucccucagcuucgaccacgccguggucgacgagcagugccagcugaacugcgggggccacgagucccagaucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgcugggugcugggggugaucggcguccuccucgggggccuggcccuguucuucaugaucaugagccuguucaagcugggcacgaagcaggucuuccggucccgcaccaagcucgcguga

SEQ ID NO: 13217 - RNA, 3222 nt, Artificial Sequence
  derived and/or modified CDS sequence (opt1) from SFTSV(HNXY_174)__KC292306.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugccgcaucgacgggaucguguucaaccagugcgagggcgagucccugccgcagcccuucgacgucgccuggauggacguggggcacagccacaagaucaucaugcgggagcacaagaccaagugggugcaggaguccagcuccaaggacuucgucugcuacaaggagggcacgggccccugcagcgaguccgaggagaagaccugcaagaccagcggguccugccgcggcgacaugcaguucugcaagguggcggggugcgagcacggcgaggaggccagcgaggccaagugccggugcucccucgugcacaagcccggggaggucguggugagcuacggcggcaugcgcguccggccgaagugcuacggguucagccgcaugauggccacccuggaggugaaccagcccgagcagcggaucggccagugcacggggugccaccuggagugcaucaacggcggggugcgccucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgggaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcgcaccgugagcugccucauggggaagcugauggaccggggccgccaggugauccacgaggagaucggcgagaaccgggaggggaaccaggacgacguccgcaucgagauggcccgcccccggcgcgugcggcacuggauguacucccccgugauccugacgauccucgccaucggccuggccgagagcugcgacgagaugguccacgccgacuccaagcuggugagcugccgccagggguccggcaacaugaaggagugcgugaccaccgggcgggcgcuccugccggccgucaaccccggccaggaggccugccugcacuucaccgcccccggcagccccgacagcaagugccuccgcaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccgcggccugcggcugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggcaugucccgguggauccugggggugaugggcguccugcucgggggccuggcccuguucuucaugaucaugagccucuucaagcugggcacgaagcaggucuuccgcucccggaccaagcuggcguga

SEQ ID NO: 13218 - RNA, 3222 nt, Artificial Sequence
  derived and/or modified CDS sequence (opt1) from SFTSV(HNXY_182)__KC292324.1__GP
augaugaaggugaucugguucagcucccugaucugcuucgucauccagugcagcggcgacuccgggcccaucaucugcgccggcccgauccacagcaacaaguccgccgacaucccccaccuccagggguacagcgagaagaucugccagaucgaccgccugauccacguguccagcuggcugcggaaccacucccaguuccagggcuacguggggcagcgcggcggccggagccaggucuccuacuaccccgcggagaacagcuacucccgcuggagcgggcuccugucccccugcgacgccgacuggcugggcaugcucguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcugcuccccuccgaccggguccuguggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggguccgcccgaagugcuacggguucagccggaugauggccacccucgaggugaaccagcccgagcagcgcaucggccagugcacggggugccaccuggagugcaucaacggcggggugcggcugaucacccucaccuccgagcugaaguccgcgaccgucugcgccucccacuucugcagcuccgccacgagcggcaagaaguccaccgagauccaguuccacagcggcucccugguggggaagaccgccauccacgucaagggcgcccucguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccuccugggguacgccggccugaugcuccugaccaacgugcugaaggccaucgggaucuggggcuccugggugaucgcccccgucaagcucaucuucgcgaucaucaagaagcugaugcggaccgugagcugccugauggggaagcucauggaccgcggccgccaggugauccacgaggagaucggcgagaaccgggaggggaaccaggacgacguccggaucgagauggcccgcccccgccgggugcgccacuggauguacucccccgugauccugacgauccuggccaucggccucgccgagagcugcgacgagaugguccacgccgacuccaagcuggugagcugccggcagggguccggcaacaugaaggagugcgugaccaccgggcgcgcgcugcucccggccgucaaccccggccaggaggccugccugcacuucaccgcccccggcagccccgacagcaagugccugaagaucaaggugaagcggaucaaccucaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcugaccaugccguccggggaggugcggaccuuccaccccaugagcggcauccccacgcaggucuucaagggcguguccgugaccuaccucgggagcgacauggaggucuccggccugaccgaccugugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcuccggguggacgacgccgucugcuacuccaagaucacgagcguggaggccguggccaacuacuccgccaucccgaccaccaucggcgggcugcgcuucgagcggagccacgacucccagggcaagaucagcggcagcccccuggacaucaccgcgauccgcgggagcuucuccgucaacuaccggggccuccgccugagccuguccgagaucacggcgaccugcaccggggaggugaccaacgugagcggcugcuacuccugcaugaccggggccaaggucagcaucaagcuccacuccagcaagaacuccacggcccacgugcgcugcaagggcgacgagaccgccuucagcgugcuggagggcguccacagcuacaccgugucccugagcuucgaccacgccguggucgacgagcagugccagcucaacugcgggggccacgagucccaggugacccugaaggggaaccugaucuuccucgacgugcccaaguucgucgacggcagcuacaugcagacguaccacuccaccgugcccaccggggccaacaucccgagccccaccgacuggcugaacgcccuguucggcaacggccucucccgguggauccuggggcugaucggcgugcuccucgggggccuggcccuguucuucaugaucaugagccuguucaagcugggcacgaagcaggucuuccgcucccggaccaagcucgcguga

SEQ ID NO: 13219 - RNA, 3222 nt, Artificial Sequence
  derived and/or modified CDS sequence (opt1) from SFTSV(HNXY_188)__KC292301.1__GP
augaugaaggugaucugguucagcucccugaucugccucgucauccagugcggcgggggcaccgggcccaucaucugcgccggcccgauccacagcaacaaguccgccgacaucccccaccuccugggguacagcgagaagaucugccagaucgaccgccugauccacguguccagcuggcugcggaaccacucccaguuccagggcuacgugggccagcgcgggggccggagccaggucuccuacuaccccgcggagaacagcuacucccgcuggagcgggcugcucucccccugcgacgccgacuggcugggcaugcugguggugaagaaggccaaggggagcgacaugaucgucccgggccccuccuacaagggcaagguguucuucgagcggcccaccuucgacggguacgugggcugggggugcggcagcggcaagucccgcacggagagcggggagcucugcuccagcgacagcggcaccuccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggcgaggucguggugagcuacgggggcaugcggguccgcccgaagugcuacggguucucccggaugauggccacgcuggaggugagccagcccgagcagcgcaucggccagugcaccgggugccaccucgagugcaucaacggcggcgugcggcugaucacccugaccagcgagcucaaguccgcgacggucugcgccagccacuucugcuccagcgccaccuccgggaagaaguccaccgagauccaguuccacuccggcagccugguggggaagaccgccauccacgucaagggcgcccugguggacggcacggaguucaccuucgagggguccugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggguguggggcagcugggucaucgcccccgugaagcugguguucgcgaucaucaagaagcucaugcgggccgucuccugccugaugggcaagcugauggaccgcgggcgccaggugauccacgaggagaucggcgagaaccgggaggggaaccaggacgacgugcggaucgagauggcccgcccccgccggguccgccacuggauguacagccccgugauccucacgauccuggccaucggccuggccgaggggugcgacgagauggugcacgcggacuccaagcucgucagcugccggcagggcuccggcaacaugaaggagugcgugaccaccgggcgcgcccugcugccggccgugaaccccggccaggaggccugccuccacuucaccgcccccgggagccccgacuccaagugccugaagaucaaggucaagcggaucaaccugaagugcaagaaguccagcagcuacuucgugccggacgcgcgcagccggugcacguccgugcgccggugccgcugggccggcgacugccagagcgggugcccgccccacuucaccuccaacagcuucuccgacgacugggccggcaagauggaccgggccggccucggguucagcggcugcuccgacgggugcggcggggcggccugcggcugcuucaacgccgcccccagcugcaucuucuggcgcaagugggucgagaacccccacggcaucaucuggaaggugucccccugcgccgcgugggugcccagcgccgucaucgagcugaccaugccguccggggaggugcggaccuuccaccccaugagcggcauccccacccagguguucaagggggucuccgugaccuaccugggcagcgacauggagguguccggccucaccgaccugugcgagaucgaggagcucaagagcaagaagcuggcccuggcccccugcaaccaggccgggaugggcgucguggggaaggugggcgagauccagugcuccagcgaggagagcgcgcgcaccaucaagaaggacgggugcaucuggaacgccgaccuggucggcaucgagcugcggguggacgacgccgugugcuacuccaagaucacgagcgucgaggccguggccaacuacuccgcgaucccgaccaccaucggcgggcuccgcuucgagcggagccacgacucccagggcaagaucagcgggagcccccuggacaucaccgccauccgcggcagcuucuccgugaacuaccgggggcugcgccucagccuguccgagaucacggccacgugcaccggcgaggucaccaacgugagcggcugcuacuccugcaugaccggggccaaggugagcaucaagcugcacuccagcaagaacuccacggcgcacguccgcugcaagggcgacgagaccgccuucagcgugcucgagggggugcacuccuacagcgucagccuguccuucgaccacgccgugguggacgagcagugccagcugaacugcggcgggcacgagagccaggucacccuccggggcaaccugaucuuccuggacgugcccaaguucguggacggcuccuacaugcagaccuaccacagcacgguccccaccggggccaacaucccgucccccaccgacuggcucaacgcccuguucggcaacgggcugagccgcuggauccucggcgugaucggcguccugcucgggggccuggcgcuguucuuccugaucaugucccucuucaagcuggggaccaagcagaucuuccggagccgcacgaagcuggccuga

SEQ ID NO: 13220 - RNA, 3222 nt, Artificial Sequence
  derived and/or modified CDS sequence (opt1) from SFTSV(HNXY_191)__KC292323.1__GP
augaugaaggugaucugguucagcucccugaucugccucgucauccagugcggcggggacaccggccccaucaucugcgccgggccgacccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccacguucgacggcuacgugggguggggcugcgggagcggcaagucccgcaccgagagcggcgagcucugcuccagcgacagcgggaccuccagcggccugcugcccuccgaccggguccucuggaucggggacguggccugccagccgaugacccccauccccgaggagacguuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagaccaagugggugcaggaguccagcuccaaggacuucgucugcuacaaggagggcaccgggcccugcagcgaguccgaggagaagaccugcaagacgagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacccuggaggugagccagcccgagcagcgcaucgggcagugcaccggcugccaccucgagugcaucaacgggggcgugcggcugaucacccugacgagcgagcucaaguccgcgaccgucugcgccagccacuucugcuccagcgccaccuccggcaagaaguccaccgagauccaguuccacuccgggagccuggugggcaagacggccauccacgucaagggggcccugguggacggcaccgaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucacgaacgugcugaaggccaucggcgugugggggagcugggucaucgcccccgugaagcugguguucgcgaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucaccauccuggccaucgggcuggccgagggcugcgacgagauggugcacgcggacuccaagcucgucagcugccggcagggguccggcaacaugaaggagugcgugaccaccggccgcgcccugcugccggccgugaaccccgggcaggaggccugccuccacuucacggcccccggcagccccgacuccaagugccugaagaucaaggucaagcggaucaaccugaagugcaagaaguccagcagcuacuucgugccggacgcgcgcagccggugcaccuccgugcgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugcccagcgccgucaucgagcugaccaugccguccggcgaggugcggacguuccaccccaugagcgggauccccacccagguguucaagggcgucuccgugaccuaccuggggagcgacauggagguguccggccucaccgaccugugcgagaucgaggagcucaagagcaagaagcuggcccuggcccccugcaaccaggccggcaugggggucgugggcaaggugggggagauccagugcuccagcgaggagagcgcgcgcacgaucaagaaggacggcugcaucuggaacgccgaccuggucgggaucgagcugcggguggacgacgccgugugcuacuccaagaucaccagcgucgaggccguggccaacuacuccgcgaucccgaccaccaucggcggccuccgcuucgagcggagccacgacucccaggggaagaucagcggcagcccccuggacaucacggccauccgcgggagcuucuccgugaacuaccggggccugcgccucagccuguccgagaucaccgcgaccugcaccggggaggucaccaacgugagcggcugcuacuccugcaugacgggcgccaaggugagcaucaagcugcacuccagcaagaacuccaccgcccacguccgcugcaagggggacgagaccgccuucagcgugcucgagggcgugcacuccuacagcgucagccuguccuucgaccacgccgugguggacgagcagugccagcugaacugcgggggccacgagagccaggucacccuccgggggaaccugaucuuccuggacgugcccaaguucguggacggcuccuacaugcagacguaccacagcaccguccccaccggcgccaacaucccgucccccaccgacuggcucaacgcccuguucgggaacggccugagccgcuggauccucggggugaucggcguccugcugggcgggcucgcgcuguucuuccugaucaugucccucuucaagcugggcacgaagcagaucuuccggagccgcaccaagcuggccuga

SEQ ID NO: 13221 - RNA, 3222 nt, Artificial Sequence
  derived and/or modified CDS sequence (opt1) from SFTSV(HNXY_195)__KC292326.1__GP
augaugaaggugaucugguucagcucccugaucugcuucgugauccagugcagcggcgacuccgggcccaucaucugcgccggcccgauccacagcaacaaguccgccgacaucccccaccuccagggguacagcgagaagaucugccagaucgaccgccugauccacguguccagcuggcugcggaaccacucccaguuccagggcuacguggggcagcgcggcggccggagccaggucuccuacuaccccgcggagaacagcuacucccgcuggagcgggcuccugucccccugcgacgccgacuggcugggcaugcucguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcugcuccccuccgaccggguccuguggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggguccgcccgaagugcuacggguucagccggaugauggccacccucgaggugaaccagcccgagcagcgcaucggccagugcacggggugccaccuggagugcaucaacggcggggugcggcugaucacccucaccuccgagcugaaguccgcgaccgucugcgccucccacuucugcagcuccgccacgagcggcaagaaguccaccgagauccaguuccacagcggcucccugguggggaagaccgccauccacgucaagggcgcccucguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccuccugggguacgccggccugaugcuccugaccaacgugcugaaggccaucgggaucuggggcuccugggugaucgcccccgucaagcucaucuucgcgaucaucaagaagcugaugcggaccgugagcugccugauggggaagcucauggaccgcggccgccaggugauccacgaggagaucggcgagaaccgggaggggaaccaggacgacguccggaucgagauggcccgcccccgccgggugcgccacuggauguacucccccgugauccugacgauccuggccaucggccucgccgagagcugcgacgagaugguccacgccgacuccaagcuggugagcugccggcagggguccggcaacaugaaggagugcgugaccaccgggcgcgcgcugcucccggccgucaaccccggccaggaggccugccugcacuucaccgcccccggcagccccgacagcaagugccugaagaucaaggugaagcggaucaaccucaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcugaccaugccguccggggaggugcggaccuuccaccccaugagcggcauccccacgcaggucuucaagggcguguccgugaccuaccucgggagcgacauggaggucuccggccugaccgaccugugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcuccggguggacgacgccgucugcuacuccaagaucacgagcguggaggccguggccaacuacuccgccaucccgaccaccaucggcgggcugcgcuucgagcggagccacgacucccagggcaagaucagcggcagcccccuggacaucaccgcgauccgcgggagcuucuccgucaacuaccggggccuccgccugagccuguccgagaucacggcgaccugcaccggggaggugaccaacgugagcggcugcuacuccugcaugaccggggccaaggucagcaucaagcuccacuccagcaagaacuccacggcccacgugcgcugcaagggcgacgagaccgccuucagcgugcuggagggcguccacagcuacaccgugucccugagcuucgaccacgccguggucgacgagcagugccagcucaacugcgggggccacgagucccaggugacccugaaggggaaccugaucuuccucgacgugcccaaguucgucgacggcagcuacaugcagacguaccacuccaccgugcccaccggggccaacaucccgagccccaccgacuggcugaacgcccuguucggcaacggccucucccgguggauccugggggugaucggcguccugcucgggggccuggcccuguucuucaugaucaugagccucuucaagcugggcacgaagcaggucuuccgcucccggaccaagcuggcguga

SEQ ID NO: 13222 - RNA, 3222 nt, Artificial Sequence
  derived and/or modified CDS sequence (opt1) from SFTSV(HNXY_2)__KC292318.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggcaugucccgguggauccugggggugaucggcguccugcucgggggccuggcccuguucuucaugaucaugagccucuucaagcugggcacgaagcaggucuuccgcucccggaccaagcuggcguga

SEQ ID NO: 13223 - RNA, 3222 nt, Artificial Sequence
  derived and/or modified CDS sequence (opt1) from SFTSV(HNXY_202)__KC292325.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccuccggaucaaggugaagaagaucaaccugaagugcaagcgcuccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcugcgcguggacgacgccgucugcuacuccaagaucacgagcguggaggccguggccaacuacuccgccaucccgaccaccaucggcgggcugcgguucgagcgcagccacgacucccagggcaagaucagcggcagcccccucgacaucaccgcgauccgggggagcuucuccgucaacuaccgcggccugcgccugagccucuccgagaucacggcgaccugcaccggggaggugaccaacgugagcggcugcuacuccugcaugaccggggccaaggucagcaucaagcugcacuccagcaagaacuccacggcccacgugcggugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgcuggauccugggggugaugggcguccuccucgggggccuggcccuguucuucaugaucaugagccuguucaagcugggcacgaagcaggucuuccggucccgcaccaagcucgcguga

SEQ ID NO: 13224 - RNA, 3222 nt, Artificial Sequence
  derived and/or modified CDS sequence (opt1) from SFTSV(HNXY_206)__KC292302.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugagccagcccgagcagcgcaucgggcagugcaccggcugccaccucgagugcaucaacgggggcgugcggcugaucacccugaccagcgagcucaaguccgcgacggucugcgccagccacuucugcuccagcgccaccuccggcaagaaguccaccgagauccaguuccacuccgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccgaccaagaaguggcuguucaucaucaucgucauccugcucggcuacgccgggcugaugcugcucacgaacgugcugaaggccaucggcgugugggggagcugggucaucgcccccgugaagcugguguucgccaucaucaagaagcucaugcgggcggucuccugccugaugggcaagcugauggaccgcggccgccaggugauccacgaggagaucggggagaaccgggagggcaaccaggacgacauccggaucgagauggcccgcccccgccgggugcgccacuggauguacagccccgucauccucaccauccuggccaucgggcuggccgagggcugcgacgagauggugcacgccgacuccaagcucgugagcugccggcagggguccggcaacaugaaggagugcgucaccaccggccgcgcgcugcugccggccgugaaccccgggcaggaggccugccuccacuucacgacccccggcagccccgacuccaagugccugaagaucaaggugaagcggaucaaccugaagugcaagaaguccagcagcuacuucgucccggacgcccgcagccggugcaccuccgugcgccggugccgcugggccggggacugccagagcggcugcccgccccacuucaccuccaacagcuucuccgacgacugggcggggaagauggaccgggccggccucggcuucagcgggugcuccgacggcugcgggggcgccgccugcgggugcuucaacgcggcccccagcugcaucuucuggcgcaaguggguggagaacccccacggcaucaucuggaaggucucccccugcgccgccugggugcccagcgccgugaucgagcugacgaugccguccggcgagguccggaccuuccaccccaugagcgggauccccacccagguguucaagggcguguccgucaccuaccuggggagcgacauggagguguccggccucacggaccugugcgagaucgaggagcucaagagcaagaagcuggcgcuggcccccugcaaccaggccggcauggggguggucggcaaggugggggagauccagugcuccagcgaggagagcgcccgcaccaucaagaaggacggcugcaucuggaacgccgaccugguggggaucgagcugcgggucgacgacgcggugugcuacuccaagaucaccagcguggaggccgucgccaacuacuccgccaucccgaccacgaucggcggccuccgcuucgagcggagccacgacucccaggggaagaucagcggcagcccccuggacaucaccgccauccgcgggagcuucuccgugaacuaccggggccugcgccucagccuguccgagaucaccgcgaccugcaccggggaggugacgaacgucagcggcugcuacuccugcaugaccggcgccaaggugagcaucaagcugcacuccagcaagaacuccaccgcccacgugcgcugcaagggggacgagaccgccuucagcguccucgagggcgugcacuccuacagcgugagccuguccuucgaccacgcggucguggacgagcagugccagcugaacugcgggggccacgagagccaggugacgcuccgggggaaccugaucuuccuggacguccccaaguucguggacggcuccuacaugcagaccuaccacagcaccgugcccaccggcgccaacaucccgucccccacggacuggcucaacgcccuguucgggaacggccugagccgcuggauccucggggucaucggcgugcugcugggcgggcucgcccuguucuuccugaucaugucccucuucaagcugggcaccaagcagaucuuccggagccgcaccaagcuggccuga

SEQ ID NO: 13225 - RNA, 3222 nt, Artificial Sequence
  derived and/or modified CDS sequence (opt1) from SFTSV(HNXY_207)__KC292315.1__GP
augaugaaggugaucugguuccccagccugaucugcuucgugauccagugcuccggcgacagcgggccgaucaucugcgccggccccauccacuccaacaagagcgccgacaucccccaccuccugggguacuccgagaagaucugccagaucgaccgccugauccacgugagcuccuggcuccggaaccacagccaguuccagggcuacguggggcagcgcggcggccggucccaggucagcuacuaccccgcggagaacuccuacagccgcugguccgggcugcugagcccgugcgacgccgacuggcucggcaugcugguggugaagaaggccaagggguccgacaugaucguccccggccccagcuacaaggggaagguguucuucgagcggcccaccuucgacggcuacgugggcugggggugcggcuccggcaagagccgcaccgaguccggggagcugugcagcagcgacuccggcacgagcuccgggcuccugccgagcgaccggguccuguggaucggcgacguggccugccagcccaugacccccauccccgaggagaccuuccucgagcugaaguccuucagccaguccgaguucccggacaucugcaagaucgacgggaucguguucaaccagugcgagggcgagagccugccccagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaagaccugcaagaccuccgggagcugccggggcgacaugcaguucugcaagguggcggggugcgagcacggcgaggaggccuccgaggccaagugccgcugcagccucgugcacaagccgggggaggucgugguguccuacggcggcaugcggguccgccccaagugcuacggguucagccggaugauggccacccuggaggugaaccagcccgagcagcgcaucggccagugcacggggugccaccuggagugcaucaacggcggggugcggcucaucacccugaccagcgagcugaaguccgcgaccgucugcgccagccacuucugcuccagcgccacguccggcaagaaguccaccgagauccaguuccacagcggcagccucguggggaagaccgccauccacgucaagggcgcccugguggacgggaccgaguucacguucgagggcuccugcauguuccccgacggcugcgacgcgguggacugcaccuucugccgcgaguuccugaagaacccgcagugcuaccccgccaagaaguggcuguucaucaucaucgucauccugcugggguacgccggccucaugcugcugaccaacgugcucaaggccaucgggaucuggggcagcugggugaucgcccccgucaagcugauguucgcgaucaucaagaagcugaugcggaccguguccugccucauggggaagcugauggaccgcggccgccaggugauccacgaggagaucggcgagaaccgggaggggaaccaggacgacguccggaucgagauggcccgcccccgccgggugcgccacuggauguacagcccggugauccugacgauccucgccaucggccuggccgaguccugcgacgagaugguccacgccgacagcaagcugguguccugccggcaggggagcggcaacaugaaggagugcgugaccaccgggcgcgcgcuccugcccgccgucaaccccggccaggaggccugccugcacuucaccgcccccggcuccccggacagcaagugccucaagaucaaggugaagcggaucaaccugaagugcaagaaguccagcagcuacuucgugcccgacgcccgcucccggugcacgagcguccgccggugccgcugggcgggggacugccaguccggcugcccgccccacuucaccagcaacuccuucagcgacgacugggccgggaagauggaccgggccggccugggguucuccggcugcagcgacggcugcgggggcgccgcgugcgggugcuucaacgccgcccccuccugcaucuucuggcgcaaguggguggagaacccccacggcaucaucuggaaggugagccccugcgccgccugggucccguccgcggugaucgagcucaccaugcccagcggggaggugcggaccuuccaccccauguccggcauccccacgcaggucuucaagggcgugagcgugaccuaccugggguccgacauggaggucagcggccugaccgaccucugcgagaucgaggagcugaaguccaagaagcuggcccuggccccgugcaaccaggccgggaugggcguggugggcaaggucggggagauccagugcagcagcgaggaguccgcccgcaccaucaagaaggacggcugcaucuggaacgcggaccucguggggaucgagcugcggguggacgacgccgucugcuacagcaagaucacguccguggaggccguggccaacuacagcgccauccccaccaccaucggcgggcugcgcuucgagcggucccacgacagccagggcaagaucuccggcagcccccucgacaucaccgcgauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucuccgugcuggagggcguccacagcuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagacguaccacagcaccgugccgaccggggccaacauccccucccccaccgacuggcugaacgcccucuucggcaacggccugagccgguggauccugggggugaucggcguccuccucgggggccuggcccucuucuucaugaucaugucccuguucaagcugggcacgaagcaggucuuccgcagccggaccaagcucgcguga

SEQ ID NO: 13226 - RNA, 3222 nt, Artificial Sequence
  derived and/or modified CDS sequence (opt1) from SFTSV(HNXY_224)__KC292317.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucgucgugauccugcugggguacgccggccucaugcugcugaccaacgugcucaaggccaucgggaucuggggcuccugggucaucgcccccgugaagcugauguucgcgaucaucaagaagcugaugcggaccgugagcugccucauggggaagcugauggaccgcggccggcaggucauccacgaggagaucggcgagaaccgcgaggggaaccaggacgacgugcggaucgagauggcccgcccccgccgggugcgccacuggauguacucccccgucauccugacgauccucgccaucggccugaccgagagcugcgacgagauggugcacgccgacuccaagcuggugagcugccggcagggguccggcaacaugaaggagugcgucaccaccgggcgcgcccuccugccggcggugaaccccggccaggaggccugccugcacuucacggcccccggcagccccgacagcaagugccucaagaucaaggugaagcggaucaaccugaagugcaagaaguccagcuccuacuucgucccggacgcccgcagccggugcaccuccgugcgccggugccgcugggccggggacugcgagagcggcugcccgccccacuucaccuccaacagcuucuccgacgacugggcggggaagauggaccgggccggccugggguucagcggcugcuccgacggcugcgggggcgccgccugcgggugcuucaacgcggcccccagcugcaucuucuggcgcaaguggguggagaacccccacggcaucaucuggaaggucucccccugcgccgccugggugcccagcgccgugaucgagcucaccaugccguccggggagguccggacguuccagcccaugagcggcauccccacccagguguucaagggcguguccgucaccuaccuggggagcgacauggagguguccggccugaccgaccucugcgagaucgaggagcucaagagcaagaagcuggcgcuggcccccugcaaccaggccgggaugggcguggucggcaaggugggggagauccagugcagcuccgaggagagcgcccgcacgaucaagaaggacggcugcaucuggaacgccgaccugguggggaucgagcugcgggucgacgacgcggugugcuacuccaagaucaccagcguggaggccgucgccaacuacuccgccaucccgaccaccaucggcgggcugcgcuucgagcggagccacgacucccagggcaagaucagcggcagcccccucgacaucacggccauccgcgggagcuucuccgugaacuaccggggccugcgccugagccucuccgagaucaccgcgaccugcaccggggaggugaccaacgucagcggcugcuacuccugcaugacgggggccaaggugagcaucaagcugcacuccagcaagaacuccaccgcccacgugcgcugcaagggcgacgagaccgccuucagcguccuggagggcgugcacagcuacaccgugucccucagcuucgaccacgcggucguggacgagcagugccagcugaacugcgggggccacgagucccaggugacgcugaaggggaaccucaucuuccuggacguccccaaguucguggacggcagcuacaugcagaccuaccacuccaccgugcccaccggggccaacaucccgagccccacggacuggcugaacgcccucuucggcaacggccugucccgguggauccugggggucaucggcgugcuccucgggggccuggcccuguucuucaugaucaugagccuguucaagcugggcaccaagcaggucuuccgcucccggaccaagcucgccuga

SEQ ID NO: 13227 - RNA, 3222 nt, Artificial Sequence
  derived and/or modified CDS sequence (opt1) from SFTSV(HNXY_231)__KC292313.1__GP
augaugaaggugaucugguucagcucccugaucugcuucgugauccagugcagcggcgacuccgggcccaucaucugcgccggcccgauccacagcaacaaguccgccgggaucccccaccuccugggcuacagcgagaagaucugccagaucgaccgccugauccacguguccagcuggcuccggaaccacucccaguuccagggguacgugggccagcgcggcgggcggagccaggucuccuacuaccccgcggagaacagcuacucccgcuggagcggccugcugucccccugcgacgccgacuggcucgggaugcugguggugaagaaggccaagggcagcgacaugaucgucccggggcccuccuacaagggcaagguguucuucgagcggcccaccuucgacggcuacgugggguggggcugcgggagcggcaagucccgcaccgagagcggcgagcugugcagcuccgacagcgggacguccagcggccuccugcccuccgaccggguccuguggaucggggacguggccugccagccgaugacccccauccccgaggagaccuuccucgagcugaaguccuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagaccaagugggugcaggaguccagcuccaaggacuucgucugcuacaaggagggcacggggcccugcagcgaguccgaggagaagaccugcaagaccagcggcuccugccgcggggacaugcaguucugcaagguggcgggcugcgagcacggggaggaggccagcgaggccaagugccggugcucccucgugcacaagcccggcgaggucguggugagcuacggcgggaugcggguccgcccgaagugcuacggcuucagccggaugauggccacccuggaggugaaccagcccgagcagcgcaucgggcagugcacgggcugccaccuggagugcaucaacgggggcgugcggcucaucacccugaccuccgagcucaagagcgcgaccgucugcgccucccacuucugcagcuccgccacgagcggcaagaaguccaccgagauccaguuccacagcgggucccucgugggcaagaccgccauccacgucaagggggcccugguggacggcaccgaguucacguucgagggcagcugcauguuccccgacgggugcgacgcgguggacugcaccuucugccgcgaguuccugaagaacccccagugcuacccggccaagaaguggcuguucaucaucaucgucauccugcugggcuacgccgggcucaugcugcugaccaacgugcucaaggccaucggcaucuggggguccugggugaucgcccccgucaagcugaucuucgcgaucaucaagaagcugaugcggaccgugagcugccucaugggcaagcugauggaccgcggccgccaggugauccacgaggagaucggggagaaccgggagggcaaccaggacgacguccggaucgagauggcccgcccccgccgggugcgccacuggauguacucccccgugauccugacgauccucgccaucgggcuggccgagagcugcgacgagaugguccacgccgacuccaagcuggugagcugccggcagggcuccgggaacaugaaggagugcgugaccaccggccgcgcgcuccugccggccgucaaccccggccaggaggccugccugcacuucaccgcccccgggagccccgacagcaagugccucaagaucaaggugaagcggaucaaccugaagugcaagaaguccagcuccuacuucgugccggacgcccgcagccggugcacguccguccgccggugccgcugggcgggcgacugccagagcgggugcccgccccacuucaccuccaacagcuucuccgacgacugggccggcaagauggaccgggccgggcugggcuucagcggcugcuccgacgggugcggcggggccgcgugcggcugcuucaacgccgcccccagcugcaucuucuggcgcaaguggguggagaacccccacgggaucaucuggaaggugucccccugcgccgccuggguccccagcgcggugaucgagcucaccaugccguccggcgaggugcggaccuuccaccccaugagcggcauccccacgcaggucuucaaggggguguccgugaccuaccugggcagcgacauggaggucuccgggcugaccgaccucugcgagaucgaggagcucaagagcaagaagcuggcccuggcccccugcaaccaggccggcaugggcgugguggggaaggucggcgagauccagugcagcuccgaggagagcgcccgcaccaucaagaaggacgggugcaucuggaacgcggaccuggugggcaucgagcugcggguggacgacgccgucugcuacuccaagaucacgagcguggaggccguggccaacuacuccgccaucccgaccaccaucgggggccugcgcuucgagcggagccacgacucccagggcaagaucagcgggagcccccucgacaucaccgcgauccgcggcagcuucuccgucaacuaccgggggcugcgccugagccucuccgagaucacggcgaccugcaccggcgaggugaccaacgugagcgggugcuacuccugcaugaccggcgccaaggucagcaucaagcugcacuccagcaagaacuccacggcccacgugcgcugcaagggcgacgagaccgccuucagcgugcuggaggggguccacagcuacaccgugucccucagcuucgaccacgccguggucgacgagcagugccagcugaacugcggcgggcacgagucccaggugacccugaagggcaaccucaucuuccuggacgugcccaaguucgucgacgggagcuacaugcagacguaccacuccaccgugcccaccggcgccaacaucccgagccccaccgacuggcugaacgcccucuucggcaacgggcugucccgguggauccugggcgugaucgggguccuccugggcggccuggcccucuucuucaugaucaugagccuguucaagcuggggacgaagcaggucuuccgcucccggaccaagcucgcguga

SEQ ID NO: 13228 - RNA, 3222 nt, Artificial Sequence
  derived and/or modified CDS sequence (opt1) from SFTSV(HNXY_245)__KC292320.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccuccggaucaaggugaagcgcaucaaccugaagugcaagaaguccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcugcgcguggacgacgccgucugcuacuccaagaucacgagcguggaggccguggccaacuacuccgccaucccgaccaccaucggcgggcugcgguucgagcgcagccacgacucccagggcaagaucagcggcagcccccucgacaucaccgcgauccgggggagcuucuccgucaacuaccgcggccugcgccugagccucuccgagaucacggcgaccugcaccggggaggugaccaacgugagcggcugcuacuccugcaugaccggggccaaggucagcaucaagcugcacuccagcaagaacuccacggcccacgugcggugcaagggcgacgagaccgccuucagcgugcuggagggcguccacagcuacaccaucucccucagcuucgaccacgccgugguggacgagcagugccagcugaacugcgggggccacgagucccaggucacccugaaggggaaccucaucuuccuggacgugcccaaguucguggacggcagcuacaugcagacguaccacuccaccguccccaccggggccaacaucccgagccccaccgacuggcugaacgcccucuucggcaacggccugucccgcuggauccugggggugaugggcgugcuccucgggggccuggcccuguucuucaugaucaugagccuguucaagcugggcacgaagcaggucuuccggucccgcaccaagcucgcguga

SEQ ID NO: 13229 - RNA, 3222 nt, Artificial Sequence
  derived and/or modified CDS sequence (opt1) from SFTSV(HNXY_262)__KC292309.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccgcgucuccuacuaccccgcggagaacagcuacucccgguggagcgggcugcugucccccugcgacgccgacuggcucggcaugcugguggugaagaaggccaaggggagcgacaugaucgucccgggccccuccuacaaggggaagguguucuucgagcgccccaccuucgacggcuacgugggcugggggugcggcagcgggaagucccggaccgagagcggcgagcugugcagcuccgacagcggcacguccagcgggcuccugcccuccgaccgcguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgggagcacaagaccaagugggugcaggaguccagcuccaaggacuucgucugcuacaaggagggcacgggccccugcagcgaguccgaggagaagaccugcaagaccagcggguccugccgcggcgacaugcaguucugcaagguggcggggugcgagcacggcgaggaggccagcgaggccaagugccggugcucccucgugcacaagcccggggaggucguggugagcuacggcggcaugcgcguccggccgaagugcuacggguucagccgcaugauggccacccuggaggugaaccagcccgagcagcggaucggccagugcacggggugccaccuggagugcaucaacggcggggugcgccucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgggaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcgcaccgugagcugccucauggggaagcugauggaccggggccgccaggugauccacgaggagaucggcgagaaccgggaggggaaccaggacgacguccgcaucgagauggcccgcccccggcgcgugcggcacuggauguacucccccgugauccugacgauccucgccaucggccuggccgagagcugcgacgagaugguccacgccgacuccaagcuggugagcugccgccagggguccggcaacaugaaggagugcgugaccaccgggcgggcgcuccugccggccgucaaccccggccaggaggccugccugcacuucaccgcccccggcagccccgacagcaagugccucaagaucaaggugaagcgcaucaaccugaagugcaagaaguccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacgcaggucuucaagggcguguccgugaccuaccuggggagcgacauggaggucuccggccugaccgaccucugcgagaucgaggagcugcggagcaagaagcuggcccuggcccccugcaaccaggccgggaugggcguggugggcaaggucggggagauccagugcagcuccgaggagagcgcccgcaccaucaagaaggacggcugcaucuggaacgcggaccucguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccgcggccugcggcugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaugggcguccuccucgggggccuggcccuguucuucaugaucaugagccuguucaagcugggcacgaagcaggucuuccgcucccggaccaagcucgcguga

SEQ ID NO: 13230 - RNA, 3222 nt, Artificial Sequence
  derived and/or modified CDS sequence (opt1) from SFTSV(HNXY_278)__KC292322.1__GP
augaugaaggugaucugguucagcucccugaucugccucgucauccagugcggcggggacaccggccccaucaucugcgccgggccgacccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccacguucgacggcuacgugggguggggcugcgggagcggcaagucccgcaccgagagcggcgagcucugcuccagcgacagcgggaccuccagcggccugcugcccuccgaccggguccucuggaucggggacguggccugccagccgaugacccccauccccgaggagacguuccuggagcugaaguccuucucccagagcgaguuccccgacaucugcaagaucgacggcaucguguucaaccagugcgagggggagucccucccgcagcccuucgacgucgccuggauggacgugggccacagccacaagaucaucaugcgcgagcacaagaccaagugggugcaggaguccagcuccaaggacuucgucugcuacaaggagggcaccgggcccugcagcgaguccgaggagaagaccugcaagacgggcgggagcugccggggcgacaugcaguucugcaagguggcggggugcgagcacggcgaggaggccuccgaggccaagugccgcugcagccuggugcacaagcccggcgaggucgugguguccuacgggggcaugcggguccgcccgaagugcuacggguucagccggaugauggccacccuggaggugucccagcccgagcagcgcaucggccagugcaccgggugccaccucgagugcaucaacggcggcgugcggcugaucacccugacgagcgagcucaagagcgcgaccgucugcgccucccacuucugcagcuccgccaccagcgggaagaaguccaccgagauccaguuccacagcggcucccugguggggaagacggccauccacgucaagggcgcccugguggacggcaccgaguucaccuucgaggggagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucacgaacgugcugaaggccaucgggguguggggcuccugggucaucgcccccgugaagcugguguucgcgaucaucaagaagcucaugcgggccgucagcugccugaugggcaagcugauggaccgcgggcgccaggugauccacgaggagaucggcgagaaccgggaggggaaccaggacgacgugcggaucgagauggcccgcccccgccggguccgccacuggauguacucccccgugauccucaccauccuggccaucggccuggccgaggggugcgacgagaugauccacgcggacagcaagcucguguccugccggcagggcagcggcaacaugaaggagugcgucaccaccgggcgcgcccugcugccggccgugaaccccggccaggaggccugccuccacuucacggcccccgggucccccgacagcaagugccugaagaucaaggugaagcggaucaaccugaagugcaagaaguccagcagcuacuucgucccggacgcgcgcucccggugcaccagcgugcgccggugccgcugggccggcgacugccaguccgggugcccgccccacuucacccccaacagcuucuccgacgacugggccggcaagauggaccgggccggccucggguucagcggcugcuccgacgggugcggcggggcggccugcggcugcuucaacgccgcccccagcugcaucuucuggcgcaaguggguggagaacccccacggcaucaucuggaaggucucccccugcgccgcgugggugccgagcgccgugaucgagcugaccaugcccuccggggagguccggacguuccaccccaugagcggcauccccacccagguguucaaggggguguccgucaccuaccugggcagcgacauggagguguccggccucaccgaccugugcgagaucgaggagcucaagagcaagaagcuggcccuggccccgugcaaccaggccgggaugggcguggucgggaaggugggcgagauccagugcuccagcgaggaguccgcgcgcacgaucaagaaggacgggugcaucuggaacgccgaccuggugggcaucgagcugcgggucgacgacgccgugugcuacagcaagaucaccagcguggaggccgucgccaacuacuccgcgauccccaccaccaucggcgggcuccgcuucgagcggagccacgacucccagggcaagaucagcgggagcccccuggacaucacggccauccgcggcagcuucuccgugaacuaccgggggcugcgccucagccuguccgagaucaccgcgaccugcaccggcgaggugaccaacgucagcggcugcuacuccugcaugacgggggccaaggugagcaucaagcugcacuccagcaagaacuccaccgcccacgugcgcugcaagggcgacgagaccgccuucagcguccucgagggggugcacuccuacagcgugucccugagcuucgaccacgccgucguggacgagcagugccagcugaacugcggcgggcacgagagccaggugacccuccggggcaaccugaucuuccuggacguccccaaguucguggacggcuccuacaugcagacguaccacagcaccgugccgaccggggccaacauccccucccccaccgacuggcucaacgcccuguucggcaacgggcugagccgcuggauccucggcgucaucggcgugcugcucgggggccuggcgcuguucuuccugaucaugucccucuucaagcuggggacgaagcagaucuuccggagccgcaccaagcuggccuga

SEQ ID NO: 13231 - RNA, 3222 nt, Artificial Sequence
  derived and/or modified CDS sequence (opt1) from SFTSV(HNXY_31)__KC292310.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacuccgugagccucuccuucgaccacgccguggucgacgagcagugccagcugaacugcgggggccacgagagccaggugacccugcgggggaaccucaucuuccuggacgugcccaaguucgucgacggcuccuacaugcagaccuaccacagcacggugcccaccggggccaacaucccgucccccaccgacuggcugaacgcccucuucggcaacggccugagccgcuggauccugggggugaucggcguccuccucgggggccuggcccuguucuucaugaucaugucccuguucaagcugggcaccaagcaggucuuccggagccgcacgaagcucgcguga

SEQ ID NO: 13232 - RNA, 3222 nt, Artificial Sequence
  derived and/or modified CDS sequence (opt1) from SFTSV/FTLSV(2011YGS5)__KF711925.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccucauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcucaagagcuucucccagagcgaguuccccgacaucugcaagaucgacgggaucgucuucaaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccuggucgggaagaccgcgauccacgugaagggcgcccugguggacgggaccgaguucaccuucgagggcagcugcauguuccccgacggcugcaacgccgucgacugcacguucugccgcgaguuccugaagaacccccagugcuaccccgccaagaaguggcuguucaucaucaucgugauccugcugggguacgccggccucaugcugcugaccaacgugcucaaggcgaucggggucuggggcuccugggugaucgcccccgugaagcugauguucgccaucaugaagaagcugaugcggaccgucagcugccucguggggaagcugauggaccgcggccgccaggugauccacgaggagaucggcgagaacggggagggcaaccacgacgacguccggaucgagauggcccggccccgccgcgugcggcacuggauguacuccccggugauccugaccauccucgccaucgggcuggcggagggcugcgacgagaugguccacgccgacagcaagcugguguccugccgccaggggagcggcaacaugaaggagugcgugacgaccggccgggcccuccugcccgccgucaaccccgggcaggaggccugccugcacuucaccgcgcccggcuccccggacagcaagugccucaagaucaaggugaagcgcaucaaccugaagugcaagaaguccagcagcuacuucgugcccgacgcccggaaccgcugcaccuccguccggcgcugccggugggccggggacugccagagcggcugcccgccccacuucacguccaacagcuucuccgacgacugggccgggaagauggaccgcgcgggccugggcuucagcgggugcuccgacggcugcgggggcgccgccugcgggugcuucaacgccgcccccagcugcaucuucuggcggaaguggguggagaacucccacggcaucaucuggaaggugagccccugcgcggccuggguccccuccgccgugaucgagcucaccaugccgagcggcgaggugcgcaccuuccaccccauguccgggauccccacccaggucuucaagggcgugagcgugacguaccugggguccgacauggaggucagcggccugaccgaccucugcgagaucgaggagcugaaguccaagaagcuggcccuggcccccugcaaccaggcgggcauggggguggugggcaaggucggggagauccagugcagcagcgaggaguccgcccggaccaucaagaaggacggcugcaucuggaacgccgaccucguggggaucgagcugcgcguggacgacgccgucugcuacagcaagaucaccuccguggaggccguggcgaacuacagcgccaucccgacgaccaucggcggccugcgguucgagcgcucccacgacagccaggggaagaucuccggcagcccccucgacaucaccgccauccggggguccuucagcgucaacuaccgcggccugcggcugucccucagcgagaucaccgccacgugcaccggggaggugaccaacguguccggcugcuacagcugcaugaccggcgcgaaggucuccaucaagcugcacagcuccaagaacagcaccgcccacgugcgcugcaagggggacgagacggccuucuccgugcuggagggcguccacagcuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagaccuaccacagcacggugcccaccggcgccaacaucccgucccccaccgacuggcugaacgcgcuguucgggaacggccugagccgcuggauccugggggucaucggcgugcuccugggcgggcuggcccucuucuuccugaucauguuccuguucaagcucggcaccaagcaggucuuccggucccgcacgaagcuggccuga

SEQ ID NO: 13233 - RNA, 3222 nt, Artificial Sequence
  derived and/or modified CDS sequence (opt1) from SFTSV/FTLSV(2011YGS7)__KF711922.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccucauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcugaaguccuucucccagagcgaguuccccgacaucugcaagaucgacgggaucgucuucuaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccucgucgggaagaccgcgauccacgugaagggcgcccugguggacgggaccgaguucaccuucgagggcagcugcauguuccccgacggcugcaacgccgucgacugcacguucugccgcgaguuccugaagaacccccagugcuaccccgccaagaaguggcuguucaucaucaucgugauccugcugggguacgccggccucaugcugcugaccaacgugcucaaggcgaucggggucuggggcuccugggugaucgcccccgugaagcugauguucgccaucaugaagaagcugaugcggaccgucagcugccucguggggaagcugauggaccgcggccgccaggugauccacgaggagaucggcgagaacggggagggcaaccacgacgacguccggaucgagauggcccggccccgccgcgugcggcacuggauguacuccccggugauccugaccauccucgccaucgggcuggcggagggcugcgacgagaugguccacgccgacagcaagcugguguccugccgccaggggagcggcaacaugaaggagugcgugacgaccggccgggcccuccugcccuccgucaaccccgggcaggaggccugccugcacuucaccgcccccggcagcccggacagcaagugccucaagaucaaggugaagcgcaucaaccugaagugcaagaaguccagcuccuacuucgugcccgacgcgcggaaccgcugcaccagcguccggcgcugccggugggccggggacugccaguccggcugcccgccccacuucacgagcaacuccuucagcgacgacugggccgggaagauggaccgcgccggccugggcuucuccgggugcagcgacggcugcgggggcgcggccugcgggugcuucaacgccgcccccuccugcaucuucuggcggaaguggguggagaacagccacggcaucaucuggaaggugucccccugcgccgcguggguccccagcgccgugaucgagcucaccaugccguccggcgaggugcgcaccuuccaccccaugagcgggauccccacccaggucuucaagggcguguccgugacguaccuggggagcgacauggaggucuccggccugaccgaccucugcgagaucgaggagcucaagagcaagaagcuggcccuggcccccugcaaccaggccggcauggggguggugggcaaggucggggagauccagugcagcuccgaggagagcgcgcggaccaucaagaaggacggcugcaucuggaacgccgaccugguggggaucgagcugcgcguggacgacgccgucugcuacuccaagaucaccagcguggaggccguggccaacuacuccgcgaucccgacgaccaucggcggccugcgguucgagcgcagccacgacucccaggggaagaucagcggcagcccccucgacaucaccgccauccgggggagcuucuccgucaacuaccgcggccugcggcugagccucuccgagaucaccgccacgugcaccggggaggugaccaacgugagcggcugcuacuccugcaugaccggcgccaaggucagcaucaagcugcacuccagcaagaacuccaccgcgcacgugcgcugcaagggggacgagacggccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagaccuaccacuccacggugcccaccggcgccaacaucccgagccccaccgacuggcugaacgcccucuucgggaacggccugucccgcuggauccugggggucaucggcgugcuccugggcgggcuggcgcuguucuuccugaucauguuccuguucaagcucggcaccaagcaggucuuccggagccgcacgaagcuggccuga

SEQ ID NO: 13234 - RNA, 3222 nt, Artificial Sequence
  derived and/or modified CDS sequence (opt1) from SFTSV/FTLSV(2011YPQ11)__KF711926.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccucauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcugaaguccuucucccagagcgaguuccccgacaucugcaagaucgacgggaucgucuucaaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccuggucgggaagaccgcgauccacgugaagggcgcccugguggacgggaccgaguucaccuucgagggcagcugcauguuccccgacggcugcaacgccgucgacugcacguucugccgcgaguuccugaagaacccccagugcuaccccgccaagaaguggcuguucaucaucaucgugauccugcugggguacgccggccucaugcugcugaccaacgugcucaaggcgaucggggucuggggcuccugggugaucgcccccgugaagcugauguucgccaucaugaagaagcugaugcggaccgucagcugccucguggggaagcugauggaccgcggccgccaggugauccacgaggagaucggcgagaacggggagggcaaccacgacgacguccggaucgagauggcccggccccgccgcgugcggcacuggauguacuccccggugauccugaccauccucgccaucgggcuggcggagggcugcgacgagaugguccacgccgacagcaagcugguguccugccgccaggggagcggcaacaugaaggagugcgugacgaccggccgggcccuccugcccuccgucaaccccgggcaggaggccugccugcacuucaccgcccccggcagcccggacagcaagugccucaagaucaaggugaagcgcaucaaccugaagugcaagaaguccagcuccuacuucgugcccgacgcgcgguaccgcugcaccagcguccggcgcugccccugggccggggacugccaguccggcugcccgccccacuucacgagcaacuccuucagcgacgacugggccgggaagauggaccgggccggccugggcuucuccgggugcagcgacggcugcgggggcgcggccugcgggugcuucaacgccgcccccuccugcaucuucuggcgcaaguggguggagaacagccacggcaucaucuggaaggugucccccugcgccgcgugggucccgagcgccgugaucgagcucaccaugcccuccggcgaggugcggaccuuccaccccaugagcgggauccccacccaggucuucaagggcguguccgugacguaccuggggagcgacauggaggucuccggccugaccgaccucugcgagaucgaggagcucaagagcaagaagcuggcccuggccccgugcaaccaggccggcauggggguggugggcaaggucggggagauccagugcagcuccgaggagagcgcgcgcaccaucaagaaggacggcugcaucuggaacgccgaccugguggggaucgagcugcggguggacgacgccgucugcuacuccaagaucaccagcguggaggccguggccaacuacuccgcgauccccacgaccaucggcggccugcgcuucgagcggagccacgacucccaggggaagaucagcggcagcccccucgacaucaccgccauccgcgggagcuucuccgucaacuaccggggccugcgccugagccucuccgagaucaccgccacgugcaccggggaggugaccaacgugagcggcugcuacuccugcaugaccggcgccaaggucagcaucaagcugcacuccagcaagaacuccaccgcgcacgugcggugcaagggggacgagacggccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagaccuaccacuccacggugccgaccggcgccaacauccccagccccaccgacuggcugaacgcccucuucgggaacggcaugucccgcuggauccugggggucaucggcgugcugcucggcgggcuggcgcuguucuuccucaucauguuccuguucaagcugggcaccaagcaggucuuccgcagccggacgaagcucgccuga

SEQ ID NO: 13235 - RNA, 3222 nt, Artificial Sequence
  derived and/or modified CDS sequence (opt1) from SFTSV/FTLSV(2011YPQ12)__KF711930.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugucccagcccgagcagcgcaucggccagugcacggggugccaccuggagugcaucaacggcggggugcggcucaucacccugaccagcgagcugaaguccgcgaccgucugcgccagccacuucugcuccagcgccacguccggcaagaaguccaccgagauccaguuccacagcggcagccucguggggaagaccgccauccacgucaagggcgcccugguggacgggaccgaguucacguucgagggcuccugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggguguggggcagcugggucaucgcccccgugaagcugguguucgcgaucaucaagaagcugaugcgggccgucuccugccucauggggaagcugauggaccgcggccgccaggugauccacgaggagaucggcgagaaccgggaggggaaccaggacgacgugcggaucgagauggcccgcccccgccggguccgccacuggauguacagccccgugauccugaccauccucgccaucggccuggccgaggggugcgacgagauggugcacgcggacuccaagcuggucagcugccggcagggcuccgggaacaugaaggagugcgugacgaccggccgcgcccuccugccggccgugaaccccggccaggaggccugccugcacuucaccgcccccgggagccccgacagcaagugccucaagaucaaggucaagcggaucaaccugaagugcaagaaguccagcuccuacuucgugccgguggcgcgcuaccggugcaccagcguccgccggugccgcugggccggcgacugccaguccgggugcccgccccacuucacgagcaacuccuucagcgacgacugggccggcaagauggaccgggccgggcugggcuucuccggcugcagcgacgggugcggcggggcggccugcggcugcuucaacgccgcccccuccugcaucuucuggcgcaaguggguggagaacccccacgggaucaucuggaaggugagccccugcgccgcguggguccccuccgccgugaucgagcucaccaugccgagcggcgaggugcggaccuuccaccccauguccggcauccccacccaggucuucaagggggugagcgugacguaccugggcuccgacauggaggucagcgggcugaccgaccucugcgagaucgaggagcugaaguccaagaagcuggcccuggcccccugcaaccaggccggcaugggcgugguggggaaggucggcgagauccagugcagcagcgaggaguccgcgcgcaccaucaagaaggacgggugcaucuggaacgccgaccucgugggcaucgagcugcggguggacgacgccgucugcuacagcaagaucaccuccguggaggccguggccaacuacagcgcgaucccgacgaccaucgggggccugcgcuucgagcggucccacgacagccagggcaagaucuccgggagcccccucgacaucaccgccauccgcggcuccuucagcgucaacuaccgggggcugcgccugucccucagcgagaucaccgccacgugcaccggcgaggugaccaacguguccgggugcuacagcugcaugaccggcgccaaggucuccaucaagcugcacagcuccaagaacagcaccgcgcacgugcgcugcaagggcgacgagacggccuucuccgugcuggaggggguccacagcuacagcgugucccucagcuucgaccacgccguggucgacgagcagugccagcugaacugcggcgggcacgagucccaggugacccugcggggcaaccucaucuuccuggacgugcccaaguucgucgacgggagcuacaugcagaccuaccacuccaccgugcccacgggcgccaacaucccgagccccaccgacuggcugaacgcccucuucggcaacgggcugucccgcuggauccugggcgucaucggggugcuccugggcggccuggcccucuucuuccugaucaugagccuguucaagcucgggaccaagcagaucuuccggucccgcaccaagcuggcguga

SEQ ID NO: 13236 - RNA, 3222 nt, Artificial Sequence
  derived and/or modified CDS sequence (opt1) from SFTSV/FTLSV(2011YPQ17)__KF711923.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccugauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcugaaguccuucucccagagcgaguuccccgacaucugcaagaucgacgggaucgucuucaaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccuggucgggaagaccgcgauccacgugaagggcgcccugguggacgggaccgaguucaccuucgagggcagcugcauguuccccgacggcugcaacgcccuggacugcacguucugccgcgaguuccucaagaacccccacugcuaccccgccaagaaguggcuguucaucaucaucgucauccugcucggguacgccggccugaugcugcucaccaacgugcugaaggcgaucgggguguggggcuccugggucaucgcccccgugaagcugauguucgccaucaugaagaagcucaugcggaccgugagcugccuggucgggaagcugauggaccgcggccgccaggugauccacgaggagaucggcgagaacggggagggcaaccacgacgacgugcggaucgagauggcccggccccgccgcguccggcacuggauguacuccccggugauccucaccauccuggccaucgggcuggcggagggcugcgacgagauggugcacgccgacagcaagcucgucuccugccgccaggggagcggcaacaugaaggagugcgugacgaccggccgggcccugcugcccuccgugaaccccgggcaggaggccugccuccacuucaccgcccccggcagcccggacagcaagugccugaagaucaaggucaagcgcaucaaccugaagugcaagaaguccagcuccuacuucgugcccgacgcgcggaaccgcugcaccagcgugcggcgcugccggugggccggggacugccaguccggcugcccgccccacuucacgagcaacuccuucagcgacgacugggccgggaagauggaccgcgccggccucggcuucuccgggugcagcgacggcugcgggggcgcggccugcgggugcuucaacgccgcccccuccugcaucuucuggcggaagugggucgagaacagccacggcaucaucuggaaggugucccccugcgccgcgugggugcccagcgccgucaucgagcugaccaugccguccggcgaggugcgcaccuuccaccccaugagcgggauccccacccagguguucaagggcgucuccgugacguaccuggggagcgacauggagguguccggccucaccgaccugugcgagaucgaggagcucaagagcaagaagcuggcccuggcccccugcaaccaggccggcaugggggucgugggcaaggugggggagauccagugcagcuccgaggagagcgcgcggaccaucaagaaggacggcugcaucuggaacgccgaccuggucgggaucgagcugcgcguggacgacgccgugugcuacuccaagaucaccagcgucgaggccguggccaacuacuccgcgaucccgacgaccaucggcggccuccgguucgagcgcagccacgacucccaggggaagaucagcggcagcccccuggacaucaccgccauccgggggagcuucuccgugaacuaccgcggccugcggcucagccuguccgagaucaccgccacgugcaccggggaggucaccaacgugagcggcugcuacuccugcaugaccggcgccaaggugagcaucaagcugcacuccagcaagaacuccaccgcgcacguccgcugcaagggggacgagacggccuucagcgugcucgagggcgugcacagcuacaccgucucccugagcuucgaccacgccgugguggacgagcagugccagcugaacugcgggggccacgagucccaggucacccucaaggggaaccugaucuuccuggacgugcccaaguucguggacggcagcuacaugcagaccuaccacuccacgguccccaccggcgccaacaucccgagccccaccgacuggcucaacgcccuguucgggaacggccugucccgcuggauccucggggugaucggcguccugcugggcgggcucgcgcuguucuuccugaucauguuccucuucaagcugggcaccaagcaggucuuccggagccgcacgaagcuggccuga

SEQ ID NO: 13237 - RNA, 3222 nt, Artificial Sequence
  derived and/or modified CDS sequence (opt1) from SFTSV/FTLSV(2011YSC22)__KF711927.1__GP
augaugaaggugaucugguucagcucccuggucugccucgugauccagugcagcggcgacuccgggcccaucaucugcgccggcccgauccacagcaacaaguccgccgcgaucccccaccuccugggguacagcgagaagaucugccagaucgaccgccucauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcugaaguccuucucccagagcgaguuccccgacaucugcaagaucgacgggaucgucuucaaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccuggucgggaagaccgcgauccacgugaagggcgcccugguggacgggaccgaguucaccuucgagggcagcugcauguuccccgacggcugcaacgccgucgacugcacguucugccgcgaguuccugaagaacccccagugcuaccccgccaagaaguggcuguucaucaucaucgugauccugcugggguacgccggccucaugcugcugaccaacgugcucaaggcgaucggggucuggggcuccugggugaucgcccccgugaagcugauguucgccaucaugaagaagcugaugcggaccgucagcugccucguggggaagcugauggaccgcggccgccaggugauccacgaggagaucggcgagaacggggagggcaaccacgacgacguccggaucgagauggcccggccccgccgcgugcggcacuggauguacuccccggugauccugaccauccucgccaucgggcuggcggagggcugcgacgagaugguccacgccgacagcaagcugguguccugccgccaggggagcggcaacaugaaggagugcgugacgaccggccgggcccuccugcccuccgucaaccccgggcaggaggccugccugcacuucaccgcccccggcagcccggacagcaagugccucaagaucaaggugaagcgcaucaacgugaagugcaagaaguccagcuccuacuucguccccgacgcgcggaaccgcugcaccagcgugcggcgcugccggugggccggggacugccaguccggcugcccgccccacuucacgagcaacuccuucagcgacgacugggccgggaagauggaccgcgccggccugggcuucuccgggugcagcgacggcugcgggggcgcggccugcgggugcuucaacgccgcccccuccugcaucuucuggcggaaguggguggagaacagccacggcaucaucuggaaggucucccccugcgccgcgugggugcccagcgccgugaucgagcugaccaugccguccggcgagguccgcaccuuccaccccaugagcgggauccccacccagguguucaagggcguguccgucacguaccucgggagcgacauggagguguccggccugaccgaccugugcgagaucgaggagcucaagagcaagaagcuggcccuggcccccugcaaccaggccggcauggggguggucggcaaggugggggagauccagugcagcuccgaggagagcgcgcggaccaucaagaaggacggcugcaucuggaacgccgaccugguggggaucgagcuccgcgucgacgacgccgugugcuacuccaagaucaccagcguggaggccgucgccaacuacuccgcgaucccgacgaccaucggcggccugcgguucgagcgcagccacgacucccaggggaagaucagcggcagcccccuggacaucaccgccauccgggggagcuucuccgugaacuaccgcggccuccggcugagccuguccgagaucaccgccacgugcaccggggaggugaccaacgucagcggcugcuacuccugcaugaccggcgccaaggugagcaucaagcuccacuccagcaagaacuccaccgcgcacgugcgcugcaagggggacgagacggccuucagcguccuggagggcgugcacagcuacaccgugucccugagcuucgaccacgccgucguggacgagcagugccagcucaacugcgggggccacgagucccaggugacccugaaggggaaccugaucuuccucgacguccccaaguucguggacggcagcuacaugcagaccuaccacuccacgguccccaccggcgccaacaucccgagccccaccgacuggcugaacgcccugcucgggaacggcaugucccgcuggauccugggggugaucggcgugcugcucggcgggcuggcgcuguucuuccucaucauguuccuguucaagcugggcaccaagcaggucuuccggagccgcacgaagcucgccuga

SEQ ID NO: 13238 - RNA, 3222 nt, Artificial Sequence
  derived and/or modified CDS sequence (opt1) from SFTSV/FTLSV(2011YSC60)__KF711945.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgaguacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugaaccagcccgagcagcgcaucgggcagugcaccggcugccaccucgagugcaucaacgggggcgugcggcugaucacccugaccagcgagcucaagagcgcgacggucugcgccucccacuucugcagcuccgccaccagcggcaagaaguccaccgagauccaguuccacagcgggucccuggugggcaagaccgccauccacgucaagggggcccugguggacggcacggaguucaccuucgagggcagcugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcaucuggggguccugggugaucgcccccgucaagcugaucuucgcgaucaucaagaagcucaugcggacggugagcugccugaugggcaagcugauggaccgcggccgccaggugauccacgaggagaucggggagaaccgggagggcaaccaggacgacguccggaucgagauggcccgcccccgccgggugcgccacuggauguacucccccgugauccucaccauccuggccaucgggcuggccgagagcugcgacgagaugguccacgccgacuccaagcucgugagcugccggcagggcuccgggaacaugaaggagugcgugaccaccggccgcgcgcugcugccggccgucaaccccggccaggaggccugccuccacuucacggcccccgggagccccgacuccaagugccugcggaucaaggugaagcgcaucaaccugaagugcaagaaguccagcagcuacuucgugccggacgcccggaaccgcugcaccagcguccggcgcugccggugggcgggcgacugccaguccgggugcccgccccacuucaccagcaacuccuucagcgacgacugggccggcaagauggaccgcgccgggcucggcuucuccggcugcagcgacgggugcggcggggccgcgugcggcugcuucaacgccgcccccuccugcaucuucuggcggaaguggguggagaacccccacgggaucaucuggaaggugagccccugcgccgccuggguccccuccgcggugaucgagcugaccaugccgagcggcgaggugcgcacguuccaccccauguccggcauccccacccaggucuucaagggggugagcgugaccuaccugggcuccgacauggaggucagcgggcucaccgaccugugcgagaucgaggagcugaaguccaagaagcuggcccucgcccccugcaaccaggccggcaugggcgugguggggaaggucggcgagauccagugcagcuccgaggagagcgcccggacgaucaagaaggacgggugcaucuggaacgcggaccuggugggcaucgagcugcgcguggacgacgccgucugcuacagcaagaucaccuccguggaggccguggccaacuacagcgccaucccgaccaccaucgggggccuccgguucgagcgcucccacgacagccagggcaagaucuccgggagcccccuggacaucacggcgauccggggcuccuucagcgucaacuaccgcgggcugcgccucucccugagcgagaucaccgcgaccugcaccggcgaggugaccaacguguccgggugcuacagcugcaugacgggcgccaaggucuccaucaagcugcacagcuccaagaacagcaccgcccacgugcggugcaagggcgacgagaccgccuucuccgugcucgaggggguccacagcuacaccgugucccugagcuucgaccacgccguggucgacgagcagugccagcugaacugcggcgggcacgagagccaggugacgcucaagggcaaccugaucuuccuggacgugcccaaguucgucgacggguccuacaugcagaccuaccacagcaccgugcccaccggcgccaacaucccgucccccacggacuggcucaacgcccuguucggcaacgggcugagccgcugggugcucggcgucaugggggugcugcugggcggccucgcccuguucuucaugaucaugucccuguucaagcucgggaccaagcaggucuuccggagccgcaccaagcuggcguga

SEQ ID NO: 13239 - RNA, 3222 nt, Artificial Sequence
  derived and/or modified CDS sequence (opt1) from SFTSV/FTLSV(2011YSH45)__KF711947.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccuggagugcaagaaguccagcuccuacuucgugccggacgcccgcaaccggugcacgagcguccgccggugccgcugggcgggggacugccaguccggcugcccgccccacuucaccagcaacuccuucagcgacgacugggccgggaagauggaccgggccggccugggguucuccggcugcagcgacggcugcgggggcgccgcgugcgggugcuucaacgccgcccccuccugcaucuucuggcgcaaguggguggagaacccccacggcaucaucuggaaggugagccccugcgccgccuggguccccuccgcggugaucgagcucaccaugccgagcggggaggugcggaccuuccaccccauguccggcauccccacgcaggucuucaagggcgugagcgugaccuaccugggguccgacauggaggucagcggccugaccgaccucugcgagaucgaggagcugaaguccaagaagcuggcccuggcccccugcaaccaggccgggaugggcguggugggcaaggucggggagauccagugcagcagcgaggaguccgcccgcaccaucaagaaggacggcugcaucuggaacgcggaccucguggggaucgagcugcggguggacgacgccgucugcuacagcaagaucacguccguggaggccguggccaacuacagcgccaucccgaccaccaucggcgggcugcgcuucgagcggucccacgacagccagggcaagaucuccggcagcccccucgacaucaccgcgauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcucccgcaacagcacggcccacgugcggugcaagggcgacgagaccgccuucuccgugcuggagggcguccacagcuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagacguaccacagcaccgugcccaccggggccaacaucccgucccccaccgacuggcugaacgcccucuucggcaacggccugagccgcugggugcugggggucaugggcgugcuccucgggggccuggcccuguucuucaugaucaugucccuguucaagcugggcacgaagcaggucuuccggagccgcaccaagcucgcguga

SEQ ID NO: 13240 - RNA, 3222 nt, Artificial Sequence
  derived and/or modified CDS sequence (opt1) from SFTSV/FTLSV(2011YSH52)__KF711928.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugagccagcccgagcagcgcaucgggcagugcaccggcugccaccucgagugcaucaacgggggcgugcggcugaucacccugaccagcgagcucaaguccgcgacggucugcgccagccacuucugcuccagcgccaccuccggcaagaaguccaccgagauccaguuccacagcgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccggguucaugcugcugaccaacgugcucaaggccaucggcgugugggggagcugggucaucgcccccgugaagcugguguucgcgaucaucaagaagcugaugcgggccgucuccugccucaugggcaagcugauggaccgcggccgccaggugauccacgaggagaucggggagaaccgggagggcaaccaggacgacgugcggaucgagauggcccgcccccgccggguccgccacuggauguacagccccgugauccugacgauccucgccaucgggcuggccgagggcugcgacgagauggugcacgcggacuccaagcuggucagcugccggcagggguccggcaacaugaaggagugcgugaccaccggccgcgcccuccugccggccgugaaccccgggcaggaggccugccugcacuucaccgcccccggcagccccgacuccaagugccucaagaucaaggucaagcggaucaacaagaagugcaagaaguccagcagcuacuucgugccggacgcgcgcuaccggugcacgagcgugcgccggugccgcugggccggggacugccaguccggcugcccgccccacuucaccagcaacuccuucagcgacgacugggccgggaagauggaccgggccggccugggcuucuccgggugcagcgacggcugcgggggcgcggccugcgggugcuucaacgccgcccccuccugcaucuucuggcgcaagugggucgagaacccccacggcaucaucuggaaggugagccccugcgccgcgugggugcccuccgccgucaucgagcugaccaugccgagcggcgaggugcggaccuuccaccccauguccgggauccccacccagguguucaagggcgucagcgugacguaccucggguccgacauggaggugagcggccuguccgaccugugcgagaucgaggagcucaacagcaagaagcuggcccuggcccccugcaaccaggccggcaugggggucgugggcaaggugggggagauccagugcuccagcgaggagagcgcgcgcaccaucaagaaggacggcugcauccggaacgccgaccuggucgggaucgaggugcgcguggacgacgccgucuucuacuucaagaucaccuccguggaggccguggccaacuacagcgcgaucccgacgaccaucggcggccuccgguucgagcgcucccacgacagccaggggaagaucuccggcagcccccuggacaucaccgccauccggggguccuucagcgucaacuaccgcggccugcgccucucccugagcgagaucaccgccacgugcaccggggaggugaccaacguguccggcugcuacagcugcaugaccggcgccaaggucuccaucaagcugcacagcuccaagaacagcaccgcgcacgugcggugcaagggggacgagacggccuucuccgugcucgagggcguccacagcuacuccgugagccugagcuucgaccacgccguggucgacgagcagugccagcugaacugcgggggccacgagucccaggugacccuccgcgggaaccugaucuuccuggacgugcccaaguucgucgacggcagcuacaugcagaccuaccacuccaccgugcccacgggcgccaacaucccgagccccaccgacuggcucaacgcccuguucgggaacggccugucccgguggauccucggggucaucggcgugcugcugggcgggcucgcgcuguucuuccugauccucagccuguucaagcugggcaccaagcagaucuuccgcucccggaccaagcucgccuga

SEQ ID NO: 13241 - RNA, 3222 nt, Artificial Sequence
  derived and/or modified CDS sequence (opt1) from SFTSV/FTLSV(2011YXX9)__KF711924.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccucauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcugaaguccuucucccagagcgaguuccccgacaucugcaagaucgacgggaucgucuucaaccagugggagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccucgucgggaagaccgcgauccacgugaagggcgcccugguggacgggaccgaguucaccuucgagggcagcugcauguuccccgacggcugcaacgccgucgacugcacguucugccgcgaguuccugaagaacccccagugcuaccccgccaagaaguggcuguucaucaucaucgugauccugcugggguacgccggccucaugcugcugaccaacgugcucaaggcgaucggggucuggggcuccugggugaucgcccccgugaagcugauguucgccaucaugaagaagcugaugcggaccgucagcugccucguggggaagcugauggaccgcggccgccaggugauccacgaggagaucggcgagaacggggagggcaaccacgacgacguccggaucgagauggcccggccccgccgcgugcggcacuggauguacuccccggugauccugaccauccucgccaucgggcuggcggagggcugcgacgagaugguccacgccgacagcaagcugguguccugccgccaggggagcggcaacaugaaggagugcgugacgaccggccgggcccuccugcccuccgucaaccccgggcaggaggccugccugcacuucaccgcccccggcagcccggacagcaagugccucaagaucaaggugaagcgcaucaaccugaagugcaagaaguccagcuccuacuucgugcccgacgcgcggaaccgcugcaccagcguccggcgcugccggugggccggggacugccaguccggcugcccgccccacuucacgagcaacuccuucagcgacgacugggccgggaagauggaccgcgccggccugggcuucuccgggugcagcgacggcugcgggggcgcggccugcgggugcuucaacgccgcccccuccugcaucuucuggcggaaguggguggagaacagccacggcaucaucuggaaggugucccccugcgccgcguggguccccagcgccgugaucgagcucaccaugccguccggcgaggugcgcaccuuccaccccaugagcgggauccccacccaggucuucaagggcguguccgugacguaccuggggagcgacauggaggucuccggccugaccgaccucugcgagaucgaggagcucaagagcaagaagcuggcccuggcccccugcaaccaggccggcauggggguggugggcaaggucggggagauccagugcagcuccgaggagagcgcgcggaccaucaagaaggacggcugcaucuggaacgccgaccugguggggaucgagcugcgcguggacgacgccgucugcuacuccaagaucaccagcguggaggccguggccaacuacuccgcgaucccgacgaccaucggcggccugcgguucgagcgcagccacgacucccaggggaagaucagcggcagcccccucgacaucaccgccauccgggggagcuucuccgucaacuaccgcggccugcggcugagccucuccgagaucaccgccacgugcaccggggaggugaccaacgugagcggcugcuacuccugcaugaccggcgccaaggucagcaucaagcugcacuccagcaagaacuccaccgcgcacgugcgcugcaagggggacgagacggccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagaccuaccacuccacggugcccaccggcgccaacaucccgagccccaccgacuggcugaacgcccucuucgggaacggccugucccgcuggauccugggggucaucggcgugcuccugggcgggcuggcgcuguucuuccugaucauguuccuguucaagcucggcaccaagcaggucuuccggagccgcacgaagcuggccuga

SEQ ID NO: 13242 - RNA, 3222 nt, Artificial Sequence
  derived and/or modified CDS sequence (opt1) from SFTSV/FTLSV(2012YGS10)__KF711937.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgguccucgccaucggccuggccgagagcugcgacgagauggugcacgccgacuccaagcuggugagcugccggcagggguccggcaacaugaaggagugcgucaccaccgggcgcgcgcuccugccggccgugaaccccggccaggaggccugccugcacuucaccgcccccggcagccccgacagcaagugccucaagaucaaggugaagcggaucaaccugaagugcaagaaguccagcuccuacuucgucccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggucucccccugcgccgccugggugcccagcgcggugaucgagcucaccaugccguccggggagguccggaccuuccaccccaugagcggcauccccacccagguguucaagggcguguccgucaccuaccuggggagcgacauggagguguccggccugaccgaccucugcgagaucgaggagcucaagagcaagaagcuggcccuggcccccugcaaccaggccgggaugggcguggucggcaaggugggggagauccagugcagcuccgaggagagcgcccgcaccaucaagaaggacggcugcaucuggaacgcggaccugguggggaucgagcugcgggucgacgacgccgugugcuacuccaagaucacgagcguggaggccgucgccaacuacuccgccaucccgaccaccaucggcgggcugcgcuucgagcggagccacgacucccagggcaagaucagcggcagcccccucgacaucaccgcgauccgcgggagcuucuccgugaacuaccggggccugcgccugagccucuccgagaucacggccacgugcaccggggaggugaccaacgucagcggcugcuacuccugcaugaccggggccaaggugagcaucaagcugcacuccagcaagaacuccacggcccacgugcgcugcaagggcgacgagaccgcguucagcguccuggagggcgugcacagcuacaccgugucccucagcuucgaccacgccgucguggacgagcagugccagcugaacugcgggggccacgagucccaggugacccugaaggggaaccucaucuuccuggacguccccaaguucguggacggcagcuacaugcagacguaccacuccaccgugcccaccggggccaacaucccgagccccaccgacuggcugaacgcccucuucggcaacggccugucccgguggauccugggggucaucggcgugcuccucgggggccuggcccuguucuucaugaucaugagccuguucaagcugggcacgaagcaggucuuccgcucccggaccaagcucgcguga

SEQ ID NO: 13243 - RNA, 3222 nt, Artificial Sequence
  derived and/or modified CDS sequence (opt1) from SFTSV/FTLSV(2012YGS4)__KF711933.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcaucccccucgacaucaccgcgauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucuccgugcuggagggcguccacagcuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagacguaccacagcaccgugcccaccggggccaacaucccgucccccaccgacuggcugaacgcccucuucggcaacggccugagccgguggauccugggggugaucggcguccuccucgggggccuggcccuguucuucaugaucaugucccuguucaagcugggcacgaagcaggucuuccgcagccggaccaagcucgcguga

SEQ ID NO: 13244 - RNA, 3222 nt, Artificial Sequence
  derived and/or modified CDS sequence (opt1) from SFTSV/FTLSV(2012YSC6)__KF711931.1__GP
augaugaaggugaucugguucagcucccugaucugcuucgugauccagugcagcggcggguccggccccaucaucugcgccgggccgauccacagcaacaaguccgccgacaucccccaccuccugggcuacagcgagaagaucugccagaucgaccgccugauccacguguccagcuggcuccggaaccacucccaguuccagggguacgugggccagcgcggcgggcggagccaggucuccuacuaccccgcggagaacagcuacucccgcuggagcggccugcugucccccugcgacgccgacuggcucgggaugcugguggugaagaaggccaagggcagcgacaugaucgucccggggcccuccuacaagggcaagguguucuucgagcggcccaccuucgacggcuacgugggguggggcugcgggagcggcaagucccgcaccgagagcggcgagcugugcagcuccgacagcgggacguccagcggccuccugcccuccgaccggguccuguggaucggggacguggccugccagccgaugacccccauccccgaggagaccuuccucgagcugaaguccuucucccagagcgaguuccccgacaucugcaagaucgacggcaucguguucaaccagugcgagggggagucccugccgcagcccaucgacgucgccuggauggacgugggccacagccacaagaucaucaugcgcgagcacaagaccaagugggugcaggaguccagcuccaaggacuucgucugcuacaaggagggcacggggcccugcagcgaguccgaggagaagaccugcaagaccagcggcuccugccgcggggacaugcaguucugcaagguggcgggcugcgagcacggggaggaggccagcgaggccaagugccggugcucccucgugcacaagcccggcgaggucguggugagcuacggcgggaugcggguccgcccgaagugcuacggcuucagccggaugauggccacccuggaggugaaccagcccgagcagcgcaucgggcagugcacgggcugccaccuggagugcaucaacgggggcgugcggcucaucacccugaccuccgagcucaagagcgcgaccgucugcgccucccacuucugcagcuccgccacgagcggcaagaaguccaccgagauccaguuccacagcgggucccucgugggcaagaccgccauccacgucaagggggcccugguggacggcaccgaguucacguucgagggcagcugcauguuccccgacgggugcgacgcgguggacugcaccuucugccgcgaguuccugaagaacccccagugcuacccggccaagaaguggcuguucaucaucaucgucauccugcugggcuacgccgggcucaugcugcugaccaacgugcucaaggccaucggcaucuggggguccugggugaucgcccccgucaagcugaucuucgcgaucaucaagaagcugaugcggaccgugagcugccucaugggcaagcugauggaccgcggccgccaggugauccacgaggagaucggggagaaccgggagggcaaccaggacgacguccggaucgagauggcccgcccccgccgggugcgccacuggauguacucccccgugauccugacgauccucgccaucgggcuggccgagagcugcgacgagaugguccacgccgacuccaagcuggugagcugccggcagggcuccgggaacaugaaggagugcgugaccaccggccgcgcgcuccugccggccgucaaccccggccaggaggccugccugcacuucaccgcccccgggagccccgacagcaagugccucaagaucaaggugaagcggaucaaccugaagugcaagaaguccagcuccuacuucgugccggacgcccgcagccggugcacguccguccgccggugccgcugggcgggcgacugccagagcgggugcccgccccacuucaccuccaacagcuucuccgacgacugggccggcaagauggaccgggccgggcugggcuucagcggcugcuccgacgggugcggcggggccgcgugcggcugcuucaacgccgcccccagcugcaucuucuggcgcaaguggguggagaacccccacgggaucaucuggaaggugucccccugcgccgccuggguccccagcgcggugaucgagcucaccaugccguccggcgaggugcggaccuuccaccccaugagcggcauccccacgcaggucuucaaggggguguccgugaccuaccugggcagcgacauggaggucuccgggcugaccgaccucugcgagaucgaggagcucaagagcaagaagcuggcccuggcccccugcaaccaggccggcaugggcgugguggggaaggucggcgagauccagugcagcuccgaggagagcgcccgcaccaucaagaaggacgggugcaucuggaacgcggaccuggugggcaucgagcugcggguggacgacgccgucugcuacuccaagaucacgagcguggaggccguggccaacuacuccgccaucccgaccaccaucgggggccugcgcuucgagcggagccacgacucccagggcaagaucagcgggagcccccucgacaucaccgcgauccgcggcagcuucuccgucaacuaccgggggcugcgccugagccucuccgagaucacggcgaccugcaccggcgaggugaccaacgugagcgggugcuacuccugcaugaccggcgccaaggucagcaucaagcugcacuccagcaagaacuccacggcccacgugcgcugcaagggcgacgagaccgccuucagcgugcuggaggggguccacagcuacaccgugucccucagcuucgaccacgccguggucgacgagcagugccagcugaacugcggcgggcacgagucccaggugacccugaagggcaaccucaucuuccuggacgugcccaaguucgucgacgggagcuacaugcagacguaccacuccaccgugcccaccggcgccaacaucccgagccccaccgacuggcugaacgcccucuucggcaacgggcugucccgguggauccugggcgugaucgggguccuccugggcggccuggcccucuucuucaugaucaugagccuguucaagcuggggacgaagcaggucuuccgcucccggaccaagcucgcguga

SEQ ID NO: 13245 - RNA, 3222 nt, Artificial Sequence
  derived and/or modified CDS sequence (opt1) from SFTSV/FTLSV(2012YSH10)__KF711940.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccaugagcggcaagaaguccacggagauccaguuccacagcggcucccucguggggaagaccgccauccacgucaagggcgcccugguggacgggaccgaguucaccuucgagggcagcugcauguuccccgacggcugcgacgcgguggacugcacguucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugaccauccucgccaucggccuggccgagagcugcgacgagaugguccacgccgacuccaagcuggugagcugccggcagggguccggcaacaugaaggagugcgugacgaccgggcgcgcgcuccugccggccgucaaccccggccaggaggccugccugcacuucaccgcccccggcagccccgacagcaagugccuccggaucaaggugaagcgcaucaaccugaagugcaagaaguccagcuccuacuucgugccggacgcccggagccgcugcaccuccguccggcgcugccggugggcgggggacugccagagcggcugcccgccccacuucacguccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacccaggucuucaagggcguguccgugacguaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcugcgcguggacgacgccgucugcuacuccaagaucaccagcguggaggccguggccaacuacuccgccaucccgacgaccaucggcgggcugcgguucgagcgcagccacgacucccagggcaagaucagcggcagcccccucgacaucaccgcgauccgggggagcuucuccgucaacuaccgcggccugcgccugagccucuccgagaucaccgccacgugcaccggggaggugaccaacgugagcggcugcuacuccugcaugaccggggccaaggucagcaucaagcugcacuccagcaagaacuccaccgcccacgugcggugcaagggcgacgagacggcguucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagaccuaccacuccacggugcccaccggggccaacaucccgagccccaccgacuggcugaacgcccucuucggcaacggccugucccgcugggugcugggggucaugggcgugcuccucgggggccuggcccuguucuucaugaucaugagccuguucaagcugggcaccaagcaggucuuccggucccgcacgaagcucgcguga

SEQ ID NO: 13246 - RNA, 3222 nt, Artificial Sequence
  derived and/or modified CDS sequence (opt1) from SFTSV/FTLSV(2012YSH104)__KF711943.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcaaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugacccggacggugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugaccauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucacggcccccggcagccccgacagcaagugccuccggaucaaggugaagcgcaucaaccugaagugcaagaaguccagcuccuacuucgugccggacgcccgguaccgcugcaccagcguccggcgcugccggugggcgggggacugccaguccggcugcccgccccacuucaccagcaacuccuucagcgacgacugggccgggaagauggaccgcgccggccugggguucuccggcugcagcgacggcugcgggggcgccgcgugcgggugcuucaacgccgcccccuccugcaucuucuggcggaaguggguggagaacccccacggcaucaucuggaaggugagccccugcgccgccuggguccccuccgcggugaucgagcucaccaugccgagcggggaggugcgcacguuccaccccauguccggcauccccacccaggucuucaagggcgugagcgugaccuaccugggguccgacauggaggucagcggccugaccgaccucugcgagaucgaggagcugaaguccaagaagcuggcccuggcccccugcaaccaggccgggaugggcguggugggcaaggucggggagauccagugcagcagcgaggaguccgcccggacgaucaagaaggacggcugcaucuggaacgcggaccucguggggaucgagcugcgcguggacgacgccgucugcuacagcaagaucaccuccguggaggccguggccaacuacagcgccaucccgaccaccaucggcgggcugcgguucgagcgcucccacgacagccagggcaagaucuccggcagcccccucgacaucacggcgauccggggguccuucagcgucaacuaccgcggccugcgccugucccucagcgagaucaccgcgaccugcaccggggaggugaccaacguguccggcugcuacagcugcaugacgggggccaaggucuccaucaagcugcacagcuccaagaacagcaccgcccacgugcggugcaagggcgacgagaccgccuucuccgugcuggagggcguccacagcuacaccgugagccucuccuucgaccacgccguggucgacgagcagugccagcugaacugcgggggccacgagagccaggugacgcugaaggggaaccucaucuuccuggacgugcccaaguucgucgacggcuccuacaugcagaccuaccacagcaccgugcccaccggggccaacaucccgucccccacggacuggcugaacgcccucuucggcaacggccugagccgcugggugcugggggucaugggcgugcuccucgggggccuggcccuguucuucaugaucaugucccuguucaagcugggcaccaagcaggucuuccggagccgcaccaagcucgcguga

SEQ ID NO: 13247 - RNA, 3222 nt, Artificial Sequence
  derived and/or modified CDS sequence (opt1) from SFTSV/FTLSV(2012YSH105)__KF711944.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccuccggaucaaggugaagcgcaucaaccugaagugcaagaaguccagcuccuacuucgugccggacgcccggagccgcugcacguccguccggcgcugccggugggcgggggacugccagagcggcugcccgccccacuucaccuccaacagcuucuccggggacugggccggcaagauggaccgcgccgggcugggcuucagcggcugcuccgacgggugcggcggggccgcgugcggcugcuucaacgccgcccccagcugcaucuucuggcggaaguggguggagaacccccacgggaucaucuggaaggugucccccugcgccgccuggguccccagcgcggugaucgagcucaccaugccguccggcgaggugcgcaccuuccaccccaugagcggcauccccacgcaggucuucaaggggguguccgugaccuaccugggcagcgacauggaggucuccgggcugaccgaccucugcgagaucgaggagcucaagagcaagaagcuggcccuggcccccugcaaccaggccggcaugggcgugguggggaaggucggcgagauccagugcagcuccgaggagagcgcccggaccaucaagaaggacgggugcaucuggaacgcggaccuggugggcaucgagcugcgcguggacgacgccgucugcuacuccaagaucacgagcguggaggccguggccaacuacuccgccaucccgaccaccaucgggggccugcgguucgagcgcagccacgacucccagggcaagaucagcgggagcccccucgacaucaccgcgauccggggcagcuucuccgucaacuaccgcgggcugcgccugagccucuccgagaucacggcgaccugcaccggcgaggugaccaacgugagcgggugcuacuccugcaugaccggcgccaaggucagcaucaagcugcacuccagcaagaacuccacggcccacgugcggugcaagggcgacgagaccgccuucagcgugcuggaggggguccacagcuacaccgugucccucagcuucgaccacgccguggucgacgagcagugccagcugaacugcggcgggcacgagucccaggugacccugaagggcaaccucaucuuccuggacgugcccaaguucgucgacgggagcuacaugcagacguaccacuccaccgugcccaccggcgccaacaucccgagccccaccgacuggcugaacgcccucuucggcaacgggcugucccgcuggauccugggcgugauggggguccuccugggcggccuggcccucuucuucaugaucaugagccuguucaagcuggggacgaagcaggucuuccggucccgcaccaagcucgcguga

SEQ ID NO: 13248 - RNA, 3222 nt, Artificial Sequence
  derived and/or modified CDS sequence (opt1) from SFTSV/FTLSV(2012YSH107)__KF711942.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccgggaagaccagcggcuccugccgcggggacaugcaguucugcaagguggcgggcugcgagcacggggaggaggccagcgaggccaagugccggugcucccucgugcacaagcccggcgaggucguggugagcuacggcgggaugcggguccgcccgaagugcuacggcuucagccggaugauggccacccuggaggugaaccagcccgagcagcgcaucgggcagugcacgggcugccaccuggagugcaucaacgggggcgugcggcucaucacccugaccuccgagcucaagagcgcgaccgucugcgccucccacuucugcagcuccgccacgagcggcaagaaguccaccgagauccaguuccacagcgggucccuggugggcaagaccgccauccacgucaagggggcccugguggacggcaccgaguucacguucgagggcagcugcauguuccccgacgggugcgacgcgguggacugcaccuucugccgcgaguuccugaagaacccccagugcuacccggccaagaaguggcuguucaucaucaucgucauccugcugggcuacgccgggcucaugcugcugaccaacgugcucaaggccaucggcaucuggggguccugggugaucgcccccgucaagcugaucuucgcgaucaucaagaagcugaugcggaccgugagcugccucaugggcaagcugauggaccgcggccgccaggugauccacgaggagaucggggagaaccgggagggcaaccaggacgacguccggaucgagauggcccgcccccgccgggugcgccacuggauguacucccccgugauccugacgauccucgccaucgggcuggccgagagcugcgacgagaugguccacgccgacuccaagcuggugagcugccggcagggcuccgggaacaugaaggagugcgugaccaccggccgcgcgcuccugccggccgucaaccccggccaggaggccugccugcacuucaccgcccccgggagccccgacagcaagugccuccggaucaaggugaagcgcaucaaccugaagugcaagaaguccagcuccuacuucgugccggacgcccgguaccgcugcacgagcguccggcgcugccggugggcgggcgacugccaguccgggugcccgccccacuucaccagcaacuccuucagcgacgacugggccggcaagauggaccgcgccgggcugggcuucuccggcugcagcgacgggugcggcggggccgcgugcggcugcuucaacgccgcccccuccugcaucuucuggcggaaguggguggagaacccccacgggaucaucuggaaggugagccccugcgccgccuggguccccuccgcggugaucgagcucaccaugccgagcggcgaggugcgcaccuuccaccccauguccggcauccccacgcaggucuucaagggggugagcgugaccuaccugggcuccgacauggaggucagcgggcugaccgaccucugcgagaucgaggagcugaaguccaagaagcuggcccuggcccccugcaaccaggccggcaugggcgugguggggaaggucggcgagauccagugcagcagcgaggaguccgcccggaccaucaagaaggacgggugcaucuggaacgcggaccucgugggcaucgagcugcgcguggacgacgccgucugcuacagcaagaucacguccguggaggccguggccaacuacagcgccaucccgaccaccaucgggggccugcgguucgagcgcucccacgacagccagggcaagaucuccgggagcccccucgacaucaccgcgauccggggcuccuucagcgucaacuaccgcgggcugcgccugucccucagcgagaucacggcgaccugcaccggcgaggugaccaacguguccgggugcuacagcugcaugaccggcgccaaggucuccaucaagcugcacagcuccaagaacagcacggcccacgugcggugcaagggcgacgagaccgccuucuccgugcuggaggggguccacagcuacaccgugagccucuccuucgaccacgccguggucgacgagcagugccagcugaacugcggcgggcacgagagccaggugacccugaagggcaaccucaucuuccuggacgugcccaaguucgucgacggguccuacaugcagacguaccacagcaccgugcccaccggcgccaacaucccgucccccaccgacuggcugaacgcccucuucggcaacgggcugagccgcugggugcugggcgucaugggggugcuccugggcggccuggcccucuucuucaugaucaugucccuguucaagcuggggacgaagcaggucuuccggagccgcaccaagcucgcguga

SEQ ID NO: 13249 - RNA, 3222 nt, Artificial Sequence
  derived and/or modified CDS sequence (opt1) from SFTSV/FTLSV(2012YSH14)__KF711938.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaucggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaucggcguccuccucgggggccuggcccuguucuucaugaucaugagccuguucaagcugggcacgaagcaggucuuccgcucccggaccaagcucgcguga

SEQ ID NO: 13250 - RNA, 3222 nt, Artificial Sequence
  derived and/or modified CDS sequence (opt1) from SFTSV/FTLSV(2012YSH16)__KF711934.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcuaccggugcacgagcguccgccggugccgcugggcgggggacugccaguccggcugcccgccccacuucaccagcaacuccuucagcgacgacugggccgggaagauggaccgggccggccugggguucuccggcugcagcgacggcugcgggggcgccgcgugcgggugcuucaacgccgcccccuccugcaucuucuggcgcaaguggguggagaacccccacggcaucaucuggaaggugagccccugcgccgccuggguccccuccgcggugaucgagcucaccaugccgagcggggaggugcggaccuuccaccccauguccggcauccccacgcaggucuucaagggcgugagcgugaccuaccugggguccgacauggaggucagcggccugaccgaccucugcgagaucgaggagcugaaguccaagaagcuggcccuggcccccugcaaccaggccgggaugggcguggugggcaaggucggggagauccagugcagcagcgaggaguccgcccgcaccaucaagaaggacggcugcaucuggaacgcggaccucguggggaucgagcugcggguggacgacgccgucugcuacagcaagaucacguccguggaggccguggccaacuacagcgccaucccgaccaccaucggcgggcugcgcuucgagcggucccacgacagccagggcaagaucuccggcagcccccucgacaucaccgcgauccgcggguccuucagcgucaacuaccggggccugcgccugucccucagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucuccgugcuggagggcguccacagcuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagacguaccacagcaccgugcccaccggggccaacaucccgucccccaccgacuggcugaacgcccucuucggcaacggccugagccgguggauccugggggugaucggcguccuccucgggggccuggcccuguucuucaugaucaugucccuguucaagcugggcacgaagcaggucuuccgcagccggaccaagcucgcguga

SEQ ID NO: 13251 - RNA, 3222 nt, Artificial Sequence
  derived and/or modified CDS sequence (opt1) from SFTSV/FTLSV(2012YSH6)__KF711921.1__GP
augaugaaggugaucugguucagcucccugaucugccucgugauccagugcagcggcgacuccgggcccaucaucugcgccggcccgauccacagcaacaaguccgccgggaucccccaccuccugggcuacagcgagaagaucugccagaucgaccgccucauccacguguccagcuggcugcggaaccacucccaguuccagggguacgugggccagcgcggcgggcggagccaggucuccuacuaccccgcggagaacagcuacucccgcuggaacggccugcucagccccugcgacgccgacuggcuggggaugcugguggugaagaaggccaaggaguccgacaugaucgucccgggccccagcuacaaggggaagguguucuucgagcggcccaccuucgacggcuacgugggcugggggugcggcuccggcaagagccgcaccgaguccggggagcucugcagcagcgacuccggcacgagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagggcgagagccucccgcagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaaggcgugcaagaccuccgggagcugccggggcgacaugcaguucugcaagguggccgggugcgagcacggcgaggaggccuccgaggccaagugccgcugcagccuggugcacaagcccggggaggucgugguguccuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccagcgagcuccgcuccgccaccgucugcgccagccacuucugcuccagcgccaccuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcuggugaccaacgugcucaaggccaucggggucuggggcagcugggugaucgcgcccgugaagcugauguucgccaucaucaagaagcugaugcgcaccgucuccugccucguggggaagcugauggaccggggccgccaggugauccacgaggagaucggcgagaacggggagggcaaccaggacgacguccggaucgagauggcccgcccccgccgggugcgccacuggauguacagcccggugauccugaccauccucgccaucgggcuggccgagggcugcgacgagaugguccacgcggacuccaagcuggugagcugccggcagggguccggcaacaugaaggagugcaucacgaccggccgcgcccuccugcccgccgugaaccccgggcaggaggccugccugcacuucaccgcccccggcagcccggacuccaagugccucaagaucaaggucaagcggaucaaccugaagugcaagaaguccagcagcuacuucgugcccgacgcgcgcagccggugcaccuccgugcgccggugccgcugggccggggacugccagagcggcugcccgccccacuucacguccaacagcuucuccgacgacugggccgggaagauggaccgggccggccugggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugccgagcgccgucaucgagcucaccaugcccuccggcgaggugcggaccuuccaccccaugagcgggauccccacccagguguucaagggcgucuccgugacguaccuggggagcgacauggagguguccggccugaccgaccucugcgagaucgaggagcucaagagcaagaagcuggcccuggccccgugcaaccaggccggcaugggggucgugggcaaggugggggagauccagugcuccagcgaggagagcgcgcgcaccaucaagaaggacggcugcaucuggaacgccgaccuggucgggaucgagcugcggguggacgacgccgugugcuacuccaagaucaccagcgucgaggccguggccaacuacuccgcgauccccacgaccaucggcggccugcgcuucgagcggagccacgacucccaggggaagaucagcggcagcccccucgacaucaccgccauccgcgggagcuucuccgugaacuaccggggccugcgccugagccucuccgagaucaccgccacgugcaccggggaggucaccaacgugagcggcugcuacuccugcaugaccggcgccaaggugagcaucaagcugcacuccagcaagaacuccaccgcgcacguccgcugcaagggggacgagacggccuucagcgugcuggagggcgugcacuccuacaucgucagccucagcuucgaccacgccgugguggacgagcagugccagcugaacugcgggggccacgagucccaggucacccugaaggggaaccucaucuuccuggacgugcccaaguucguggacggcagcuacaugcagaccuaccacuccaccgucccgacgggcgccaacauccccagccccaccgacuggcugaacgcccucuucgggaacggccugucccgguggauccugggggugaucggcguccuccugggcgggcuggcgcuguucuuccugaucauguuccugcucaagcugggcaccaagcaggucuuccgcagccggaccaagcuggccuga

SEQ ID NO: 13252 - RNA, 3222 nt, Artificial Sequence
  derived and/or modified CDS sequence (opt1) from SFTSV/FTLSV(2012YSH86)__KF711939.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugccacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugauguucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaucggcguccuccucgggggccuggcccuguucuucaugaucaugagccuguucaagcugggcacgaagcagguccuccgcucccggaccaagcuggcguga

SEQ ID NO: 13253 - RNA, 3222 nt, Artificial Sequence
  derived and/or modified CDS sequence (opt1) from SFTSV/FTLSV(2012YSH89)__KF711935.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgaggcggccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagaccuaccacuccacggugcccaccggggccaacaucccgagccccaccgacuggcugaacgcccucuucggcaacggccugucccgguggauccugggggugaucggcguccuccucgggggccuggcccuguucuucaugaucaugagccuguucaagcugggcaccaagcaggucuuccgcucccggacgaagcucgccuga

SEQ ID NO: 13254 - RNA, 3222 nt, Artificial Sequence
  derived and/or modified CDS sequence (opt1) from SFTSV/FTLSV(2012YSH9)__KF711919.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccgcgucuccuacuaccccgcggagaacagcuacucccgguggagcggccugcucucccccugcgacgccgacuggcuggggaugcugguggugaagaaggccaaggagagcgacaugaucgucccgggccccuccuacaaggggaagguguucuucgagcgccccaccuucgacggcuacgugggcugggggugcggcagcgggaagucccggaccgagagcggcgagcucugcagcuccgacagcggcacguccagcgggcugcugcccuccgaccgcguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgggagcacaagaccaagugggugcaggaguccagcuccaaggacuucgucugcuacaaggagggcacgggccccugcagcgaguccgaggagaaggcgugcaagaccagcggguccugccgcggcgacaugcaguucugcaagguggccgggugcgagcacggcgaggaggccagcgaggccaagugccggugcucccuggugcacaagcccggggaggucguggugagcuacggcggcaugcgcguccggccgaagugcuacggguucagccgcaugauggcgacccuggaggugaaccggcccgagcagcgcaucggccagugcaccgggugccaccucgagugcaucaacggcggggugcggcugaucacgcugaccuccgagcuccgcagcgccaccgucugcgccucccacuucugcagcuccgccaccagcggcaagaagaacacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuacccggccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcgcaucgagauggcccggccccgccggguccgccacuggauguacagccccgugauccucaccauccuggccaucgggcuggccgagggcugcgacgagauggugcacgcggacuccaagcucgucagcugccggcagggguccggcaacaugaaggagugcaucacgaccggccgcgcccugcugccggccgugaaccccgggcaggaggccugccuccacuucaccgcccccggcagccccgacuccaagugccugaagaucaaggugaagcggaucaaccugaagugcaagaaguccagcuccuacuucgucccggacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugcccagcgccgugaucgagcugaccaugccguccggcgagguccggaccuuccaccccaugagcgggauccccacccagguguucaagggcguguccgucacguaccuggggagcgacauggagguguccggccucaccgaccugugcgagaucgaggagcucaagagcaagaagcuggcccuggcccccugcaaccaggccggcauggggguggucggcaaggugggggagauccagugcuccagcgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgaucccgacgaccaucggcggccuccgcuucgagcggagccacgacucccaggggaagaucagcggcagcccccuggacaucaccgccauccgcgggagcuucuccgugaacuaccgcggccugcggcucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacuccuacaucgugagccugagcuucgaccacgccgucguggacgagcagugccagcugaacugcgggggccacgagucccaggugacccucaaggggaaccugaucuuccuggacguccccaaguucguggacggcagcuacaugcagaccuaccacuccaccgugcccacgggcgccaacaucccgagccccaccgacuggcucaacgcccuguucgggaacggccugucccgguggauccucggggucaucggcgugcugcugggcgggcucgcgcuguucuuccugaucauguuccuccugaagcugggcaccaagcaggucuuccgcagccggaccaagcucgccuga

SEQ ID NO: 13255 - RNA, 3222 nt, Artificial Sequence
  derived and/or modified CDS sequence (opt1) from SFTSV/FTLSV(2012YSH91)__KF711920.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccacgaggagaccuuccuggagcucaagagcuucucccagagcgaguuccccgacaucugcaagaucgacgggaucguguucaaccagugcgagggcgagucccugccccagccguucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgagaaggccagcgagaccaagugccgcugcucccuggugcacaagcccggggaggucguggugagcuacggcggcaugcggguccgccccaagugcuacgggaucagccggaugauggccacccuggaggugaacccgcccgagcagcgcaucggccagugcacggggugccaccucgagugcaucaacggcggggugcggcugaucacccugaccuccgagcuccgcagcgcgaccgucugcgccucccacuucugcagcuccgccagcuccggcaagaaguccacggagauccacuuccacagcggcagccugguggggaagaccgccauccacgucaagggcgcccugguggacgggaccgaguucaccuucgagggcuccugcauguuccccgacggcugcgacgcgguggacugcacguucugccgggaguuccucaagaacccccagugcuacccggccaagaaguggcuguucaucaucaucgucauccugcucggguacgccggccugaugcugcucaccaacgugcugaaggccaucgggguguggggcagcugggucaucgcccccgugaagcugauguucgcgaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagccccgugauccucaccauccuggccaucgggcuggccgagggcugcgacgagauggugcacgccgacuccaagcucgucagcugccggcagggguccggcaacaugaaggagugcaucacgaccggccgcgcgcugcugccggccgugaaccccgggcaggaggccugccuccacuucaccgcccccggcagccccgacagcaagugccugaagaucaaggugaagcggaucaacaucaagugcaagaaguccagcuccuacuucguccgcgacgcccggagccgcugcaccuccgugcggcgcugccggugggcgggggacugccagagcggcugcccgccccacuucacguccaacagcuucuccgacgacugggccgggaagauggaccgcgccggccugggcuucagcgggugcuccgacggcugcgggggcgccgcgugcgggugcuucaacgccgcccccagcugcaucuucuggcggaaguggguggagaacccgcacggcaucaucuggaaggucucccccugcgccgccugggugcccagcgcggugaucgagcucaccaugcccuccggcgagguccgcaccuuccacccgaugagcgggauccccacccagguguucaagggcguguccgucacguaccuggggagcgacauggagguguccggccugaccgaccucugcgagaucgaggagcucaagagcaagaagcuggcccuggcccccugcaaccaggccggcauggggguggucggcaaggugggggagaagcagugcagcuccgaggagagcgcccggaccaucaagaaggacggcugcaucuggaacgcggaccugguggggaucgagcugcgcgucgacgacgccgugugcuacuccaagaucaccagcguggaggccgucgccaacuacuccgccauccccacgaccaucggcggccugcgguucgagcgcagccacgacucccaggggaagaucagcggcuccccgcucgacaucaccgcgauccgggggagcuucuccgugaacuaccgcggccugcgccugagccucuccgagaucaccgccacgugcaccggggaggugaccaacgucagcggcugcuacuccugcaugaccggcgccaaggugagcaucaagcugcacuccagcaagaacuccaccgcccacgugcggugcaagggggacgagacggcguucagcguccuggagggcgugcacagcuacaucgugucccucagcuucgaccacgccgucguggacgagcagugccagcugaacugcgggggccacgagucccaggugacccugaaggggaaccucaucuuccuggacguccccaaguucguggacggcagcuacaugcagaccuaccacuccaccgugcccacgggcgccaacauccccagcccgaccgacuggcugaacgcccucuucgggaacggccugucccgcuggauccugggggucaucggcgugcuccugggcgggcuggcccucuucuuccugaucauguuccugcucaagcugggcaccaagcaggucuuccggagccgcaccaagcuggcguga

SEQ ID NO: 13256 - RNA, 3222 nt, Artificial Sequence
  derived and/or modified CDS sequence (opt1) from SFTSV/FTLSV(2012YSH92)__KF711941.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagccacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacgauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccuccggaucaaggugaagcgcaucaaccugaagugcaagaaguccagcuccuacuucgugccggacgcccggagccgcugcacguccguccggcgcugccggugggcgggggacugccagagcggcugcccgccccacuucaccuccaacagcuucuccgacgacugggccgggaagauggaccgcgccggccugggguucagcggcugcuccgacggcugcgggggcgccgcgugcgggugcuucaacgccgcccccagcugcaucuucuggcggaaguggguggagaacccccacggcaucaucuggaaggugucccccugcgccgccuggguccccagcgcggugaucgagcucaccaugccguccggggaggugcgcaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccggaccaucaagaaggacggcugcaucuggaacgcggaccugguggggaucgagcugcgcguggacgacgccgucugcuacuccaagaucacgagcguggaggccguggccaacuacuccgccaucccgaccaccaucggcgggcugcgguucgagcgcagccacgacucccagggcaagaucagcggcagcccccucgacaucaccgcgauccgggggagcuucuccgucaacuaccgcggccugcgccugagccucuccgagaucacggcgaccugcaccggggaggugaccaacgugagcggcugcuacuccugcaugaccggggccaaggucagcaucaagcugcacuccagcaagaacuccacggcccacgugcggugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgcugggugcugggggucaugggcgugcuccucgggggccuggcccuguucuucaugaucaugagccuguucaagcugggcacgaagcaggucuuccggucccgcaccaagcucgcguga

SEQ ID NO: 13257 - RNA, 3222 nt, Artificial Sequence
  derived and/or modified CDS sequence (opt1) from SFTSV/FTLSV(2012YSH93)__KF711946.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccaaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugacccggacggugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugaccauccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucacggcccccggcagccccgacagcaagugccucaagaucaaggugaagcggaucaaccugaagugcaagaaguccagcuccuacuucgugccggacgcccgcuaccggugcaccagcguccgccggugccgcugggcgggggacugccaguccggcugcccgccccacuucaccagcaacuccuucagcgacgacugggccgggaagauggaccgggccggccugggguucuccggcugcagcgacggcugcgggggcgccgcgugcgggugcuucaacgccgcccccuccugcaucuucuggcgcaaguggguggagaacccccacggcaucaucuggaaggugagccccugcgccgccuggguccccuccgcggugaucgagcucaccaugccgagcggggaggugcggacguuccaccccauguccggcauccccacccaggucuucaagggcgugagcgugaccuaccugggguccgacauggaggucagcggccugaccgaccucugcgagaucgaggagcugaaguccaagaagcuggcccuggcccccugcaaccaggccgggaugggcguggugggcaaggucggggagauccagugcagcagcgaggaguccgcccgcacgaucaagaaggacggcugcaucuggaacgcggaccucguggggaucgagcugcggguggacgacgccgucugcuacagcaagaucaccuccguggaggccguggccaacuacagcgccaucccgaccaccaucggcgggcugcgcuucgagcggucccacgacagccagggcaagaucuccggcagcccccucgacaucacggcgauccgcggguccuucagcgucaacuaccggggccugcgccugucccucagcgagaucaccgcgaccugcaccggggaggugaccaacguguccggcugcuacagcugcaugacgggggccaaggucuccaucaagcugcacagcuccaagaacagcaccgcccacgugcgcugcaagggcgacgagaccgccuucuccgugcuggagggcguccacagcuacaccgugagccucuccuucgaccacgccguggucgacgagcagugccagcugaacugcgggggccacgagagccaggugacgcugaaggggaaccucaucuuccuggacgugcccaaguucgucgacggcuccuacaugcagaccuaccacagcaccgugcccaccggggccaacaucccgucccccacggacuggcugaacgcccucuucggcaacggccugagccggugggugcugggggucaugggcgugcuccucgggggccuggcccuguucuucaugaucaugucccuguucaagcugggcaccaagcaggucuuccgcagccggaccaagcucgcguga

SEQ ID NO: 13258 - RNA, 3222 nt, Artificial Sequence
  derived and/or modified CDS sequence (opt1) from SFTSV/FTLSV(YGS1)__KF356537.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccucauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcucaagagcuucucccagagcgaguuccccgacaucugcaagaucgacgggaucgucuucaaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccuggucgggaagaccgcgauccacgugaagggcgcccugguggacgggaccgaguucaccuucgagggcagcugcauguuccccgacggcugcaacgccgucgacugcacguucugccgcgaguuccugaagaacccccagugcuaccccgccaagaaguggcuguucaucaucaucgugauccugcugggguacgccggccucaugcugcugaccaacgugcucaaggcgaucggggucuggggcuccugggugaucgcccccgugaagcugauguucgccaucaugaagaagcugaugcggaccgucagcugccucguggggaagcugauggaccgcggccgccaggugauccacgaggagaucggcgagaacggggagggcaaccacgacgacguccggaucgagauggcccggccccgccgcgugcggcacuggauguacuccccggugauccugaccauccucgccaucgggcuggcggagggcugcgacgagaugguccacgccgacagcaagcugguguccugccgccaggggagcggcaacaugaaggagugcgugacgaccggccgggcccuccugcccuccgucaaccccgggcaggaggccugccugcacuucaccgcccccggcagcccggacagcaagugccucaagaucaaggugaagcgcaucaaccugaagugcaagaaguccagcuccuacuucgugcccgacgcgcggagccgcugcaccuccguccggcgcugccggugggccggggacugccagagcggcugcccgccccacuucacguccaacagcuucuccgacgacugggccgggaagauggaccgcgccggccugggcuucagcgggugcuccgacggcugcgggggcgcggccugcgggugcuucaacgccgcccccagcugcaucuucuggcggaaguggguggagaacucccacggcaucaucuggaaggugagccccugcgccgcguggguccccuccgccgugaucgagcucaccaugccgagcggcgaggugcgcaccuuccaccccauguccgggauccccacccaggucuucaagggcgugagcgugacguaccugggguccgacauggaggucagcggccugaccgaccucugcgagaucgaggagcucaagagcaagaagcuggcccuggcccccugcaaccaggccggcauggggguggugggcaaggucggggagauccagugcuccagcgaggaguccgcgcggaccaucaagaaggacggcugcaucuggaacgccgaccugguggggaucgagcugcgcguggacgacgccgucugcuacagcaagaucaccuccguggaggccguggccaacuacagcgcgaucccgacgaccaucggcggccugcgguucgagcgcucccacgacagccaggggaagaucuccggcagcccccucgacaucaccgccauccggggguccuucagcgucaacuaccgcggccugcggcugucccucagcgagaucaccgccacgugcaccggggaggugaccaacguguccggcugcuacagcugcaugaccggcgccaaggucuccaucaagcugcacagcuccaagaacagcaccgcgcacgugcgcugcaagggggacgagacggccuucagcgugcuggagggcguccacuccuacaccgugagccucuccuucgaccacgccguggucgacgagcagugccagcugaacugcgggggccacgagagccaggugacccugaaggggaaccucaucuuccuggacgugcccaaguucgucgacggcuccuacaugcagaccuaccacagcacggugcccaccggcgccaacaucccgucccccaccgacuggcugaacgcccucuucgggaacggccugagccgcuggauccugggggucaucggcgugcuccugggcgggcuggcgcuguucuuccugaucauguuccuguucaagcucggcaccaagcaggucuuccggucccgcacgaagcuggccuga

SEQ ID NO: 13259 - RNA, 3222 nt, Artificial Sequence
  derived and/or modified CDS sequence (opt1) from SFTSV/FTLSV(YNY1)__KF356538.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccuguucggguacgccggccugaugcuccugaccaacgugcugaaggccaucgggaucuggggcuccugggugaucgcccccgucaagcucaucuucgcgaucaucaagaagcugaugcggaccgugagcugccugauggggaagcucauggaccgcggccgccaggugauccacgaggagaucggcgagaaccgggaggggaaccaggacgacguccggaucgagauggcccgcccccgccgggugcgccacuggauguacucccccgugauccugacgauccuggccaucggccucgccgagagcugcgacgagaugguccacgccgacuccaagcuggugagcugccggcagggguccggcaacaugaaggagugcgugaccaccgggcgcgcgcugcucccggccgucaaccccggccaggaggccugccugcacuucaccgcccccggcagccccgacagcaagugccugaagaucaaggugaagcggaucaaccucaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcugaccaugccguccggggaggugcggaccuuccaccccaugagcggcauccccacgcaggucuucaagggcguguccgugaccuaccucgggagcgacauggaggucuccggccugaccgaccugugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcuccggguggacgacgccgucugcuacuccaagaucacgagcguggaggccguggccaacuacuccgccaucccgaccaccaucggcgggcugcgcuucgagcggagccacgacucccagggcaagaucagcggcagcccccuggacaucaccgcgauccgcgggagcuucuccgucaacuaccggggccuccgccugagccuguccgagaucacggcgaccugcaccggggaggugaccaacgugagcggcugcuacuccugcaugaccggggccaaggucagcaucaagcuccacuccagcaagaacuccacggcccacgugcgcugcaagggcgacgagaccgccuucagcgugcuggagggcguccacagcuacaccgugucccugagcuucgaccacgccguggucgacgagcagugccagcucaacugcgggggccacgagucccaggugacccugaaggggaaccugaucuuccucgacgugcccaaguucgucgacggcagcuacaugcagacguaccacuccaccgugcccaccggggccaacaucccgagccccaccgacuggcugaacgcccuguucggcaacggccucucccgguggauccugggggugaugggcguccugcucgggggccuggcccuguucuucaugaucaugagccucuucaagcugggcacgaagcaggucuuccgcucccggaccaagcuggcguga

SEQ ID NO: 13260 - RNA, 3222 nt, Artificial Sequence
  derived and/or modified CDS sequence (opt1) from SFTSV/FTLSV(YPQ133)__KF356530.1__GP
augaugaaggugaucugguucagcucccugaucugcuucgucauccagugcagcggcgacuccagccccaucaucugcgccgggccgauccacuccaacaagagcgccgacaucccccaccuccugggcuacuccgagaagaucugccagaucgaccgccugauccacgugagcuccuggcuccggaaccacagccaguuccagggguacgugggccagcgcgggggccggucccaggucagcuacuaccccgcggagaacuccuacagccgcugguccggccugcugagccccugcgacgccgacuggcucgggaugcugguggugaagaaggccaagggcuccgacaugaucgucccggggcccagcuacaagggcaagguguucuucgagcggcccaccuucgacggguacgugggcuggggcugcggguccggcaagagccgcaccgagagcggggagcugugcuccagcgacuccggcacgagcuccggccuccugcccagcgaccggguccuguggaucggggacguggccugccagccgaugacccccauccccgaggagaccuuccucgagcugaaguccuucagccaguccgaguuccccgacaucugcaagaucgacggcaucguguucaaccagugcgagggggagagccugccgcagcccuucgacgucgccuggauggacgugggccacucccagaagaucaucaugcgcgagcacaagaccaagugggugcaggagagcuccagcaaggacuucgucugcuacaaggaggggacgggccccugcuccgagagcgaggagaagaccugcaagaccuccggcagcugccgcggggacaugcaguucugcaagguggcgggcugcgagcacggggaggaggccuccgaggccaagugccggugcagccucgugcacaagcccggcgaggucguggugagcuacgggggcaugcggguccgcccgaagugcuacggcuucucccggaugauggccacccuggaggugaaccagcccgagcagcgcaucgggcagugcacgggcugccaccuggagugcaucaacgggggcgugcggcucaucacccugaccagcgagcugaaguccgcgaccgucugcgccagccacuucugcuccagcgccacguccgggaagaaguccaccgagauccaguuccacagcggcagccucgugggcaagaccgccauccacgucaagggggcccugguggacggcaccgaguucacguucgagggguccugcauguuccccgacggcugcgacgcgguggacugcaccuucugccgcgaguuccugaagaacccccagugcuacccggccaagaaguggcuguucaucaucaucgucauccugcugggcuacgccgggcucaugcugcugaccaacgugcucaaggccaucggcaucugggggagcugggugaucgcccccgucaagcugaucuucgcgaucaucaagaagcugaugcggaccguguccugccucaugggcaagcugauggaccgcgggcgccaggugauccacgaggagaucggcgagaaccgggagggcaaccaggacgacguccggaucgagauggcccgcccccgccgggugcgccacuggauguacagccccgugauccugacgauccucgccaucgggcuggccgaguccugcgacgagaugguccacgccgacagcaagcugguguccugccggcagggcagcgggaacaugaaggagugcgugaccaccggccgcgcgcuccugccggccgucaaccccgggcaggaggccugccugcacuucaccgcccccggcagccccgacuccaagugccucaagaucaaggugaagcggaucaaccugaagugcaagaaguccagcagcuacuucgugccggacgcccgcucccggugcacgagcguccgccggugccgcugggcgggcgacugccaguccgggugcccgccccacuucaccagcaacuccuucagcgacgacugggccggcaagauggaccgggccgggcugggcuucuccgggugcagcgacggcugcggcggggccgcgugcggcugcuucaacgccgcccccuccugcaucuucuggcgcaaguggguggagaacccccacggggugaucuggaaggucagccccugcgccgccugggugcccuccgcggugaucgagcucaccaugccgagcggcgagguccggaccuuccaccccauguccgggauccccacccagguguucaagggcgugagcgucaccuaccugggcuccgacauggaggugagcgggcugaccgaccucugcgagaucgaggagcucaagagcaagaagcuggcccuggcccccugcaaccaggccggcauggggguggucggcaaggugggcgagauccagugcuccagcgaggaguccgcccgcaccaucaagaaggacgggugcaucuggaacgcggaccucgugggcaucgagcugcgggucgacgacgccgugugcuacagcaagaucacguccguggaggccgucgccaacuacagcgccaucccgaccaccaucgggggccugcgcuucgagcggucccacgacagccaggggaagaucuccggcagcccccucgacaucaccgcgauccgcggcuccuucagcgugaacuaccgggggcugcgccugucccucagcgagaucacggccacgugcaccggcgaggugaccaacgucuccgggugcuacagcugcaugaccggcgccaagguguccaucaagcugcacagcuccaagaacagcacggcccacgugcgcugcaagggggacgagaccgcguucagcguccuggagggcgugcacuccuacaccgugagccucuccuucgaccacgccgucguggacgagcagugccagcugaacugcggcgggcacgagagccaggugacccugaagggcaaccucaucuuccuggacguccccaaguucguggacggguccuacaugcagacguaccacagcaccgugcccaccggcgccaacaucccgucccccaccgacuggcugaacgcccucuucgggaacggccugagccgguggauccugggcgucaugggggugcuccugggcgggcuggcccucuucuucaugaucaugucccuguucaagcugggcacgaagcaggucuuccgcagccggaccaagcucgcguga

SEQ ID NO: 13261 - RNA, 3222 nt, Artificial Sequence
  derived and/or modified CDS sequence (opt1) from SFTSV/FTLSV(YPQ2)__KF356531.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaucgccauccacgucaagggcgcccugguggacgggaccgaguucaccuucgagggcagcugcauguuccccgacggcugcgacgcgguggacugcacguucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugaccauccucgccaucggccuggccgagagcugcgacgagaugguccacgccgacuccaagcuggugagcugccggcagggguccggcaacaugaaggagugcgugacgaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccgauggcccgcuuccggugcaccagcguccgccggugccgcugggcgggggacugccaguccggcugcccgccccacuucacgagcaacuccuucagcgacgacugggccgggaagauggaccgggccggccugggguucuccggcugcagcgacggcugcgggggcgccgcgugcgggugcuucaacgccgcccccuccugcaucuucuggcgcaaguggguggagaacccccacggcaucaucuggaaggugagccccugcgccgccuggguccccuccgcggugaucgagcucaccaugccgagcggggaggugcggaccuuccaccccauguccggcauccccacccaggucuucaagggcgugagcgugacguaccugggguccgacauggaggucagcggccugaccgaccucugcgagaucgaggagcugaaguccaagaagcuggcccuggcccccugcaaccaggccgggaugggcguggugggcaaggucggggagauccagugcagcagcgaggaguccgcccgcaccaucaagaaggacggcugcaucuggaacgcggaccucguggggaucgagcugcggguggacgacgccgucugcuacagcaagaucaccuccguggaggccguggccaacuacagcgccaucccgacgaccaucggcgggcugcgcuucgagcggucccacgacagccaggucaagaucuccggcagcccccucgacaucaccgcgaugcgcggcuccuucagcgugaacuaccgggggcugcgccugucccucagcgagaucaccgccacgugcaccggcgaggugaccaacgucuccgggugcuacagcugcaugaccggcgccaagguguccaucaagcugcacagcuccaagaacagcaccgcccacgugcgcugcaagggggacgagacggcguucuccguccuggagggcgugcacagcuacaccgugagccucuccuucgaccacgccgucguggacgagcagugccagcugaacugcggcgggcacgagagccaggugacccugaagggcaaccucaucuuccuggacguccccaaguucguggacggguccuacaugcagaccuaccacagcacggugcccaccggcgccaacaucccgucccccaccgacuggcugaacgcccucuucgggaacggccugagccgguggauccugggcgucaugggggugcuccugggcgggcuggcccucuucuucaugaucaugucccuguucaagcugggcaccaagcaggucuuccgcagccggacgaagcucgcguga

SEQ ID NO: 13262 - RNA, 3222 nt, Artificial Sequence
  derived and/or modified CDS sequence (opt1) from SFTSV/FTLSV(YPQ5)__KF356532.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccgcgucuccuacuaccccgcggagaacagcuacucccgguggagcgggcugcugucccccugcgacgccgacuggcucggcaugcugguggugaagaaggccaaggggagcgacaugaucgucccgggccccuccuacaaggggaagguguucuucgagcgccccaccuucgacggcuacgugggcugggggugcggcagcgggaagucccggaccgagagcggcgagcugugcagcuccgacagcggcacguccagcgggcuccugcccuccgaccgcguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgggagcacaagaccaagugggugcaggaguccagcuccaaggacuucgucugcuacaaggagggcacgggccccugcagcgaguccgaggagaagaccugcaagaccagcggguccugccgcggcgacaugcaguucugcaagguggcggggugcgagcacggcgaggaggccagcgaggccaagugccggugcucccucgugcacaagcccggggaggucguggugagcuacggcggcaugcgcguccggccgaagugcuacggguucagccgcaugauggccacccuggaggugaaccagcccgagcagcggaucggccagugcacggggugccaccuggagugcaucaacggcggggugcgccucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgggaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcgcaccgugagcugccucauggggaagcugauggaccggggccgccaggugauccacgaggagaucggcgagaaccgggaggggaaccaggacgacguccgcaucgagauggcccgcccccggcgcgugcggcacuggauguacucccccgugauccugacgauccucgccaucggccuggccgagagcugcgacgagaugguccacgccgacuccaagcuggugagcugccgccagggguccggcaacaugaaggagugcgugaccaccgggcgggcgcuccugccggccgucaaccccggccaggaggccugccugcacuucaccgcccccggcagccccgacagcaagugccucaagaucaaggugaagcgcaucaaccugaagugcaagaaguccagcuccuacuucgugccggucgcccgguaccgcugcacgagcgugcggcgcugccggugggcgggggacugccaguccggcugcccgccccacuucaccagcaacuccuucagcaacgacugggccgggaagauggaccgcgccggccugggguucuccggcugcagcgacggcugcgggggcgccgcgugcgggugcuucaacgccgcccccuccugcaucuucuggcggaaguggguggagaacccccacggcaucaucuggaaggucagccccugcgccgccugggugcccuccgcggugaucgagcucaccaugccgagcggggagguccgcaccuuccaccccauguccggcauccccacccagguguucaagggcgugagcgucaccuaccugggguccuacauggaggugagcggccugaccgaccucugcgagaucgaggagcugcgguccaagaagcuggcccuggcccccugcaaccaggccgggaugggcguggucggcaaggugggggagauccagugcagcagcgaggaguccgcccgcaccaucaagaaggacggcugcaucuggaacgcggaccucguggggaucgagcugcgggucgacgacgccgugugcuacagcaagaucacguccguggaggccgucgccaacuacagcgccaucccgaccaccaucggcgggcugcgcuucgagcggucccacgacagccagggcaagaucuccggcagcccccucgacaucaccgcgauccgcggguccuucagcgugaacuaccgcggccugcggcugucccucagcgagaucacggccacgugcaccggggaggugaccaacgucuccggcugcuacagcugcaugaccggggccaagguguccaucaagcugcacagcuccaagaacagcacggcccacgugcgcugcaagggcgacgagaccgcguucuccguccuggagggcgugcacagcuacaccgugagccucuccuucgaccacgccgucguggacgagcagugccagcugaacugcgggggccacgagagccaggugacccugaaggggaaccucaucuuccuggacguccccaaguucguggacggcuccuacaugcagacguaccacagcaccgugcccaccggggccaacaucccgucccccaccgacuggcugaacgcccucuucggcaacggccugagccgguggauccugggggucaugggcgugcuccucgggggccuggcccuguucuucaugaucaugucccuguucaagcugggcacgaagcaggucuuccgcagccggaccaagcucgcguga

SEQ ID NO: 13263 - RNA, 3222 nt, Artificial Sequence
  derived and/or modified CDS sequence (opt1) from SFTSV/FTLSV(YSC19)__KF356536.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccucauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcugaaguccuucucccagagcgaguuccccgacaucugcaagaucgacgggaucgucuucaaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaaggccugcaagaccagcggguccugccggggcgacaugcaguucugcaagguggccgggugcgagcacggcgaggaggccagcgaggcgaagugccgcugcucccugguccacaagcccggggaggugguggucagcuacggcggcaugcgggugcgcccgaagugcuacggguucagccggaugauggccaccauggaggugaacccgcccgagcagcgcaucggccagugcaccgggugccaccuggagugcaucaacggcgggguccggcucaucacgcugaccuccgagcucaagagcgccaccgugugcgccucccacuucugcagcuccgccaccagcggcaagaaguccacggagauccacuuccacagcggcucccucgucgggaagaccgcgauccacgugaagggcgcccugguggacgggaccgaguucaccuucgagggcagcugcauguuccccgacggcugcaacgccgucgacugcacguucugccgcgaguuccugaagaacccccagugcuaccccgccaagaaguggcuguucaucaucaucgugauccugcugggguacgccggccucaugcugcugaccaacgugcucaaggcgaucggggucuggggcuccugggugaucgcccccgugaagcugauguucgccaucaugaagaagcugaugcggaccgucagcugccucguggggaagcugauggaccgcggccgccaggugauccacgaggagaucggcgagaacggggagggcaaccacgacgacguccggaucgagauggcccggccccgccgcgugcggcacuggauguacuccccggugauccugaccauccucgccaucgggcuggcggagggcugcgacgagaugguccacgccgacagcaagcugguguccugccgccaggggagcggcaacaugaaggagugcgugacgaccggccgggcccuccugcccuccgucaaccccgggcaggaggccugccugcacuucaccgcccccggcagcccggacagcaagugccucaagaucaaggugaagcgcaucaaccugaagugcaagaaguccagcuccuacuucgugcccaucgcgcggaaccgcugcaccagcguccggcgcugccggugggccggggacugccaguccggcugcccgccccacuucacgagcaacuccuucagcgacgacugggccgggaagauggaccgcgccggccugggcuucuccgggugcagcgacggcugcgggggcgcggccugcgggugcuucaacgccgcccccuccugcaucuucuggcggaaguggguggagaacagccacggcaucaucuggaaggugucccccugcgccgcguggguccccagcgccgugaucgagcucaccaugccguccggcgaggugcgcaccuuccaccccaugagcgggauccccacccaggucuucaagggcguguccgugacguaccuggggagcgacauggaggucuccggccugaccgaccucugcgagaucgaggagcucaagagcaagaagcuggcccuggcccccugcaaccaggccggcauggggguggugggcaaggucggggagauccagugcagcuccgaggagagcgcgcggaccaucaagaaggacggcugcaucuggaacgccgaccugguggggaucgagcugcgcguggacgacgccgucugcuacuccaagaucaccagcguggaggccguggccaacuacuccgcgaucccgacgaccaucggcggccugcgguucgagcgcagccacgacucccaggggaagaucagcggcagcccccucgacaucaccgccauccgggggagcuucuccgucaacuaccgcggccugcggcugagccucuccgagaucaccgccacgugcaccggggaggugaccaacgugagcggcugcuacuccugcaugaccggcgccaaggucagcaucaagcugcacuccagcaagaacuccaccgcgcacgugcgcugcaagggggacgagacggccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagaccuaccacuccacggugcccaccggcgccaacaucccgagccccaccgacuggcugaacgcccucuucgggaacggccugucccgcuggauccugggggucaucggcgugcuccugggcgggcuggcgcuguucuuccugaucauguuccuguucaagcucggcaccaagcaggucuuccggagccgcacgaagcuggccuga

SEQ ID NO: 13264 - RNA, 3222 nt, Artificial Sequence
  derived and/or modified CDS sequence (opt1) from SFTSV/FTLSV(YSC3)__KF356535.1__GP
augaugaaggugaucugguucagcucccuggugugccucgugauccagugcagcggcgacuccgggcccaucaucugcgccggcccgauccacagcaacaaguccgccgcgaucccccaccuccugggguacagcgagaagaucugccagaucgaccgccugauccacguguccagcuggcugcggaaccacucccaguuccagggcuacgucgggcagcgcggcggccggagccagguguccuacuaccccgccgagaacagcuacucccgcuggagcgggcugcucucccccugcgacgccgacuggcugggcaugcugguggucaagaaggccaaggggagcgacaugaucgugccgggccccuccuacaaggggaagguguucuucgagcggcccaccuucgacggcuacgucggcugggggugcggcagcgggaagucccgcaccgagagcggcgagcucugcagcuccgacagcggcacguccagcgggcugcugcccuccgaccgggugcucuggaucggcgacguggccugccagccgaugacccccauccccgaggagaccuuccuggagcugaaguccuucucccagagcgaguuccccgacaucugcaagaucgacgggaucgucuucaaccagugcgagggcgagucccucccgcagcccuucgacguggcguggauggacguggggcacagccacaagaucaucaugcgcgagcacaagaccaaguggguccaggaguccagcuccaaggacuucgugugcuacaaggagggcacgggccccugcagcgaguccgaggagaagaccugcaagaccagcggguccugccggggcgacaugcaguucugcaagguggccgggugcgagcacggcgaggaggccagcgaggccaagugccgcugcucccugguccacaagcccggggaggugguggucagcuacggcggcaugcgggugcgcccgaagugcuacggguucagccggaugauggcgacccuggaggugaaccagcccgagcagcgcaucggccagugcacggggugccaccucgagugcaucaacggcgggguccggcugaucacccugaccuccgagcucaagagcgccaccgugugcgccucccacuucugcagcuccgccacgagcggcaagaaguccaccgagauccaguuccacagcggcucccuggucgggaagaccgccauccacgugaagggcgcgcugguggacgggaccgaguucacguucgagggcagcugcauguuccccgacggcugcgacgccgucgacugcaccuucugccgcgaguuccucaagaacccccagugcuacccggccaagaaguggcuguucaucaucaucgugauccugcucggguacgccggccugaugcugcucaccaacgugcugaaggccaucgggaucuggggcuccugggucaucgcgcccgugaagcugaucuucgccaucaucaagaagcucaugcggaccgugagcugccugauggggaagcugauggaccgcggccggcaggucauccacgaggagaucggcgagaaccgcgaggggaaccaggacgacgugcggaucgagauggcccgcccccgccggauccgccacuggauguacucccccgugauccucacgauccuggccaucggccuggccgagagcugcgacgagaugguccacgcggacuccaagcucgugagcugccggcagggguccggcaacaugaaggagugcgugaccaccgggcgcgcccugcugccggccgucaaccccggccaggaggccugccuccacuucaccgcccccggcagccccgacagcaagugccugaagaucaaggugaagcggaucaaccugaagugcaagaaguccagcuccuacuucgugccggacgcgcgcagccggugcacguccguccgccggugccgcugggccggggacugccagagcggcugcccgccccacuucaccuccaacagcuucuccgacgacugggccgggaagauggaccgggccggccucggguucagcggcugcuccgacggcugcgggggcgcggccugcgggugcuucaacgccgcccccagcugcaucuucuggcgcaaguggguggagaacccccacggcaucaucuggaaggugucccccugcgccgcguggguccccagcgccgugaucgagcugaccaugccguccggggaggugcggaccuuccaccccaugagcggcauccccacgcaggucuucaagggcguguccgugaccuaccuggggagcgacauggaggucuccggccucaccgaccugugcgagaucgaggagcucaagagcaagaagcuggcccuggcccccugcaaccaggccgggaugggcguggugggcaaggucggggagauccagugcagcuccgaggagagcgcgcgcaccaucaagaaggacggcugcaucuggaacgccgaccugguggggaucgagcugcggguggacgacgccgucugcuacuccaagaucacgagcguggaggccguggccaacuacuccgcgaucccgaccaccaucggcgggcuccgcuucgagcggagcuacgacucccagggcaagaucagcggcagcccccuggacaucaccgccauccgcgggagcuucuccgucaacuaccggggccugcgccucagccuguccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcucgagggcguccacagcuacaccgugucccugagcuucgaccacgccguggucgacgagcagugccagcugaacugcgggggccacgagucccaggugacccucaaggggaaccugaucuuccuggacgugcccaaguucgucgacggcagcuacaugcagacguaccacuccaccgugcccaccggggccaacaucccgagccccaccgacuggcucaacgcccuguucggcaacggccugucccgguggauccucggggugaucggcguccugcucgggggccuggcgcuguucuucaugaucaugagccuguucaagcucggcacgaagcaggucuuccgcucccggaccaagcuggccuga

SEQ ID NO: 13265 - RNA, 3222 nt, Artificial Sequence
  derived and/or modified CDS sequence (opt1) from SFTSV/FTLSV(YSH39)__KF356529.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuucauggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggauccgcccgaagugcuacggguucagccggaugauggccacccucgaggucaaccagcccgagcagcgcaucggccagugcacggggugccaccuggagugcaucaacggcggggugcggcugaucacccucaccuccgagcugaaguccgcgaccgugugcgccucccacuucugcagcuccgccacgagcggcaagaaguccaccgagauccaguuccacagcggcucccuggucgggaagaccgccauccacgugaagggcgcccucgucgacgggaccgaguucacguucgagggcagcugcauguuccccgacggcugcgacgcgguggacugcaccuucugccgcgaguuccugaagaacccccagugcuacccggccaagaaguggcuguucaucaucaucgugauccuccuggggcacgccggccugaugcuccugaccaacguccugaaggccaucgggaucuggggcuccugggugaucgcccccgugaagcucaucuucgcgaucaucaagaagcugaugcggaccgucagcugccugauggggaagcucauggaccgcggccgccaggugauccacgaggagaucggcgagaaccgggaggggaaccaggacgacgugcggaucgagauggcccgcccccgccggguccgccacuggauguacucccccgugauccugacgauccuggccaucggccucgccgagagcugcgacgagauggugcacgccgacuccaagcuggucagcugccggcagggguccggcaacaugaaggagugcgugaccaccgggcgcgcgcugcucccggccgugaaccccggccaggaggccugccugcacuucaccgcccccggcagccccgacagcaagugccugaagaucaaggucaagcggaucaaccucaagugcaagaaguccagcuccuacuucgugccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaagugggucgagaacccccacggcaucaucuggaaggugucccccugcgccgccugggugcccagcgcggucaucgagcugaccaugccguccggggaggugcggaccuuccaccccaugagcggcauccccacccagguguucaagggcgucuccgugaccuaccucgggagcgacauggagguguccggccugaccgaccugugcgagaucgaggagcucaagagcaagaagcuggcccuggcccccugcaaccaggccgggaugggcgucgugggcaaggugggggagauccagugcagcuccgaggagagcgcccgcaccaucaagaaggacggcugcaucuggaacgcggaccuggucgggaucgagcuccggguggacgacgccgugugcuacuccaagaucacgagcgucgaggccguggccaacuacuccgccaucccgaccaccaucggcgggcugcgcuucgagcggagccacgacucccagggcaagaucagcggcagcccccuggacaucaccgcgauccgcgggagcuucuccgugaacuaccggggccuccgccugagccuguccgagaucacggccacgugcaccggggaggucaccaacgugagcggcugcuacuccugcaugaccggggccaaggugagcaucaagcuccacuccagcaagaacuccacggcccacguccgcugcaagggcgacgagaccgcguucagcgugcuggagggcgugcacagcuacaccgucucccugagcuucgaccacgccgugguggacgagcagugccagcucaacugcgggggccacgagucccaggucacccugaaggggaaccugaucuuccucgacgugcccaaguucguggacggcagcuacaugcagacguaccacuccaccguccccaccggggccaacaucccgagccccaccgacuggcugaacgcccuguucggcaacggccucucccgguggauccugggggugaucggcgugcugcucgggggccuggcccuguucuucaugaucaugagccucuucaagcugggcacgaagcaggucuuccgcucccggaccaagcuggcguga

SEQ ID NO: 13266 - RNA, 3222 nt, Artificial Sequence
  derived and/or modified CDS sequence (opt1) from SFTSV/FTLSV(YSHX002)__KF356540.1__GP
augaugaaggugaucugguucagcucccugaucugccucgugauccagugcagcggcgacuccgggcccaucaucugcgccggcccgauccacagcaacaaguccgccgggaucccccaccuccugggcuacagcgagaagaucugccagaucgaccgccucauccacguguccagcuggcugcggaaccacucccaguuccagggguacgugggccagcgcggcgggcggagccaggucuccuacuaccccgcggagaacagcuacucccgcuggaacggccugcucagccccugcgacgccgacuggcuggggaugcugguggugaagaaggccaaggaguccgacaugaucgucccgggccccagcuacaaggggaagguguucuucgagcggcccaccuucgacggcuacgugggcugggggugcggcuccggcaagagccgcaccgaguccggggagcucugcagcagcgacuccggcacgagcuccgggcugcugcccagcgaccggguccucuggaucggcgacguggccugccagccgaugacccccauccccgaggagaccuuccuggagcugaaguccuucagccaguccgaguuccccgacaucugcaagaucgacgggaucguguucaaccagugcgagggcgagagccucccgcagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaaggcgugcaagaccuccgggagcugccggggcgacaugcaguucugcaagguggccgggugcgagcacggcgaggaggccuccgaggccaagugccgcugcagccuggugcacaagcccggggaggucgugguguccuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccagcgagcuccgcuccgccaccgucugcgccagccacuucugcuccagcgccaccuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcuggugaccaacgugcucaaggccaucggggucuggggcagcugggugaucgcgcccgugaagcugauguucgccaucaucaagaagcugaugcgcaccgucuccugccucguggggaagcugauggaccggggccgccaggugauccacgaggagaucggcgagaacggggagggcaaccaggacgacguccggaucgagauggcccgcccccgccgggugcgccacuggauguacagcccggugauccugaccauccucgccaucgggcuggccgagggcugcgacgagaugguccacgcggacuccaagcuggugagcugccggcagggguccggcaacaugaaggagugcaucacgaccggccgcgcccuccugcccgccgugaaccccgggcaggaggccugccugcacuucaccgcccccggcagcccggacuccaagugccucaagaucaaggucaagcggaucaaccugaagugcaagaaguccagcagcuacuucgugcccgacgcgcgcagccggugcaccuccgugcgccggugccgcugggccggggacugccagagcggcugcccgccccacuucacguccaacagcuucuccgacgacugggccgggaagauggaccgggccggccugggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugccgagcgccgucaucgagcucaccaugcccuccggcgaggugcggaccuuccaccccaugagcgggauccccacccagguguucaagggcgucuccgugacguaccuggggagcgacauggagguguccggccugaccgaccucugcgagaucgaggagcucaagagcaagaagcuggcccuggccccgugcaaccaggccggcaugggggucgugggcaaggugggggagaagcagugcuccagcgaggagagcgcgcgcaccaucaagaaggacggcugcaucuggaacgccgaccuggucgggaucgagcugcggguggacgacgccgugugcuacuccaagaucaccagcgucgaggccguggccaacuacuccgcgauccccacgaccaucggcggccugcgcuucgagcggagccacgacucccaggggaagaucagcggcagcccccucgacaucaccgccauccgcgggagcuucuccgugaacuaccggggccugcgccugagccucuccgagaucaccgccacgugcaccggggaggucaccaacgugagcggcugcuacuccugcaugaccggcgccaaggugagcaucaagcugcacuccagcaagaacuccaccgcgcacguccgcugcaagggggacgagacggccuucagcgugcuggagggcgugcacuccuacaucgucagccucagcuucgaccacgccgugguggacgagcagugccagcugaacugcgggggccacgagucccaggucacccugaaggggaaccucaucuuccuggacgugcccaaguucguggacggcagcuacaugcagaccuaccacuccaccgucccgacgggcgccaacauccccagccccaccgacuggcugaacgcccucuucgggaacggccugucccgguggauccugggggugaucggcguccuccugggcgggcuggcgcuguucuuccugaucauguuccugcucaagcugggcaccaagcaggucuuccgcagccggaccaagcuggccuga

SEQ ID NO: 13267 - RNA, 3222 nt, Artificial Sequence
  derived and/or modified CDS sequence (opt1) from SFTSV/FTLSV(YXX2)__KF356534.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugagccagcccgagcagcgcaucgggcagugcaccggcugccaccucgagugcaucaacgggggcgugcggcugaucacccugaccagcgagcucaaguccgcgacggucugcgccagccacuucugcuccagcgccaccuccggcaagaaguccaccgagauccaguuccacuccgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugguguucgcgaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucacgauccuggccaucgggcuggccgagggcugcgacgagauggugcacgcggacuccaagcucgucagcugccggcagggguccggcaacaugaaggagugcgugaccaccggccgcgcccugcugccggccgugaaccccgggcaggaggccugccuccacuucaccgcccccggcagccccgacuccaagugccugaagaucaaggucaagcggaucaaccugaagugcaagaaguccagcagcuacuucgugccggacgcgcgcagccggugcacguccgugcgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaagugggucgagaacccccacggcaucaucuggaaggugucccccugcgccgcgugggugcccagcgccgucaucgagcugaccaugccguccggcgaggugcggaccuuccaccccaugagcgggauccccacccagguguucaagggcgucuccgugaccuaccuggggagcgacauggagguguccggccucaccgaccugugcgagaucgaggagcucaagagcaagaagcuggcccuggcccccugcaaccaggccggcaugggggucgugggcaaggugggggagauccagugcuccagcgaggagagcgcgcgcaccaucaagaaggacggcugcaucuggaacgccgaccuggucgggaucgagcugcggguggacgacgccgugugcuacuccaagaucacgagcgucgaggccguggccaacuacuccgcgaucccgaccaccaucggcggccuccgcuucgagcggagccacgacucccaggggaagaucagcggcagcccccuggacaucaccgccauccgcgggagcuucuccgugaacuaccggggccugcgccucagccuguccgagaucacggccacgugcaccggggaggucaccaacgugagcggcugcuacuccugcaugaccggcgccaaggugagcaucaagcugcacuccagcaagaacuccacggcgcacguccgcugcaagggggacgagaccgccuucagcgugcucgagggcgugcacuccuacagcgucagccuguccuucgacuacgccgugguggacgagcagugccagcugaacugcgggggccacgagagccaggucacccuccgggggaaccugaucuuccuggacgugcccaaguucguggacggcuccuacaugcagaccuaccacagcacgguccccaccggcgccaacaucccgucccccaccgacuggcucaacgcccuguucgggaacggccugagccgcuggauccucggggugaucggcguccugcugggcgggcucgcgcuguucuuccugaucaugucccucuucaagcugggcaccaagcagaucuuccggagccgcacgaagcuggccuga

SEQ ID NO: 13268 - RNA, 3222 nt, Artificial Sequence
  derived and/or modified CDS sequence (opt1) from SFTSV/Huaiyangshan virus(2010-FQM)__HQ419236.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaaggcgugcaaggccagcggcuccugccgcggggacaugcaguucugcaagguggccggcugcgagcacggggaggaggccagcgaggcgaagugccggugcucccuggugcacaagcccggcgaggucguggugagcuacggcgggaugcggguccgcccgaagugcuacggcuucucccggaugauggccacccuggaggugagccagcccgagcagcgcaucgggcagugcaccggcugccaccucgagugcaucaacgggggcgugcggcugaucacgcugaccagcgagcucaaguccgccaccgucugcgccagccacuucugcuccagcgccaccuccggcaagaaguccacggagauccaguuccacuccgggagccuggugggcaagaccgcgauccacgucaagggggcccugguggacggcaccgaguucaccuucgagggcuccugcauguuccccgacgggugcgacgccguggacugcacguucugccgcgaguuccucaagaacccccagugcuacccggccaagaaguggcuguucaucaucaucgucauccugcucggcuacgccgggcugaugcugcucaccaacgugcugaaggcgaucggcgugugggggagcugggucaucgcccccgugaagcugguguucgccaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucaccauccuggcgaucgggcuggccgagggcugcgacgagauggugcacgccgacuccaagcucgucagcugccggcagggguccggcaacaugaaggagugcgugaccacgggccgcgcccugcugccggccgugaaccccgggcaggaggcgugccuccacuucaccgcccccggcagccccgacuccaagugccugaagaucaaggucaagcggaucaaccugaagugcaagaaguccagcagcuacuucgugccggacgcccgcagccggugcaccuccgugcgccggugccgcugggccggggacugccagagcggcugcccgccccacuucaccuccaacagcuucuccgacgacugggcggggaagauggaccgggccggccucggcuucagcgggugcuccgacggcugcgggggcgccgccugcgggugcuucaacgccgcgcccagcugcaucuucuggcgcaagugggucgagaacccccacggcaucaucuggaaggugucccccugcgccgccugggugcccagcgccgucaucgagcugacgaugccguccggcgaggugcggaccuuccaccccaugagcgggauccccacccagguguucaagggcgucuccgugaccuaccuggggagcgacauggagguguccggccucacggaccugugcgagaucgaggagcucaagagcaagaagcuggcccuggcgcccugcaaccaggccggcaugggggucgugggcaaggugggggagauccagugcuccagcgaggagagcgcccgcaccaucaagaaggacggcugcaucuggaacgccgaccuggucgggaucgagcugcggguggacgacgccgugugcuacuccaagaucaccagcgucgaggcgguggccaacuacuccgccaucccgaccacgaucggcggccuccgcuucgagcggagccacgacucccaggggaagaucagcggcagcccccuggacaucaccgccauccgcgggagcuucuccgugaacuaccggggccugcgccucagccuguccgagaucaccgcgaccugcacgggggaggucaccaacgugagcggcugcuacuccugcaugaccggcgccaaggugagcaucaagcugcacuccagcaagaacuccaccgcccacguccgcugcaagggggacgagaccgccuucagcgugcucgagggcgugcacuccuacagcgucagccuguccuucgaccacgccgugguggacgagcagugccagcugaacugcgggggccacgagagccaggucacgcuccgggggaaccugaucuuccuggacgugcccaaguucguggacggcuccuacaugcagaccuaccacagcaccguccccaccggcgcgaacaucccgucccccacggacuggcucaacgcccuguucgggaacggccugagccgcuggauccucggggugaucggcguccugcugggcgggcucgcccuguucuuccugaucauguuccucuucaagcugggcaccaagcagaucuuccggucccgcaccaagcuggccuga

SEQ ID NO: 13269 - RNA, 3222 nt, Artificial Sequence
  derived and/or modified CDS sequence (opt1) from SFTSV/Huaiyangshan virus(2010-LZR)__HQ419237.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugagccagcccgagcagcgcaucgggcagugcaccggcugccaccucgagugcaucaacgggggcgugcggcugaucacccugaccagcgagcucaaguccgcgacggucugcgccagccacuucugcuccagcgccaccuccggcaagaaguccaccgagauccaguuccacuccgggagccuggugggcaagaccgccauccacgucaagggggcccugguggacggcacggaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcgugugggggagcugggucaucgcccccgugaagcugguguucgcgaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucacgauccuggccaucgggcuggccgagggcugcgacgagauggugcacgcggacuccaagcucgucagcugccggcagggguccggcaacaugaaggagugcgugaccaccggccgcgcccugcugccggccgugaaccccgggcaggaggccugccuccacuucaccgcccccggcagccccgacuccaagugccugaagaucaaggucaagcggaucaaccugaagugcaagaaguccagcagcuacuucgugccggacgcgcgcagccggugcacguccgugcgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaagugggucgagaacccccacggcaucaucuggaaggugucccccugcgccgcguggauccccagcgccgugaucgagcugaccaugccguccggcgagguccggaccuuccaccccaugagcgggauccccacccagguguucaagggcguguccgucaccuaccuggggagcgacauggagguguccggccucaccgaccugugcgagaucgaggagcucaagagcaagaagcuggcccuggcccccugcaaccaggccggcauggggguggucggcaaggugggggagauccagugcuccagcgaggagagcgcgcgcaccaucaagaaggacggcugcaucuggaacgccgaccugguggggaucgagcugcgggucgacgacgccgugugcuacuccaagaucacgagcguggaggccgucgccaacuacuccgcgaucccgaccaccaucggcggccuccgcuucgagcggagccacgacucccaggggaagaucagcggcagcccccuggacaucaccgccauccgcgggagcuucuccgugaacuaccggggccugcgccucagccuguccgagaucacggccacgugcaccggggaggugaccaacgucagcggcugcuacuccugcaugaccggcgccaaggugagcaucaagcugcacuccagcaagaacuccacggcgcacgugcgcugcaagggggacgagaccgccuucagcguccucgagggcgugcacuccuacagcgugagccuguccuucgaccacgccgucguggacgagcagugccagcugaacugcgggggccacgagagccaggugacccuccgggggaaccugaucuuccuggacguccccaaguucguggacggcuccuacaugcagaccuaccacagcacggugcccaccggcgccaacaucccgucccccaccgacuggcucaacgcccuguucgggaacggccugagccgcuggauccucggggucaucggcgugcugcugggcgggcucgcgcuguucuuccugaucaugucccucuucaagcugggcaccaagcagaucuuccggagccgcacgaagcuggccuga

SEQ ID NO: 13270 - RNA, 3222 nt, Artificial Sequence
  derived and/or modified CDS sequence (opt1) from SFTSV/Huaiyangshan virus(2010-T112)__HQ419238.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgugcagcgcaucggccagugcacggggugccaccuggagugcaucaacggcgggguccggcucaucacccugaccuccgagcucaagagcgcgaccgugugcgccucccacuucugcagcuccgccacgagcggcaagaaguccaccgagauccaguuccacagcggcucccuggucgggaagaccgccauccacgugaagggcgcccugguggacgggaccgaguucacguucgagggcagcugcauguuccccgacggcugcgacgcggucgacugcaccuucugccgcgaguuccugaagaacccccagugcuacccggccaagaaguggcuguucaucaucaucgugauccugcugggguacgccggccucaugcugcugaccaacgugcucaaggccaucgggaucuggggcuccugggucaucgcccccgugaagcugaucuucgcgaucaucaagaagcugaugcggaccgugagcugccucauggggaagcugauggaccgcggccggcaggucauccacgaggagaucggcgagaaccgcgaggggaaccaggacgacgugcggaucgagauggcccgcccccgccgggugcgccacuggauguacgcccccgucauccugacgauccucgccaugggccuggccgaguccugcgacgagauggugcacgcggacagcaagcugguguccugccggcaggggagcggcaacaugaaggagugcgucaccaccgggcgcgcccuccugccggccgugaaccccggccaggaggccugccugcacuucaccgcccccggcucccccgacagcaagugccucaagaucaaggugaagcggaucaaccugaagugcaagaaguccagcagcuacuucgucccggacgcgcgcucccggugcacgagcgugcgccggugccgcugggccggggacugccaguccggcugcccgccccacuucaccagcaacuccuucagcgacgacugggccgggaagauggaccgggccggccugggguucuccggcugcagcgacggcugcgggggcgcggccugcgggugcuucaacgccgcccccuccugcaucuucuggcgcaaguggguggagaacccccacggcaucaucuggaaggucagccccugcguggccugggugcccuccgcggucaucgagcucaccaugccgagcggggaggugcggaccuuccaccccauguccggcauccccacccagguguucaagggcgucagcgugaccuaccugggguccgacauggaggugagcggccugaccgaccucugcgagaucgaggagcugaaguccaagaagcuggcccuggcccccugcaaccaggccgggaugggcgucgugggcaaggugggggagauccagugcagcagcgaggaguccgcccgcaccaucaagaaggacggcugcaucuggaacgcggaccucgucgggaucgagcugcggguggacgacgccgugugcuacagcaagaucacguccgucgaggccguggccaacuacagcgccaucccgaccaccaucggcgggcugcgcuucgagcggucccacgacagccagggcaagaucuccggcagcccccucgacaucaccgcgauccgcggguccuucagcgugaacuaccggggccugcgccugucccucagcgagaucacggccacgugcaccggggaggucaccaacguguccggcugcuacagcugcaugaccggggccaagguguccaucaagcugcacagcuccaagaacagcacggcccacguccgcugcaagggcgacgagaccgcguucuccgugcuggagggcgugcacagcuacaccgucagccucuccuucgaccacgccgugguggacgagcagugccagcugaacugcgggggccacgagagccaggucacccugaaggggaaccucaucuuccuggacgugcccaaguucguggacggcuccuacaugcagacguaccacagcaccguccccaccggggccaacaucccgucccccaccgacuggcugaacgcccucuucggcaacggccugagccgguggauccugggggugaucggcguccuccucgggggccuggcccuguucuucaugaucaugucccuguucaagcugggcacgaagcaggucuuccgcagccggaccaagcucgcguga

SEQ ID NO: 13271 - RNA, 3222 nt, Artificial Sequence
  derived and/or modified CDS sequence (opt1) from SFTSV/Huaiyangshan virus(2010-WJ)__HQ419229.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggaagcgcggcggccggagccaggucuccuacuaccuggcggagaacagcuacucccgcuggagcgggcugcucucccccugcgacgccgacuggcugggcaugcugguggugaagaaggccaaggggagcgacaugaucguccccggcccguccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagcccaugaccccgauccccgaggagaccuuccuggagcucaagagcuucucccagagcgaguuccccgacaucugcaagaucgacgggaucguguucaaccagugcgagggcgagucccugccccagccguucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggguccgccccaagugcuacggguucagccggaugauggccacccuggaggugaaccagccggagcagcgcaucggccagugcacggggugccaccucgagugcaucaacggcggggugcggcugaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccucaagaacccccagugcuaccccgccaagaaguggcuguucaucaucaucgucauccugcucggguacgccggccugaugcugcucaccaacgugcugaaggccaucgggaucuggggcuccugggugaucgccccggucaagcugaucuucgcgaucaucaagaagcucaugcggaccgugagcugccugauggggaagcugauggaccgcggccgccaggugauccacgaggagaucggcgagaaccgggaggggaaccaggacgacguccggaucgagauggcccgcccccgccgggugcgccacuggauguacucccccgugauccucacgauccuggccaucggccuggccgagagcugcgacgagaugguccacgccgacuccaagcucgugagcugccggcagggguccggcaacaugaaggagugcgugaccaccgggcgcgcgcugcugcccgccgucaacccgggccaggaggccugccuccacuucaccgcccccggcagccccgacagcaagugccugaagaucaaggugaagcggaucaaccugaagugcaagaaguccagcuccuacuucgugcccgacgcccgcagccggugcacguccguccgccggugccgcugggcgggggacugccagagcggcugcccgccccacuucacccccaacuccuucagcgacgacugggccgggaagauggaccgggccggccucggguucuccggcugcagcgacggcugcgggggcgccgcgugcgggugcuucaacgccgccccguccugcaucuucuggcgcaaguggguggagaacccccacggcaucaucuggaaggugagccccugcgccgccuggguccccuccgcggugaucgagcugaccaugccgagcggggaggugcggaccuuccaccccauguccggcauccccacgcaggucuucaagggcgugagcgugaccuaccugggguccgacauggaggucagcggccucaccgaccugugcgagaucgaggagcugaaguccaagaagcuggcccucgcccccugcaaccaggccgggaugggcguggugggcaaggucggggagauccagugcagcagcgaggaguccgcccgcaccaucaagaaggacggcugcaucuggaacgcggaccugguggggaucgagcugcggguggacgacgccgucugcuacagcaagaucacguccguggaggccguggccaacuacagcgccaucccgaccaccaucggcgggcuccgcuucgagcggucccacgacagccagggcaagaucuccggcagcccccuggacaucaccgcgauccgcggguccuucagcgucaacuaccggggccugcgccucucccugagcgagaucacggcgaccugcaccggggaggugaccaacguguccggcugcuacagcugcaugaccggggccaaggucuccaucaagcugcacagcuccaagaacagcacggcccacgugcgcugcaagggcgacgagaccgccuucuccgugcucgagggcguccacagcuacaccgugagccuguccuucgaccacgccguggucgacgagcagugccagcugaacugcgggggccacgagagccaggugacccucaaggggaaccugaucuuccuggacgugcccaaguucgucgacggcuccuacaugcagacguaccacagcaccgugcccaccggggccaacaucccgucccccaccgacuggcucaacgcccuguucggcaacggccugagccgguggauccucggggugaucggcguccugcucgggggccuggcccuguucuucaugaucaugucccuguucaagcucggcacgaagcaggucuuccgcagccggaccaagcuggcguga

SEQ ID NO: 13272 - RNA, 3222 nt, Artificial Sequence
  derived and/or modified CDS sequence (opt1) from SFTSV/Huaiyangshan virus(2010-WJQ)__HQ419230.1__GP
augaugaaggugaucugguucagcucccugaucugccucgucauccagugcggcggggacaccggccccaucaucugcgccgggccgacccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccacguucgacggcuacgugggguggggcugcgggagcggcaagucccgcaccgagagcggcgagcucugcuccagcgacagcgggaccuccagcggccugcugcccuccgaccggguccucuggaucggggacguggccugccagccgaugacccccauccccgaggagacguuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagaccaagugggugcaggaguccagcuccaaggacuucgucugcuacaaggagggcaccgggcccugcagcgaguccgaggagaagaccugcaagacgagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacccuggaggugagccagcccgagcagcgcaucgggcagugcaccggcugccaccucgagugcaucaacgggggcgugcggcugaucacccugacgagcgagcucaaguccgcgaccgucugcgccagccacuucugcuccagcgccaccuccggcaagaaguccaccgagauccaguuccacuccgggagccuggugggcaagacggccauccacgucaagggggcccugguggacggcaccgaguucaccuucgagggcuccugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucacgaacgugcugaaggccaucggcgugugggggagcugggucaucgcccccgugaagcugguguucgcgaucaucaagaagcucaugcgggccgucuccugccugaugggcaagcugauggaccgcggccgccaggugauccacgaggagaucggggagaaccgggagggcaaccaggacgacgugcggaucgagauggcccgcccccgccggguccgccacuggauguacagccccgugauccucaccauccuggccaucgggcuggccgagggcugcgacgagauggugcacgcggacuccaagcucgucagcugccggcagggguccggcaacaugaaggagugcgugaccaccggccgcgcccugcugccggccgugaaccccgggcaggaggccugccuccacuucacggcccccggcagccccgacuccaagugccugaagaucaaggucaagcggaucaaccugaagugcaagaaguccagcagcuacuucgugccggacgcgcgcagcgggugcaccuccgugcggcgcugccggugggccggcgacugccagagcgggugcccgccccacuucaccuccaacagcuucuccgacgacugggccggcaagauggaccgcgccggccucggguucagcggcugcuccgacgggugcggcggggcggccugcggcugcuucaacgccgcccccagcugcaucuucuggcggaagugggucgagaacccccacggcaucaucuggaaggugucccccugcgccgcgugggugcccagcgccgucaucgagcugaccaugccguccggggaggugcgcacguuccaccccaugagcggcauccccacccagguguucaagggggucuccgugaccuaccugggcagcgacauggagguguccggccucaccgaccugugcgagaucgaggagcucaagagcaagaagcuggcccuggcccccugcaaccaggccgggaugggcgucguggggaaggugggcgagauccagugcuccagcgaggagagcgcgcggacgaucaagaaggacgggugcaucuggaacgccgaccuggucggcaucgagcugcgcguggacgacgccgugugcuacuccaagaucaccagcgucgaggccguggccaacuacuccgcgaucccgaccaccaucggcgggcuccgguucgagcgcagccacgacucccagggcaagaucagcgggagcccccuggacaucacggccauccggggcagcuucuccgugaacuaccgcgggcugcggcucagccuguccgagaucaccgcgaccugcaccggcgaggucaccaacgugagcggcugcuacuccugcaugacgggggccaaggugagcaucaagcugcacuccagcaagaacuccaccgcccacguccgcugcaagggcgacgagaccgccuucagcgugcucgagggggugcacuccuacagcgucagccuguccuucgaccacgccgugguggacgagcagugccagcugaacugcggcgggcacgagagccaggucacccuccgcggcaaccugaucuuccuggacgugcccaaguucguggacggcuccuacaugcagacguaccacagcaccguccccaccggggccaacaucccgucccccaccgacuggcucaacgcccuguucggcaacgggcugagccgguggauccucggcgugaucggcguccugcucgggggccuggcgcuguucuuccugaucaugucccucuucaagcuggggacgaagcagaucuuccgcagccggaccaagcuggccuga

SEQ ID NO: 13273 - RNA, 3222 nt, Artificial Sequence
  derived and/or modified CDS sequence (opt1) from SFTSV/Huaiyangshan virus(2010-WSQ)__HQ419235.1__GP
augaugaaggugaucugguucagcucccugaucugccucgugauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagcgggcgugcaagaccagcggguccugccgcggcgacaugcaguucugcaagguggccgggugcgagcacggcgaggaggccagcgaggccaagugccggugcucccuggugcacaagcccggggaggucguggugagcuacggcggcaugcgcguccggccgaagugcuacggguucagccgcaugauggcgacccuggaggugaacccgcccgagcagcggaucggccagugcaccgggugccaccucgagugcaucaacggcggggugcgccugaucacgcugaccuccgagcuccggagcgccaccgucugcgccucccacuucugcagcuccgccaccagcggcaagaaguccacggagauccacuuccacagcggcucccugaucgggaagaccgccauccacgugaagggcgcgcuggucgacgggaccgaguucaccuucgagggcagcugcauguuccccgacggcugcgacgccguggacugcacguucugccgcgaguuccucaagaacccccagugcuaccccgccaagaaguggcuguucaucaucaucgugauccugcucggguacgccggccugaugcugcucaccaacguccugaaggccaucgggguguggggcuccugggugaucgcgcccgucaagcugauguucgccaucaucaagaagcucaugcggaccgugagcugccugguggggaagcugauggaccgcggccggcaggucauccacgaggagaucggcgagaacggggagggcaaccaggacgacgugcgcaucgagauggcccgcccccggcgcgugcggcacuggauguacuccccggucauccucaccauccuggccaucgggcuggccgaggacugcgacgagauggugcacgcggacagcaagcucguguccugccgccagggcagcgggaacaugaaggagugcaucacgaccggccgggcccugcugcccgccgucaaccccggccaggaggccugccuccacuucaccgcccccggguccccggacagcaagugccugaagaucaaggugaagcgcaucaaccugaagugcaagaaguccagcagcuacuucgugcccgacgcgcggucccgcugcaccagcguccggcgcugccggugggccggcgacugccaguccgggugcccgccccacuucacgagcaacuccuucagcgacgacugggccggcaagauggaccgcgccgggcucggcuucuccggcugcagcgacgggugcggcggggcggccugcggcugcuucaacgccgcccccuccugcaucuucuggcggaaguggguggagaacccccacgggaucaucuggaaggugagccccugcgccgcgugggucccguccgccgugaucgagcugaccaugcccagcggcgaggugcgcaccuuccaccccauguccggcauccccacccaggucuucaagggggugagcgugacguaccugggcuccgacauggaggucagcgggcucaccgaccugugcgagaucgaggagcugaaguccaagaagcuggcccucgccccgugcaaccaggccggcaugggcgugguggggaaggucggcgagauccagugcagcagcgaggaguccgcgcggaccaucaagaaggacgggugcaucuggaacgccgaccuggugggcaucgagcugcgcguggacgacgccgucugcuacagcaagaucaccuccguggaggccguggccaacuacagcgcgauccccacgaccaucgggggccuccgguucgagaagucccacgacagccagggcaagaucuccgggagcccccuggacaucaccgccauccgcggcuccuucagcgucaacuaccgggggcugcgccucucccugagcgagaucaccgccacgugcaccggcgaggugaccaacguguccgggugcuacagcugcaugaccggcgccaaggucuccaucaagcugcacagcuccaagaacagcaccgcgcacgugcgcugcaagggcgacgagacggccuucuccgugcucgaggggguccacagcuacaucgugagccuguccuucgaccacgccguggucgacgagcagugccagcugaacugcggcgggcacgagagccaggugacccucaagggcaaccugaucuuccuggacgugcccaaguucgucgacggguccuacaugcagaccuaccacagcaccgugccgacgggcgccaacauccccucccccaccgacuggcucaacgcccuguucggcaacgggcugagccgguggauccucggcgugaucgggguccugcugggcggccucgcgcuguucuuccugaucauguuccuccugaagcuggggaccaagcaggucuuccgcucccggaccaagcucgccuga

SEQ ID NO: 13274 - RNA, 3222 nt, Artificial Sequence
  derived and/or modified CDS sequence (opt1) from SFTSV/Huaiyangshan virus(2010-WWG)__HQ419231.1__GP
augaugaaggugaucugguucagcacccugaucugcuucgugauccagugcuccggcgacagcgggcccaucaucugcgccggcccgauccacuccaacaagagcgccgacaucccccaccuccugggguacuccgagaagaucugccagaucgaccgccugauccacgugagcuccuggcuccggaaccacagccaguuccagggcuacguggggcagcgcggcggccggucccaggucagcuacuaccccgcggagaacuccuacagccgcugguccgggcugcugagccccugcgacgccgacuggcucggcaugcugguggugaagaaggccaagggguccgacaugaucgucccgggccccagcuacaaggggaagguguucuucgagcggcccaccuucgacggcuacgugggcugggggugcggcuccggcaagagccgcacggaguccggggagcugugcagcagcgacuccggcaccagcuccgggcuccugcccagcgaccggguccuguggaucggcgacguggccugccagccgaugacccccauccccgaggagaccuuccucgagcugaaguccuucagccaguccgaguuccccgacaucugcaagaucgacgggaucguguucaaccagugcgagggcgagagccugccgcagcccuucgacgucgccuggauggacguggggcacucccacaagaucaucaugcgcgagcacaagacgaagugggugcaggagagcuccagcaaggacuucgucugcuacaaggagggcaccggccccugcuccgagagcgaggagaagaccugcaagaccuccgggagcugccggggcgacaugcaguucugcaagguggcggggugcgagcacggcgaggaggccuccgaggccaagugccgcugcagccucgugcacaagcccggggaggucgugguguccuacggcggcaugcggguccgcccgaagugcuacggguucccccggaugauggccacgcuggaggugaaccagcccgagcagcgcaucggccagugcaccgggugccaccuggagugcaucaacggcggggugcggcucaucacccugaccagcgagcugcgcagcgcgacggucugcgccucccacuucugcagcuccgccaccagcggcaagaaguccaccgagauccaguuccacagcggcucccucguggggaagaccgccauccacgucaagggcgcccugguggacgggacggaguucaccuucgagggcagcugcauguuccccgacggcugcgacgcgguggacugcaccuucugccgggaguuccugaagaacccgcagugcuaccccgccaagaaguggcuccugaucaucaucgucauccugcucggguacgccggccugaugcugcucaccaacgugcugaaggccaucgggaucuggggcuccugggugaucgcccccgucaagcugaucuucgcgaucaucaagaagcucaugcgcgccgugagcugccugauggggaagcugauggaccggggccgccaggugauccacgagggcaucggggagaaccgggagggcaaccaggacgacguccgcaucgagauggcccgcccccggcgcgugcggcacuggauguacuccccggugauccucacgauccuggccaucgggcuggccgagagcugcgacgagaugguccacgcggacuccaagcucgugagcugccgccagggcuccgggaacaugaaggagugcgugaccaccggccgggcccugcugcccgccgucaaccccggccaggaggccugccuccacuucaccgcccccgggagcccggacuccaagugccugaagaucaaggugaagcgcaucaaccugaagugcaagaaguccagcuccuacuucgugcccgacgcgcggagccgcugcacguccguccggcgcugccggugggccggcgacugccagagcgggugcccgccccacuucaccuccaacagcuucuccgacgacugggccggcaagauggaccgcgccgggcucggcuucagcggcugcuccgacgggugcggcggggcggccugcggcugcuucaacgccgcccccagcugcaucuucuggcggaaguggguggagaacccccacgggaucaucuggaaggugucccccugcgccgcgugggucccgagcgccgugaucgagcugaccaugcccuccggcgaggugcgcaccuuccaccccaugagcggcauccccacgcaggucuucaaggggguguccgugaccuaccugggcagcgacauggaggucuccgggcucaccgaccugugcgagaucgaggagcucaagagcaagaagcuggcccuggccccgugcaaccaggccggcaugggcgugguggggaaggucggcgagauccagugcuccagcgaggagagcgcgcggaccaucaagaaggacgggugcaucuggaacgccgaccuggugggcaucgagcugcgcguggacgacgccgucugcuacuccaagaucacgagcguggaggccguggccaacuacuccgcgauccccaccaccaucgggggccuccgguucgagcgcagccacgacucccagggcaagaucagcgggagcccccuggacaucaccgccauccggggcagcuucuccgucaacuaccgcgggcugcgccucagccuguccgagaucacggcgaccugcaccggcgaggugaccaacgugagcgggugcuacuccugcaugaccggcgccaaggucagcaucaagcugcacuccagcaagaacuccacggcccacgugcggugcaagggcgacgagaccgccuucagcgugcucgaggggguccacuccuacaccgugagccugagcuucgaccacgccguggucgacgagcagugccagcugaacugcggcgggcacgagucccaggugacccucaagggcaaccugaucuuccuggacgugcccaaguucgucgacgggagcuacaugcagacguaccacuccaccgugccgaccggcgccaacauccccagccccaccgacuggcucaacgcccuguucggcaacgggcugucccgcuggauccucggcgugaucgggguccugcugggcggccucgcgcuguucuucaugaucaugagccuguucaagcucgggacgaagcaggucuuccggucccgcaccaagcuggccuga

SEQ ID NO: 13275 - RNA, 3222 nt, Artificial Sequence
  derived and/or modified CDS sequence (opt1) from SFTSV/Huaiyangshan virus(2010-WWX)__HQ419232.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccugcucgagugcaucaacggcggggugcggcugaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugaucgacgggaccgaguucacguucgagggcagcugcauguuccccgacggcugcgacgcgguggacugcaccuucugccgcgaguuccucaagaacccccagugcuacccggccaagaaguggcuguucaucaucaucgugauccugcucggguacgccggccugaugcugcucaccaacguccugaaggccaucgggaucuggggcuccugggugaucgcccccgugaagcugaucuucgcgaucaucaagaagcucaugcggaccgucagcugccugauggggaagcugauggaccgcggccgccaggugauccacgaggagaucggcgagaaccgggaggggaaccaggacgacgugcggaucgagauggcccgcccccgccggguccgccacuggauguacucccccgugauccucacgauccuggccaucggccuggccgagagcugcgacgagauggugcacgccgacuccaagcucgucagcugccggcagggguccggcaacaugaaggagugcgugaccaccgggcgcgcgcugcugccggccgugaaccccggccaggaggccugccuccacuucaccgcccccggcagccccgacagcaagugccugaagaucaaggucaagcggaucaaccugaagugcaagaaguccagcuccuacuucgugccggacgcccgcagccggugcacguccgugcgccggugccgcugggcgggggacugccagagcggcugcccgccccacuucaccuccaacagcuucuccgacgacugggccgggaagauggaccgggccggccucggguucagcggcugcuccgacggcugcgggggcgccgcgugcgggugcuucaacgccgcccccagcugcaucuucuggcgcaagugggucgagaacccccacggcaucaucuggaaggugucccccugcgccgccugggugcccagcgcggucaucgagcugaccaugccguccggggaggugcggaccuuccaccccaugagcggcauccccacccagguguucaagggcgucuccgugaccuaccuggggagcgacauggagguguccggccucaccgaccugugcgagaucgaggagcucaagagcaagaagcuggcccuggcccccugcaaccaggccgggaugggcgucgugggcaaggugggggagauccagugcagcuccgaggagagcgcccgcaccaucaagaaggacggcugcaucuggaacgcggaccuggucgggaucgagcugcggguggacgacgccgugugcuacuccaagaucacgagcgucgaggccguggccaacuacuccgccaucccgaccaccaucggcgggcuccgcuucgagcggagccacgacucccagggcaagaucagcggcagcccccuggacaucaccgcgauccgcgggagcuucuccgugaacuaccggggccugcgccucagccuguccgagaucacggccacgugcaccggggaggucaccaacgugagcggcugcuacuccugcaugaccggggccaaggugagcaucaagcugcacuccagcaagaacuccacggcccacguccgcugcaagggcgacgagaccgcguucagcgugcucgagggcgugcacagcuacaccgucucccugagcuucgaccacgccgugguggacgagcagugccagcugaacugcgggggccacgagucccaggucacccucaaggggaaccugaucuuccuggacgugcccaaguucguggacggcagcuacaugcagacguaccacuccaccguccccaccggggccaacaucccgagccccaccgacuggcucaacgcccuguucggcaacggccugucccgguggauccucggggugaucggcgugcugcucgggggccuggcccuguucuucaugaucaugagccuguucaagcucggcacgaagcaggucuuccgcucccggaccaagcuggcguga

SEQ ID NO: 13276 - RNA, 3222 nt, Artificial Sequence
  derived and/or modified CDS sequence (opt1) from SFTSV/Huaiyangshan virus(2010-ZGQ)__HQ419233.1__GP
augaugaaggugaucugguucagcucccugaucugccucgucauccagugcggcggggacaccggccccaucaucugcgccgggccgacccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccacguucgacggcuacgugggguggggcugcgggagcggcaagucccgcaccgagagcggcgagcucugcuccagcgacagcgggaccuccagcggccugcugcccuccgaccggguccucuggaucggggacguggccugccagccgaugacccccauccccgaggagacguuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagaccaagugggugcaggaguccagcuccaaggacuucgucugcuacaaggagggcaccgggcccugcagcgaguccgaggagaagaccugcaagacgagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacccuggaggugagccagcccgagcagcgcaucgggcagugcaccggcugccaccucgagugcaucaacgggggcgugcggcugaucacccugacgagcgagcucaaguccgcgaccgucugcgccagccacuucugcuccagcgccaccuccggcaagaaguccaccgagauccaguuccacuccgggagccuggugggcaagacggccauccacgucaagggggcccugguggacggcaccgaguucaccuucgagggcuccugcauguuccccgacgggugcgacgcgguggacugcaccuucugccgcgaguuccucaagaacccccagugcuacccggccaagaaguggcuguucaucaucgucgugauccugcucggcuacgccgggcugaugcugcucacgaacgugcugaaggccaucggcgucugggggagcugggugaucgcccccgugaagcuggucuucgcgaucaucaagaagcucaugcgggccguguccugccugaugggcaagcugauggaccgcggccgccaggugauccacgaggagaucggggagaaccgggagggcaaccaggacgacguccggaucgagauggcccgcccccgccgggugcgccacuggauguacagccccgugauccucaccauccuggccaucgggcuggccgagggcugcgacgagaugguccacgcggacuccaagcucgugagcugccggcagggguccggcaacaugaaggagugcgugaccaccggccgcgcccugcugccggccgucaaccccgggcaggaggccugccuccacuucacggcccccggcagccccgacuccaagugccugaagaucaaggugaagcggaucaaccugaagugcaagaaguccagcagcuacuucgugccggacgcgcgcagccggugcaccuccguccgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggugucccccugcgccgcguggguccccagcgccgugaucgagcugaccaugccguccggcgaggugcggacguuccaccccaugagcgggauccccacccaggucuucaagggcguguccgugaccuaccuggggagcgacauggaggucuccggccucaccgaccugugcgagaucgaggagcucaagagcaagaagcuggcccuggcccccugcaaccaggccggcauggggguggugggcaaggucggggagauccagugcuccagcgaggagagcgcgcgcacgaucaagaaggacggcugcaucuggaacgccgaccugguggggaucgagcugcggguggacgacgccgucugcuacuccaagaucaccagcguggaggccguggccaacuacuccgcgaucccgaccaccaucggcggccuccgcuucgagcggagccacgacucccaggggaagaucagcggcagcccccuggacaucacggccauccgcgggagcuucuccgucaacuaccggggccugcgccucagccuguccgagaucaccgcgaccugcaccggggaggugaccaacgugagcggcugcuacuccugcaugacgggcgccaaggucagcaucaagcugcacuccagcaagaacuccaccgcccacgugcgcugcaagggggacgagaccgccuucagcgugcucgagggcguccacuccuacagcgugagccuguccuucgaccacgccguggucgacgagcagugccagcugaacugcgggggccacgagagccaggugacccuccgggggaaccugaucuuccuggacgugcccaaguucgucgacggcuccuacaugcagacguaccacagcaccgugcccaccggcgccaacaucccgucccccaccgacuggcucaacgcccuguucgggaacggccugagccgcuggauccucggggucaucggcgugcugcugggcgggcucgcgcuguucuuccugaucaugucccucuucaagcugggcacgaagcagaucuuccggagccgcaccaagcuggccuga

SEQ ID NO: 13277 - RNA, 3222 nt, Artificial Sequence
  derived and/or modified CDS sequence (opt1) from SFTSV/Huaiyangshan virus(M-HZM)__JF951393.1__GP
augaugaaggugaucugguucagcucccugaccugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcacggagagcggcgagcucugcagcuccgacagcggcaccuccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagacgaagugggugcaggaguccagcuccaaggacuucgucugcuacaaggagggcaccggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcacggggugccaccucgagugcaucaacggcggggugcggcugaucacccugaccuccgagcuccgcagcgccaccgucugcgccucccacuucugcagcuccgccacgagcggcaagaagaacaccgagauccacuuccacuccggcagccugguggggaagaccgccauccacgucaagggcgcgcugguggacgggaccgaguucacguucgagggcuccugcauguuccccgacggcugcgacgccguggacugcaccuucugccgggaguuccucaagaacccccagugcuaccccgccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagcccggugauccucacgauccuggccaucgggcuggccgagggcugcgacgagauggugcacgcggacuccaagcucgucagcugccggcagggguccggcaacaugaaggagugcaucaccaccggccgcgcccugcugcccgccgugaaccccgggcaggaggccugccuccacuucaccgcccccggcagcccggacuccaagugccugaagaucaaggugaagcggaucaaccugaagugcaagaaguccagcuccuacuucguccccgacgcgcgcagccggugcacguccgugcgccggugccgcugggccggggacugccagagcggcugcccgccccacuucaccuccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcugaccaugcccuccggcgagguccggaccuuccaccccaugagcgggauccccacccagguguucaagggcguguccgucaccuaccuggggagcgacauggagguguccggccucaccgaccugugcgagaucgaggagcucaagagcaagaagcuggcccuggccccgugcaaccaggccggcauggggguggucggcaaggugggggagauccagugcuccagcgaggagagcgcgcgcaccaucaagaaggacggcugcaucuggaacgccgaccugguggggaucgagcugcgggucgacgacgccgugugcuacuccaagaucacgagcguggaggccgucgccaacuacuccgcgauccccaccaccaucggcggccuccgcuucgagcggagccacgacucccaggggaagaucagcggcagcccccuggacaucaccgccauccgcgggagcuucuccgugaaccugcggggccuccgccugagccuguccgagaucacggccacgugcaccggggaggugaccaacgucagcggcugcuacuccugcaugaccggcgccaaggugagcaucaagcuccacuccagcaagaacuccacggcgcacgugcgcugcaagggggacgagaccgccuucagcguccuggagggcgugcacuccuacaucgugagccugagcuucgaccacgccgucguggacgagcagugccagcucaacugcgggggccacgagucccaggugacccugaaggggaaccugaucuuccucgacguccccaaguucguggacggcagcuacaugcagaccuaccacuccacggugccgaccggcgccaacauccccagccccaccgacuggcugaacgcccuguucgggaacggccucucccgguggauccugggggucaucggcgugcugcucggcgggcuggcgcuguucuuccucaucauguuccugcugaagcucggcaccaagcaggucuuccgcagccggacgaagcuggccuga

SEQ ID NO: 13278 - RNA, 3222 nt, Artificial Sequence
  derived and/or modified CDS sequence (opt1) from SFTSV/Phlebovirus(AH15/China/2010 strain AH15)__HQ141593.1__GP
augaugaaggugaucugguucuucagccugaucugccucgucauccagugcggcggggacaccggccccaucaucugcgccgggccgauccacuccaacaagagcgccgacaucccccaccuccugggcuacuccgagaagaucugccagaucgaccgccugauccacgugagcuccuggcugcggaaccacagccaguuccagggguacgugggccagcgcggcgggcggucccaggucagcuacuaccccgcggagaacuccuacagccgcugguccggccugcucagccccugcgacgccgacuggcuggggaugcugguggugaagaaggccaagggcuccgacaugaucgucccggggcccagcuacaagggcaagguguucuucgagcggcccaccuucgacggcuacgugggguggggcugcggguccggcaagagccgcacggaguccggcgagcucugcagcuccgacagcgggaccagcuccggccugcugcccagcgaccggguccucuggaucggggacguggccugccagccgaugacccccauccccgaggagaccuuccuggagcugaaguccuucagccaguccgaguuccccgacaucugcaagaucgacggcaucguguucaaccagugcgagggggagagccucccgcagcccuucgacgucgccuggaugggcgugggccacucccacaagaucaucaugcgcgagcacaagacgaagugggugcaggagagcuccagcaaggacuucgucugcuacaaggaggggaccggccccugcuccgagagcgaggagaagaccugcaagaccuccgggagcugccggggcgacaugcaguucugcaagguggcggggugcgagcacggcgaggaggccuccgaggccaagugccgcugcagccuggugcacaagcccggcgaggucgugguguccuacgggggcaugcggguccgcccgaagugcuacggguucagccggaugauggccacgcuggaggugaacgagcccgagcagcgcaucggccagugcaccgggugccaccucgagugcaucaacggcggcgugcggcugaucacccugaccuccgagcucaagagcgcgacggucugcgccagccacuucugcuccagcgccaccuccgggaagaaguccaccgagauccaguuccacuccggcagccugguggggaagaccgccauccacgucaagggcgcccugguggacggcacggaguucaccuucgagggguccugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggguguggggcagcugggucaucgcccccgugaagcugguguucgcgaucaucaagaagcucaugcgggccgucuccugccugaugggcaagcugauggaccgcgggcgccaggugauccacgaggagaucggcgagaaccgggaggggaaccaggacgacgugcggaucgagauggcccgcccccgccggguccgccacuggauguacagccccgugauccucacgauccuggccaugggccuggccgaggggugcgacgagauggugcacgcggacuccaagcucgucagcugccggcagggcuccggcaacaugaaggagugcgugaccaccgggcgcgcccugcugccggccgugaaccccggccaggaggccugccuccacuucaccgcccccgggagccccgacuccaagugccugaagaucaaggucaagcggaucaaccugaagugcaagaaguccagcagcuacuucgugccggacgcgcgcagccggugcacguccgugcgccggugccgcugggccggcgacugccagagcgggugcccgccccacuucaccuccaacagcuucuccgacgacugggccggcaagauggaccgggccggccucggguucagcggcugcuccgacgggugcggcggggcggccugcggcugcuucaacgccgcccccagcugcaucuucuggcgcaagugggucgagaacccccacggcaucaucuggaaggugucccccugcgccgcgugggugcccagcgccgucaucgagcugaccaugccguccggggaggugcggaccuuccaccccaugagcggcauccccacccagguguucaagggggucuccgugaccuaccugggcagcgacauggagguguccggccucaccgaccugugcgagaucgaggagcucaagagcaagaagcuggcccuggcccccugcaaccaggccgggaugggcgucguggggaaggugggcgagauccagugcuccagcgaggaguccgcgcgcaccaucaagaaggacgggugcaucuggaacgccgaccuggucggcaucgagcugcggguggacgacgccgugugcuacagcaagaucacgagcgucgaggccguggccaacuacuccgcgaucccgaccaccaucggcgggcuccgcuucgagcggagccacgacucccagggcaagaucagcgggagcccccuggacaucaccgccauccgcggcagcuucuccaucaacuaccgggggcugcgccucagccugacggagaucaccgccacgugcaccggcgaggugaccaacgucuccggcugcuacagcugcaugacgggggccaagguguccaucaagcugcacagcuccaagaacagcaccgcgcacgugcgcugcaagggcgacgagaccgccuucuccguccucgagggggugcacagcuacuccgugagccuguccuucgaccacgccgucguggacgagcagugccagcugaacugcggcgggcacgagagccaggugacccuccggggcaaccugaucuuccuggacguccccaaguucguggacggcagcuacaugcagacguaccacuccaccgugcccaccggggccaacaucccgagccccaccgacuggcucaacgcccuguucggcaacgggcugucccgcuggauccucggcgucaucggcgugcugcucgggggccuggcgcuguucuuccugaucaugagccucuucaagcuggggacgaagcaggucuuccggucccgcaccaagcuggccuga

SEQ ID NO: 13279 - RNA, 3222 nt, Artificial Sequence
  derived and/or modified CDS sequence (opt1) from SFTSV/Phlebovirus(HN6/China/2010 strain HN6)__HQ141596.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcgacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugaucuucgcgaucaucaagaagcugaugcggaccgugagcugccucguggggaagcugauggaccgcggccggcaggucauccacgaggagaucggcgagaaccgcgaggggaaccaggacgacgugcggaucgagauggcccgcccccgccgggugcgccacuggauguacucccccgucauccugacgauccucgccaucggccuggccgagagcugcgacgagauggugcacgccgacuccaagcuggugagcugccggcagggguccggcaacaugaaggagugcgucaccaccgggcgcgcgcuccugccggccgugaaccccggccaggaggccugccugcacuucaccgcccccggcagccccgacagcaagugccucaagaucaaggugaagcggaucaaccugaagugcaagaaguccagcuccuacuucgucccggacgcccgcagccggugcacguccgugcgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggucucccccugcgccgccugggugcccagcgcggugaucgagcucaccaugccguccggggagaugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccacggucagcaucaagcugcacuccagcaagaacuccaccgcccacgugcgcugcaagggcgacgagaccgccuucagcgugcuggagggcguccacagcuacaccgugucccucagcuucgaccacgccguggucgacgagcagugccagcugaacugcgggggccacgagucccaggugacgcugaaggggaaccucaucuuccuggacgugcccaaguucgucgacggcagcuacaugcagaccuaccacuccaccgugcccaccggggccaacaucccgagccccacggacuggcugaacgcccucuucggcaacggccugucccgguggauccugggggugaucggcguccuccucgggggccuggcccuguucuucaugaucaugagccuguucaagcugggcaccaagcaggucuuccgcucccggaccaagcucgcguga

SEQ ID NO: 13280 - RNA, 3222 nt, Artificial Sequence
  derived and/or modified CDS sequence (opt1) from SFTSV/Phlebovirus(JN1/China/2010)__JN258706.1__GP
augaugaaggugaucugguucagcucccugaucugccucgugauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccaacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcuggucacgcugaccuccgagcuccgcagcgccaccgugugcgccucccacuucugcagcuccgccaccagcggcaagaaguccacggagauccacuuccacagcggcucccuggucgggaagaccgccauccacgugaagggcgcgcugguggacgggaccgaguucaccuucgagggcagcugcauguuccccgacggcugcgacgccgucgacugcacguucugccgggaguuccucaagaacccccagugcuaccccgccaagaaguggcuguucaucaucaucgugauccugcucggguacgccggccugaugcugcucaccaacgugcugaaggccaucggggucuggggcuccugggugaucgcgcccgugaagcugauguucgccaucaucaagaagcucaugcgcaccgucagcugccugguggggaagcugauggaccggggccgccaggugauccacgaggagaucggcgagaacggggagggcaaccaggacgacguccggaucgagauggcccgcccccgccgggugcgccacuggauguacuccccggugauccucaccauccuggccaucgggcuggccgagggcugcgacgagaugguccacgcggacagcaagcucguguccugccggcaggggagcggcaacaugaaggagugcaucacgaccggccgcgcccugcugcccgccgugaaccccgggcaggaggccugccuccacuucaccgcccccggcuccccggacagcaagugccugaagaucaaggucaagcggaucaaccugaagugcaagaaguccagcagcuacuucgugcccgacgcgcgcucccggugcaccagcgugcgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaagugggucgagaacccccacggcaucaucuggaaggugagccccugcgccgcgugggugccguccgccgucaucgagcugaccaugcccagcggcgaggugcggaccuuccaccccauguccgggauccccacccagguguucaagggcgucagcgugacguaccugggguccgacauggaggugagcggccucaccgaccugugcgagaucgaggagcugaaguccaagaagcuggcccucgccccgugcaaccaggccggcaugggggucgugggcaaggugggggagauccagugcagcagcgaggaguccgcgcgcaccaucaagaaggacggcugcaucuggaacgccgaccuggucgggaucgagcugcggguggacgacgccgugugcuacagcaagaucaccuccgucgaggccguggccaacuacagcgcgauccccacgaccaucggcggccuccgcuucgagcggucccacgacagccaggggaagaucuccggcagcccccuggacaucaccgccauccgcggguccuucagcgugaacuaccggggccugcgccucucccugagcgagaucaccgccacgugcaccggggaggucaccaacguguccggcugcuacagcugcaugaccggcgccaagguguccaucaagcugcacagcuccaagaacagcaccgcgcacguccgcugcaagggggacgagacggccuucuccgugcucaagggcgugcacagcuacaucgucagccuguccuucgaccacgccgugguggacgagcagugccagcugaacugcgggggccacgagagccaggucacccucaaggggaaccugaucuuccuggacgugcccaucuucguggacggcuccuacaugcagaccuaccacagcaccgucccgacgggcgccaacauccccucccccaccgacuggcucaacgcccuguucgggaacggccugagccgguggauccucggggugaucggcguccugcugggcgggcucgcgcuguucuuccugaucauguuccuccugaagcugggcaccaagcaggucuuccgcucccggaccaagcucgccuga

SEQ ID NO: 13281 - RNA, 3222 nt, Artificial Sequence
  derived and/or modified CDS sequence (opt1) from SFTSV/Phlebovirus(JS2010-014)__JQ317170.1__GP
augaugaaggugaucugguucagcuaccugaucugcuucgugauccagugcuccggcgacagcgggcccaucaucugggccggcccgauccacuccaacaagagcgccgacaucccccaccuccugggguacuccgagaagaucugccagaucgaccgccugauccacgugagcuccuggcuccggaaccacagccaguuccagggcuacguggggcagcgcggcggccggucccaggucagcuacuaccccgcggagaacuccuacagccgcugguccgggcugcugagccccugcgacgccgacuggcucggcaugcugguggugaagaaggccaagggguccgacaugaucgucccgggccccagcuacaaggggaagguguucuucgagcggcccaccuucgacggcuacgugggcugggggugcggcuccgggaagucccgcaccgaguccggcgagcugugcagcagcgacuccggcacgagcuccgggcuccugcccagcgaccggguccuguggaucggcgacguggccugccagccgaugacccccauccccgaggagaccuuccucgagcugaaguccuucagccaguccgaguuccccgacaucugcaagaucgacgggaucguguucaaccagugcgagggcgagagccugccgcagcccuucgacgucgccuggauggacguggggcacucccacaagaucaucaugcgcgagcacaagaccaagugggugcaggagagcuccagcaaggacuucgucugcuacaaggagggcacgggccccugcuccgagagcgaggagaagaccugcaagaccuccgggagcugccggggcgacaugcaguucugcaagguggcggggugcgagcacggcgaggaggccuccgaggccaagugccgcugcagccucgugcacaagcccggggaggucgugguguccuacggcggcaugcggauccgcccgaagugcuacggguucagccggaugauggccacccuggaggucagccagcccgagcagcgccugggccagugcacggggugccaccucgagugcaucaacggcggggugcggcugaucacccugaccuccgagcucaagagcgcgaccgugugcgccucccacuucugcagcuccgccacgagcggcaagaaguccaccgagauccaguuccacagcggcucccuggucgggaagaccgccauccacgugaagggcgcccuggucgacgggaccgaguucacguucgagggcagcugcauguuccccgacggcugcgacgcgguggacugcaccuucugccgcgaguuccucaagaacccccagugcuacccggccaagaaguggcuguucaucaucaucgugauccugcucggguacgccggccugaugcugcucaccaacguccugaaggccaucgggaucuggggcuccugggugaucgcccccgugaagcugauguucgcgaucaucaagaagcucaugcggaccgucagcugccugaugcgcaagcugauggaccgggggcgccaggugauccacgaggagaucggcgagaaccgggugggcaaccaggacgacguccgcaucgagauggcccgcccccggcgcgugcggcacuggauguacucccccgugauccucacgauccuggccaucgggcuggccgagagcugcgacgagaugguccacgccgacuccaagcucgugagcugccgccagggcuccgggaacaugaaggagugcgugaccaccggccgggcgcugcugccggccgucaaccccgggcaggaggccugccuccacuucaccgcccccggcagccccgacagcaagugccugaagaucaaggugaagcgcaucaaccugaagugcaagaaguccagcuccuacuucgugccggacgcccggagccgcugcacguccguccggcgcugccggugggcgggcgacugccagagcgggugcccgccccacuucaccuccaacagcuucuccgacgacugggccggcaagauggaccgcgccgggcucggcuucagcgggugcuccgacggcugcggcggggccgcgugcggcugcuucaacgccgcccccagcugcaucuucuggcggaaguggguggagaacccccacgggaucaucuggaaggugucccccugcgccgccuggguccccagcgcggugaucgagcugaccaugccguccggcgaggugcgcaccuuccaccccaugagcgggauccccacgcaggucuucaagggcguguccgugaccuaccugggcagcgacauggaggucuccgggcucaccgaccugugcgagaucgaggagcucaagagcaagaagcuggcccuggcccccugcaaccaggccggcauggggguggugggcaaggucggcgagauccagugcagcuccgaggagagcgcccggaccaucaagaaggacgggugcaucuggaacgcggaccuggugggcaucgagcugcgcguggacgacgccgucugcuacuccaagaucacgagcguggaggccguggccaacuacuccgccaucccgaccaccaucgggggccuccgguucgagcgcagccacgacucccaggggaagaucagcggcagcccccuggacaucaccgcgauccggggcagcuucuccgucaacuaccgcgggcugcgccucagccuguccgagaucacggcgaccugcaccggcgaggugaccaacgugagcgggugcuacuccugcaugaccggcgccaaggucagcaucaagcugcacuccagcaagaacuccacggcccacgugcggugcaagggggacgagaccgccuucagcgugcucgagggcguccacagcuacaccgugucccugagcuucgaccacgccguggucgacgagcagugccagcugaacugcggcgggcacgagucccaggugacccucaagggcaaccugaucuuccuggacgugcccaaguucgucgacgggagcuacaugcagacguaccacuccaccgugcccaccggcgccaacaucccgagccccaccgacuggcucaacgcccuguucgggaacggccugucccgcuggauccucggcgugaucgggguccugcugggcgggcucgcccuguucuucaugaucaugagccuguucaagcucggcacgaagcaggucuuccggucccgcaccaagcuggcguga

SEQ ID NO: 13282 - RNA, 3222 nt, Artificial Sequence
  derived and/or modified CDS sequence (opt1) from SFTSV/Phlebovirus(JS2010-015)__JQ317173.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcaacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugauguucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacguuccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaucggcguccuccucgggggccuggcccuguucuucaugaucaugagccuguucaagcugggcacgaagcaggucuuccgcucccggaccaagcucgcguga

SEQ ID NO: 13283 - RNA, 3222 nt, Artificial Sequence
  derived and/or modified CDS sequence (opt1) from SFTSV/Phlebovirus(JS2010-019)__JQ317179.1__GP
augaugaaggugaucugguucagcucccugaccugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcacggagagcggcgagcugugcagcuccgacagcggcaccuccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagacgaagugggugcaggaguccagcuccaaggacuucgucugcuacaaggagggcaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggggaggucguggugagcuacggcggcaugcggguccgcccgaagugcuacggguucagccggaugauggccacgcuggaggugaaccagcccgagcagcgccugggccagugcaccgggugccaccucgagugcaucaacggcggggugcggcugaucacccugaccuccgagcucaagagcgcgacggucugcgccucccacuucugcagcuccgccaccagcggcaagaaguccaccgagauccaguuccacagcggcucccugguggggaagaccgccauccacgucaagggcgcccugguggacgggacggaguucaccuucgagggcagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggaucuggggcuccugggugaucgcccccgucaagcugauguucgcgaucaucaagaagcucaugcggacggugagcugccugaugcgcaagcugauggaccgggggcgccaggugauccacgaggagaucggcgagaaccgggagggcaaccaggacgacguccgcaucgagauggcccgcccccggcgcgugcggcacuggauguacucccccgugauccucaccauccuggccaucgggcuggccgagagcugcgacgagaugguccacgccgacuccaagcucgugagcugccgccagggcuccgggaacaugaaggagugcgugaccaccggccgggcgcugcugagcgccgucaacccggggcaggaggccugccuccacuucacggcccccggcagccccgacuccaagugccugaagaucaaggugaagcgcaucaaccugaagugcaagaaguccagcagcuacuucgugcccgacgcccggucccgcugcaccagcguccggcgcugccggugggcgggcgacugccaguccgggugcccgccccacuucaccagcaacuccuucagcgacgacugggccggcaagauggaccgcgccgggcucggcuucuccgggugcagcgacggcugcggcggggccgcgugcggcugcuucaacgccgcccccuccugcaucuucuggcggaaguggguggagaacccgcacgggaucaucuggaaggugagccccugcgccgccuggguccccuccgcggugaucgagcugaccaugcccagcggcgaggugcgcacguuccacccgauguccgggauccccacccaggucuucaagggcgugagcgugaccuaccugggcuccgacauggaggucagcgggcucaccgaccugugcgagaucgaggagcucaagagcaagaagcuggcccuggcccccugcaaccaggccggcauggggguggugggcaaggucggcgagauccagugcuccagcgaggaguccgcccggacgaucaagaaggacgggugcaucuggaacgcggaccuggugggcaucgagcugcgcguggacgacgccgucugcuacagcaagaucaccuccguggaggccguggccaacuacagcgccauccccaccaccaucgggggccuccgguucgagcgcucccacgacagccaggggaagaucuccggcagcccgcuggacaucacggcgauccggggcuccuucagcgucaacuaccgcgggcugcgccucucccugagcgagaucaccgcgaccugcaccggcgaggugaccaacguguccgggugcuacagcugcaugacgggcgccaaggucuccaucaagcugcacagcuccaagaacagcaccgcccacgugcggugcaagggggacgagaccgccuucagcgugcucgagggcggccacuccuacaccgucagccuguccuucgaccacgccgugguggacgagcagugccagcugaacugcgggggccacgagagccaggucacgcucaaggggaaccugaucuuccuggacgugcccaaguucguggacggcuccuacaugcagaccuaccacagcaccguccccaccggggccaacauccccuccccgacggacuggcucaacgcccuguucggcaacggccugagccgcuggauccucggggugaucggcgugcugcucgggggccuggcccuguucuucaugaucaugucccuguucaagcucggcaccaagcaggucuuccggagccgcaccaagcuggcguga

SEQ ID NO: 13284 - RNA, 3222 nt, Artificial Sequence
  derived and/or modified CDS sequence (opt1) from SFTSV/Phlebovirus(JS24)__HQ830164.1__GP
augaugaaggugaucugguucagcucccugaucugccucgugauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgggggcgagucccugccgcagcccuucgacgucgccuggauggacgugggccacagccacaagaucaucaugcgcgagcacaagacgaagugggugcaggaguccagcuccaaggacuucgucugcuacaaggaggggaccggccccugcagcgaguccgaggagaagaccugcaagaccagcggguccugccggggcgacaugcaguucugcaagguggcggggugcgagcacggcgaggaggccagcgaggccaagugccgcugcucccuggugcacaagcccggcgaggucguggugagcuacgggggcaugcggguccgcccgaagugcuacggguucucccggaugauggccacgcuggaggugaaccagcccgagcagcgcaucggccagugcaccgggugccaccucgagugcaucaacggcggcgugcggcugaucacccugaccagcgagcucaagagcgcgacggucugcgccucccacuucugcagcuccgccaccagcgggaagaaguccaccgagauccaguuccacagcggcucccugguggggaagaccgccauccacgucaagggcgcccugguggacggcacggaguucaccuucgaggggagcugcauguuccccgacggcugcgacgcgguggacugcaccuucugccgcgaguuccucaagaacccccagugcuacccggccaagaaguggcuguucaucaucaucgucauccugcucggguacgccggccugaugcugcucaccaacgugcugaaggccaucgggguguggggcuccugggucaucgcccccgugaagcugguguucgcgaucaucaagaagcucaugcgggccgucagcugccugaugggcaagcugauggaccgcgggcgccaggugauccacgaggagaucggcgagaaccgggaggggaaccaggacgacgugcggaucgagauggcccgcccccgccggguccgccacuggauguacucccccgugauccucacgauccuggccaucggccuggccgaggggugcgacgagauggugcacgcggacagcaagcucgucuccugccggcagggcagcggcaacaugaaggagugcgugaccaccgggcgcgcccugcugccggccgugaaccccggccaggaggccugccuccacuucaccgcccccgggucccccgacagcaagugccugaagaucaaggucaagaagaucaaccugaagugcaagaaguccagcagcuacuucgugccggacgcgcggucccgcugcacgagcgugcggcgcugccggugggccggcgacugccaguccgggugcccgccccacuucaccagcaacuccuucagcgacgacugggccggcaagauggaccgcgccggccucggguucuccggcugcagcgacgggugcggcggggcggccugcggcugcuucaacgccgcccccuccugcaucuucuggcggaagugggucgagaacccccacggcaucaucuggaaggugagccccugcgccgcgugggugcccuccgccgucaucgagcugaccaugccgagcggggaggugcgcaccuuccaccccauguccggcauccccacccagguguucaagggggucagcgugaccuaccugggcuccgacauggaggugagcggccucaccgaccugugcgagaucgaggagcugaaguccaagaagcuggcccucgcccccugcaaccaggccgggaugggcgucguggggaaggugggcgagauccagugcagcuccgaggagagcgcgcggaccaucaagaaggacgggugcaucuggaacgccgaccuggucggcaucgagcugcgcguggacgacgccgugugcuacagcaagaucacguccgucgaggccguggccaacuacagcgcgaucccgaccaccaucggcgggcuccgguucgagcgcucccacgacagccagggcaagaucuccgggagcccccuggacaucaccgccauccggggcuccuucagcgugaacuaccgcgggcugcggcucucccugagcgagaucacggccacgugcaccggcgaggucaccaacguguccggcugcuacagcugcaugaccggggccaagguguccaucaagcugcacagcuccaagaacagcacggcgcacguccgcugcaagggcgacgagaccgccuucuccgugcucgagggggugcacagcuacuccgucagccugagcuucgaccacgccgugguggacgagcagugccagcugaacugcggcgggcacgagucccacgucacccucaagggcaaccugaucuuccuggacgugcccaaguucguggacggcagcuacaugcagaccuaccacuccacgguccccaccggggccaacaucccgagccccaccgacuggcucaacgcccuguucggcaacgggcugucccgcuggauccucggcgugaucggcguccugcucgggggccuggcgcuguucuuccugaucaugagccucuucaagcuggggaccaagcaggucuuccggucccgcacgaagcuggccuga

SEQ ID NO: 13285 - RNA, 3222 nt, Artificial Sequence
  derived and/or modified CDS sequence (opt1) from SFTSV/Phlebovirus(JS4/China/2010 strain JS4)__HQ141605.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaacccgcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccugaagaacccccagugcuaccccgccaagaaguggcuguucaucaucaucgucauccugcugggguacgccggccucaugcugcugaccaacgugcucaaggccaucgggguguggggcuccugggucaucgcccccgugaagcugcuguucgcgaucaucaagaagcucaugcggaccgugagcugccugauggggaagcugauggaccgcggccggcaggucauccacgaggagaucggcgagaaccgcgaggggaaccaggacgacgugcggaucgagauggcccgcccccgccgggugcgccacuggauguacuccccggucauccucacgauccuggccaucggccuggccgaggggugcgacgagauggugcacgccgacagcaagcucguguccugccggcagggcagcgagaacaugaaggagugcgucaccaccgggcgcgcgcugcugcccgccgugaaccccggccaggaggccugccuccacuucaccgcccccggcuccccggacagcaagugccugaagaucaaggugaagcggaucaaccugaagugcaagaaguccagcagcuacuucguccccgacgcccgcucccggugcacgagcgugcgccggugccgcugggcgggggacugccaguccggcugcccgccccacuucaccagcaacuccuucagcgacgacugggccgggaagauggaccgggccggccucggguucuccggcugcagcgacggcugcgggggcgccgcgugcgggugcuucaacgccgcccccuccugcaucuucuggcgcaaguggguggagaacccccacggcaucaucuggaaggucagccccugcgccgccugggugccguccgcggugaucgagcugaccaugcccagcggggagguccggaccuuccaccccauguccggcauccccacccagguguucaagggcgugagcgucaccuaccugggguccgacauggaggugagcggccucaccgaccugugcgagaucgaggagcugaaguccaagaagcuggcccucgccccgugcaaccaggccgggaugggcguggucggcaaggugggggagauccagugcagcagcgaggaguccgcccgcaccaucaagaaggacggcugcaucuggaacgcggaccugguggggaucgagcugcgggucgacgacgccgugugcuacagcaagaucacguccguggaggccgucgccaacuacagcgccauccccaccaccaucggcgggcuccgcuucgagcggucccacgacagccagggcaagaucuccggcagcccccuggacaucaccgcgauccgcggguccuucagcgugaacuaccggggccugcgccucucccugagcgagaucacggccacgugcaccggggaggugaccaacgucuccggcugcuacagcugcaugaccggggccaagguguccaucaagcugcacagcuccaagaacagcacggcccacgugcgcugcaagggcgacgagaccgcguucuccguccucgagggcgugcacagcuacaccgugagccuguccuucgaccacgccgucguggacgagcagugccagcugaacugcgggggccacgagagccaggugacccucaaggggaaccugaucuuccuggacguccccaaguucguggacggcuccuacaugcagacguaccacagcaccgugccgaccggggccaacauccccucccccaccgacuggcucaacgcccuguucggcaacggccugagccgguggauccucggggucaucggcgugcugcucgggggccuggcccuguucuuccugaucaugucccucuucaagcugggcacgaagcaggucuuccgcagccggaccaagcuggcguga

SEQ ID NO: 13286 - RNA, 3222 nt, Artificial Sequence
  derived and/or modified CDS sequence (opt1) from SFTSV/Phlebovirus(JS6)__HQ830170.1__GP
augaugaaggugaucugguucagcucccugaucugccucgucauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugaacgagcccgagcagcgcaucgggcagugcaccggcugccagcucgagugcaucaacgggggcgugcggcugaucacccugaccagcgagcucaagagcgcgacggucugcgccucccacuucugcagcuccgccaccagcggcaagaaguccaccgagauccaguuccacagcgggucccuggugggcaagaccgccauccacgucaagggggcccugguggacggcacggaguucaccuucgagggcagcugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcguguggggguccugggucaucgcccccgugaagcugguguucgcgaucaucaagaagcucaugcgggccgucagcugccugaugggcaagcugauggaccgcggccgccaggugauccacgaggagaucggggagaaccgggagggcaaccaggacgacgugcggaucgagauggcccgcccccgccggguccgccacuggauguacucccccgugauccucacgauccuggccauggggcuggccgagggcugcgacgagauggugcacgcggacagcaagcucgucuccugccggcaggggagcggcaacaugaaggagugcgugaccaccggccgcgcccugcugccggccgugaaccccgggcaggaggccugccuccacuucaccgcccccggcucccccgacagcaagugccugaagaucaaggucaagcggaucaaccugaagugcaagaaguccagcagcuacuucgugccggacgcgcgcucccggugcacgagcgugcgccggugccgcugggccggggacugccaguccggcugcccgccccacuucaccagcaacuccuucagcgacgacugggccgggaagauggaccgggccggccucggcuucuccgggugcagcgacggcugcgggggcgcggccugcgggugcuucaacgccgcccccuccugcaucuucuggcgcaagugggucgagaacccccacggcaucaucuggaaggugagccccugcgccgcgugggugcccuccgccgucaucgagcugaccaugccgagcggcgaggugcggaccuuccaccccauguccgggauccccacccagguguucaagggcgucagcgugaccuaccugggguccgacauggaggugagcggccucaccgaccugugcgagaucgaggagcugaaguccaagaagcuggcccucgcccccugcaaccaggccggcaugggggucgugggcaaggugggggagauccagugcagcuccgaggagagcgcgcgcaccaucaagaaggacggcugcaucuggaacgccgaccuggucgggaucgagcugcggguggacgacgccgugugcuacagcaagaucacguccgucgaggccguggccaacuacagcgcgaucccgaccaccaucggcggccuccgcuucgagcggucccacgacagccaggggaagaucuccggcagcccccuggacaucaccgccauccgcggguccuucagcaucaacuaccggggccugcgccucucccugagcgagaucacggccacgugcaccggggaggugaccaacgucuccggcugcuacagcugcaugaccggcgccaagguguccaucaagcugcacagcuccaagaacagcacggcgcacgugcgcugcaagggggacgagaccgccuucuccguccucgagggcgugcacagcuacuccgugagccugagcuucgaccacgccgucguggacgagcagugccagcugaacugcgggggccacgagucccaggugacccuccgggggaaccugaucuuccuggacguccccaaguucguggacggcagcuacaugcagaccuaccacuccacggugcccaccggcgccaacaucccgagccccaccgacuggcucaacgcccuguucgggaacggccugucccgcuggauccucggggucaucggcgugcugcugggcgggcucgcgcuguucuuccugaucaugagccucuucaagcugggcaccaagcaggucuuccggucccgcacgaagcuggccuga

SEQ ID NO: 13287 - RNA, 3222 nt, Artificial Sequence
  derived and/or modified CDS sequence (opt1) from SFTSV/Phlebovirus(JSD1)__JF267784.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagccacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcugaaguccuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaaccagcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccucguggggaagaccgccauccacgucaagggcgcccugguggacgggaccgaguucacguucgagggcagcugcauguuccccgacggcugcaacgcgguggacugcaccuucugccgcgaguuccugaagaacccccagugcuacccggccaagaaguggcuguucaucaucaucgucauccugcugggguacgccggccucaugcugcugaccaacgugcucaaggccaucgggaucuggggcuccugggugaucgcccccgucaagcugauguucgcgaucaucaagaagcugaugcggaccgugagcugccucauggggaagcugauggaccgcggccgccaggugauccacgaggagaucggcgagaaccgggaggggaaccaggacgacguccggaucgagauggcccgcccccgccgggugcgccacuggauguacucccccgugauccugacguuccucgccaucggccuggccgagagcugcgacgagaugguccacgccgacuccaagcuggugagcugccggcagggguccggcaacaugaaggagugcgugaccaccgggcgcgcgcuccugccggccgucaaccccggccaggaggccugccugcacuucaccgcccccggcagccccgacagcaagugccucaagaucaaggugaagcggaucaaccugaagugcaagaaguccagcuccuacuucgugccggacgcccgcagccggugcacguccguccgccggugccgcugggcgggggacugccagagcggcugcccgccccacuucaccuccaacagcuucuccgacgacugggccgggaagauggaccgggccggccugggguucagcggcugcuccgacggcugcgggggcgccgcgugcgggugcuucaacgccgcccccagcugcaucuucuggcgcaaguggguggagaacccccacggcaucaucuggaaggugucccccugcgccgccuggguccccagcgcggugaucgagcucaccaugccguccggggaggugcggaccuuccaccccaugagcggcauccccacgcaggucuucaagggcguguccgugaccuaccuggggagcgacauggaggucuccggccugaccgaccucugcgagaucgaggagcucaagagcaagaagcuggcccuggcccccugcaaccaggccgggaugggcguggugggcaaggucggggagauccagugcagcuccgaggagagcgcccgcaccaucaagaaggacggcugcaucuggaacgcggaccugguggggaucgagcugcggguggacgacgccgucugcuacuccaagaucacgagcguggaggccguggccaacuacuccgccaucccgaccaccaucggcgggcugcgcuucgagcggagccacgacucccagggcaagaucagcggcagcccccucgacaucaccgcgauccgcgggagcuucuccgucaacuaccggggccugcgccugagccucuccgagaucacggcgaccugcaccggggaggugaccaacgugagcggcugcuacuccugcaugaccggggccaaggucagcaucaagcugcacuccagcaagaacuccacggcccacgugcgcugcaagggcgacgagaccgccuucagcgugcuggagggcguccacagcuacaccgugucccucagcuucgaccacgccguggucgacgagcagugccagcugaacugcgggggccacgagucccaggugacccugaaggggaaccucaucuuccuggacgugcccaaguucgucgacggcagcuacaugcagacguaccacuccaccgugcccaccggggccaacaucccgagccccaccgacuggcugaacgcccucuucggcaacggccugucccgguggauccugggggugaucggcguccuccucgggggccuggcccuguucuucaugaucaugagccuguucaagcugggcacgaagcaggucuuccgcucccggaccaagcucgcguga

SEQ ID NO: 13288 - RNA, 3222 nt, Artificial Sequence
  derived and/or modified CDS sequence (opt1) from SFTSV/Phlebovirus(LN2/China/2010 strain LN2)__HQ141608.1__GP
augaugaaggugaucugguucagcucccugaucugcuucgucauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugccgcaucgacgggaucguguucaaccagugcgagggcgagucccugccgcagcccuucgacgucgccuggauggacguggggcacagccacaagaucaucaugcgggagcacaagaccaagugggugcaggaguccagcuccaaggacuucgucugcuacaaggagggcacgggccccugcagcgaguccgaggagaagaccugcaagaccagcggguccugccgcggcgacaugcaguucugcaagguggcggggugcgagcacggcgaggaggccagcgaggccaagugccggugcucccucgugcacaagcccggggaggucguggugagcuacggcggcaugcgcguccggccgaagugcuacggguucagccgcaugauggccacccuggaggugaaccagcccgugcagcggaucggccagugcacggggugccaccuggagugcaucaacggcgggguccgccucaucacccugaccuccgagcucaagagcgcgaccgugugcgccucccacuucugcagcuccgccacgagcggcaagaaguccaccgagauccaguuccacagcggcucccucgucgggaagaccgccauccacgugaagggcgcccugguggacgggaccgaguucacguucgagggcagcugcauguuccccgacggcugcgacgcggucgacugcaccuucugccgggaguuccugaagaacccccagugcuacccggccaagaaguggcuguucaucaucaucgugauccugcugggguacgccggccucaugcugcugaccaacgugcucaaggccaucgggaucuggggcuccugggucaucgcccccgugaagcugaucuucgcgaucaucaagaagcugaugcgcaccgugagcugccucauggggaagcugauggaccggggccgccaggucauccacgaggagaucggcgagaaccgggaggggaaccaggacgacgugcgcaucgagauggcccgcccccggcgcgugcggcacuggauguacgcccccgucauccugacgauccucgccaugggccuggccgaguccugcgacgagauggugcacgcggacagcaagcugguguccugccgccaggggagcggcaacaugaaggagugcgucaccaccgggcgggcccuccugccggccgugaaccccggccaggaggccugccugcacuucaccgcccccggcucccccgacagcaagugccucaagaucaaggugaagcgcaucaaccugaagugcaagaaguccagcagcuacuucgucccggacgcgcggucccgcugcacgagcgugcggcgcugccggugggccggggacugccaguccggcugcccgccccacuucaccagcaacuccuucagcgacgacugggccgggaagauggaccgcgccggccugggguucuccggcugcagcgacggcugcgggggcgcggccugcgggugcuucaacgccgcccccuccugcaucuucuggcggaaguggguggagaacccccacggcaucaucuggaaggucagccccugcgccgcgugggugcccuccgccgugaucgagcucaccaugccgagcggggagguccgcaccuuccaccccauguccggcauccccacccagguguucaagggcgugagcgucaccuaccugggguccgacauggaggugagcggccugaccgaccucugcgagaucgaggagcugaaguccaagaagcuggcccuggcccccugcaaccaggccgggaugggcguggucggcaaggugggggagauccagugcagcagcgaggaguccgcgcggaccaucaagaaggacggcugcaucuggaacgccgaccucguggggaucgagcugcgcgucgacgacgccgugugcuacagcaagaucacguccguggaggccgucgccaacuacagcgcgaucccgaccaccaucggcgggcugcgguucgagcgcucccacgacagccagggcaagaucuccggcagcccccucgacaucaccgccauccggggguccuucagcgugaacuaccgcggccugcgccugucccucagcgagaucacggccacgugcaccggggaggugaccaacgucuccggcugcuacagcugcaugaccggggccaagguguccaucaagcugcacagcuccaagaacagcacggcgcacgugcggugcaagggcgacgagaccgccuucuccguccuggagggcgugcacagcuacaccgugagccucuccuucgaccacgccgucguggacgagcagugccagcugaacugcgggggccacgagagccaggugacccugaaggggaaccucaucuuccuggacguccccaaguucguggacggcuccuacaugcagacguaccacagcaccgugcccaccggggccaacaucccgucccccaccgacuggcugaacgcccucuucggcaacggccugagccgcuggauccugggggucaucggcgugcuccucgggggccuggcgcuguucuucaugaucaugucccuguucaagcugggcacgaagcaggucuuccggagccgcaccaagcuggccuga

SEQ ID NO: 13289 - RNA, 3222 nt, Artificial Sequence
  derived and/or modified CDS sequence (opt1) from SFTSV/Phlebovirus(LN3/China/2010 strain LN3)__HQ141611.1__GP
augaugaaggugaucugguucagcucccugaucugccucgugauccagugcggcggggacaccggccccaucaucugcgccgggccgauccacagcaacaaguccgccgacaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaagggcagcgacaugaucgucccggggcccuccuacaagggcaagguguucuucgagcggcccaccuucgacggcuacgugggguggggcugcgggagcggcaagucccgcacggagagcggcgagcucugcuccagcgacagcgggaccuccagcggccugcugcccuccgaccggguccucuggaucggggacguggccugccagccgaugacccccauccccgaggagaccuuccuggagcucaagagcuucucccagagcgaguuccccgacaucugcaagaucgacggcaucguguucaaccagugcgagggggagucccugccgcagcccuucgacgucgccuggauggacgugggccacagccacaagaucaucaugcgcgagcacaagacgaagugggugcaggaguccagcuccaaggacuucgucugcuacaaggagggcaccgggcccugcagcgaguccgaggagaagaccugcaagaccagcggcuccugccgcggggacaugcaguucugcaagguggcgggcugcgagcacggggaggaggccagcgaggccaagugccggugcucccuggugcacaagcccggcgaggucguggugagcuacggcgggaugcggguccgcccgaagugcuacggcuucucccggaugauggccacgcuggaggugaaccagcccgagcagcgcaucgggcagugcaccggcugccaccucgagugcaucaacgggggcgugcggcugaucacccugaccagcgagcucaagagcgcgacggucugcgccucccacuucugcagcuccgccaccagcggcaagaaguccaccgagauccaguuccacagcgggucccuggugggcaagaccgccauccacgucaagggggcccugguggacggcacggaguucaccuucgagggcagcugcauguuccccgacgggugcgacgcgguggacugcaccuucugccgcgaguuccucaagaacccccagugcuacccggccaagaaguggcuguucaucaucaucgucauccugcucggcuacgccgggcugaugcugcucaccaacgugcugaaggccaucggcguguggggguccugggucaucgcccccgugaagcugguguucgcgaucaucaagaagcucaugcgggccgucagcugccugaugggcaagcugauggaccgcggccgccaggugauccacgaggagaucggggagaaccgggagggcaaccaggacgacgugcggaucgagauggcccgcccccgccggguccgccacuggauguacucccccgugauccucacgauccuggccaucgggcuggccgagggcugcgacgagauggugcacgcggacagccggcucgucuccugccgccaggggagcggcaacaugaaggagugcgugaccaccggccgggcccugcugccggccgugaaccccgggcaggaggccugccuccacuucaccgcccccggcucccccgacagcaagugccugaagaucaaggucaagcgcaucaaccugaagugcaagaaguccagcagcuacuucgugccggacgcgcggucccgcugcacgagcgugcggcgcugccggugggccggggacugccaguccggcugcccgccccacuucaccagcaacuccuucagcgacgacugggccgggaagauggaccgcgccggccucggcuucuccgggugcagcgacggcugcgggggcgcggccugcgggugcuucaacgccgcccccuccugcaucuucuggcggaagugggucgagaacccccacggcaucaucuggaaggugagccccugcgccgcgugggugcccuccgccgucaucgagcugaccaugccgagcggcgaggugcgcaccuuccaccccauguccgggauccccacccagguguucaagggcgucagcgugaccuaccugggguccgacauggaggugagcggccucaccgaccugugcgagaucgaggagcugaaguccaagaagcuggcccucgcccccugcaaccaggccggcaugggggucgugggcaaggugggggagauccagugcagcuccgaggagagcgcgcggaccaucaagaaggacggcugcaucuggaacgccgaccuggucgggaucgagcugcgcguggacgacgccgugugcuacagcaagaucacguccgucgaggccguggccaacuacagcgcgaucccgaccaccaucggcggccuccgguucgagcgcucccacgacagccaggggaagaucuccggcagcccccuggacaucaccgccauccggggguccuucagcgugaacuaccgcggccugcgccucucccugagcgagaucacggccacgugcaccggggaggucaccaacguguccggcugcuacagcugcaugaccggcgccaagguguccaucaagcugcacagcuccaagaacagcacggcgcacguccggugcaagggggacgagaccgccuucuccgugcucgagggcgugcacagcuacuccgucagccugagcuucgaccacgccgugguggacgagcagugccagcugaacugcgggggccacgagucccacgucacccuccgcgggaaccugaucuuccuggacgugcccaaguucguggacggcagcuacaugcagaccuaccacuccacgguccccaccggcgccaacaucccgagccccaccgacuggcucaacgcccuguucgggaacggccugucccgguggauccucggggugaucggcguccugcugggcgggcucgcgcuguucuuccugaucaugagccucuucaagcugggcaccaagcaggucuuccgcucccggacgaagcuggccuga

SEQ ID NO: 13290 - RNA, 3222 nt, Artificial Sequence
  derived and/or modified CDS sequence (opt1) from SFTSV/Phlebovirus(SD24/China/2010 strain SD24)__HM802201.1__GP
augaugaaggugaucugguucagcucccugaucugccucgugauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacaucgccuggauggacgucgggcacagccacaagaucaucaugcgcgagcacaagaccaagugggugcaggaguccagcuccaaggacuucgugugcuacaaggagggcacgggccccugcagcgaguccgaggagaaggcgugcaagaccagcggguccugccggggcgacaugcaguucugcaaggucgccgggugcgagcacggcgaggaggccagcgaggccaagugccgcugcucccuggugcacaagcccggggagguggucgugagcuacggcggcaugcgggugcgcccgaagugcuacggguucagccggaugauggcgacccuggaggucaacccgcccgagcagcgcaucggccagugcaccgggugccaccucgagugcaucaacggcggggugcggcugaucacgcugaccuccgagcuccgcagcgccaccgugugcgccucccacuucugcagcuccgccaccagcggcaagaaguccacggagauccacuuccacagcggcucccuggucgggaagaccgccauccacgugaagggcgcgcuggucgacgggaccgaguucaccuucgagggcagcugcauguuccccgacggcugcgacgccguggacugcacguucugccgggaguuccucaagaacccccagugcuaccccgccaagaaguggcuguucaucaucaucgugauccugcucggguacgccggccugaugcugcucaccaacguccugaaggccaucgggguguggggcuccugggugaucgcgcccgucaagcugauguucgccaucaucaagaagcucaugcgcaccgugagcugccugguggggaagcugauggaccggggccgccaggucauccacgaggagaucggcgagaacggggagggcaaccaggacgacgugcggaucgagauggcccgcccccgccgggugcgccacuggauguacuccccggucauccucaccauccuggccaucgggcuggccgagggcugcgacgagauggugcacgcggacagcaagcucguguccugccggcaggggagcggcaacaugaaggagugcaucacgaccggccgcgcccugcugcccgccgucaaccccgggcaggaggccugccuccacuucaccgcccccggcuccccggacagcaagugccugaagaucaaggugaagcggaucaaccugaagugcaagaaguccagcagcuacuucgugcccgacgcgcgcucccggugcaccagcguccgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaaguggguggagaacccccacggcaucaucuggaaggugagccccugcgccgcgugggucccguccgccgugaucgagcugaccaugcccagcggcgaggugcggaccuuccaccccauguccgggauccccacccaggucuucaagggcgugagcgugacguaccugggguccgacauggaggucagcggccucaccgaccugugcgagaucgaggagcugaaguccaagaagcuggcccucgccccgugcaaccaggccggcauggggguggugggcaaggucggggagauccagugcagcagcgaggaguccgcgcgcaccaucaagaaggacggcugcaucuggaacgccgaccugguggggaucgagcugcggguggacgacgccgucugcuacagcaagaucaccuccguggaggccguggccaacuacagcgcgauccccacgaccaucggcggccuccgcuucgagcggucccacgacagccaggggaagaucuccggcagcccccuggacaucaccgccauccgcggguccuucagcgucaacuaccggggccugcgccucucccugagcgagaucaccgccacgugcaccggggaggugaccaacguguccggcugcuacagcugcaugaccggcgccaaggucuccaucaagcugcacagcuccaagaacagcaccgcgcacgugcgcugcaagggggacgagacggccuucuccgugcucgagggcguccacagcuacaucgugagccuguccuucgaccacgccguggucgacgagcagugccagcugaacugcgggggccacgagagccaggugacccucaaggggaaccugaucuuccuggacgugcccaaguucgucgacggcuccuacaugcagaccuaccacagcaccgugccgacgggcgccaacauccccucccccaccgacuggcucaacgcccuguucgggaacggccugagccgguggauccucggggugaucggcguccugcugggcgggcucgcgcuguucuuccugaucauguuccuccugaagcugggcaccaagcaggucuuccgcucccggaccaagcucgccuga

SEQ ID NO: 13291 - RNA, 3222 nt, Artificial Sequence
  derived and/or modified CDS sequence (opt1) from SFTSV/Phlebovirus(SD4/China/2010 strain SD4)__HM802203.1__GP
augaugaaggugaucugguucagcucccugaucugcuucgugauccagugcagcggcgacuccgggcccaucaucugcgccggcccgauccacagcaacaaguccgccgacaucccccaccuccugggguacagcgagaagaucugccagaucgaccgccugauccacguguccagcuggcuccggaaccacucccaguuccagggcuacguggggcagcgcggcggccggagccaggucuccuacuaccccgcggagaacagcuacucccgcuggagcgggcugcugucccccugcgacgccgacuggcucggcaugcugguggugaagaaggccaaggggagcgacaugaucgucccgggccccuccuacaaggggaagguguucuucgagcggcccaccuucgacggcuacgugggcugggggugcggcagcgggaagucccgcaccgagagcggcgagcugugcagcuccgacagcggcacguccagcgggcuccugcccuccgaccggguccuguggaucggcgacguggccugccagccgaugacccccauccccgaggagaccuuccucgagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaagaccugcaagaccagcggguccugccggggcgacaugcaguucugcaagguggcggggugcgagcacggcgaggaggccagcgaggccaagugccgcugcucccucgugcacaagcccggggaggucguggugagcuacggcggcaugcggguccgcccgaagugcuacggguucagccggaugauggccacccuggaggugaacccgcccgagcagcgcaucggccagugcacggggugccaccuggagugcaucaacggcggggugcggcucaucacccugaccuccgagcucaagagcgcgaccgucugcgccucccacuucugcagcuccgccacgagcggcaagaaguccaccgagauccaguuccacagcggcucccugguggggaagaccgccauccacgucaagggcgcccugguggacgggaccgaguucacguucgagggcagcugcauguuccccgacggcugcgacgcgguggacugcaccuucugccgcgaguuccugaagaacccccagugcuaccccgccaagaaguggcuguucaucaucaucgucauccugcugggguacgccggccucaugcugcugaccaacgugcucaaggccaucgggguguggggcuccugggucaucgcccccgugaagcugcuguucgcgaucaucaagaagcucaugcggaccgugagcugccugauggggaagcugauggaccgcggccggcaggucauccacgaggagaucggcgagaaccgcgaggggaaccaggacgacgugcggaucgagauggcccgcccccgccgggugcgccacuggauguacuccccggucauccucacgauccuggccaccggccuggccgaggggugcgacgagauggugcacgccgacagcaagcucguguccugccggcagggcagcgggaacaugaaggagugcgucaccaccggccgcgcgcugcugcccgccgugaaccccggccaggaggccugccuccacuucacggcccccggguccccggacagcaagugccugaagaucaaggugaagcggaucaaccugaagugcaagaaguccagcagcuacuucguccccgacgcccgcucccggugcaccagcgugcgccggugccgcugggcgggcgacugccaguccgggugcccgccccacuucaccagcaacuccuucagcgacgacugggccggcaagauggaccgggccgggcucggcuucuccggcugcagcgacgggugcggcggggccgcgugcggcugcuucaacgccgcccccuccugcaucuucuggcgcaaguggguggagaacccccacgggaucaucuggaaggucagccccugcgccaccugggugccguccgccgugaucgagcugacgaugcccagcggcgagguccggaccuuccaccccauguccggcauccccacccagguguucaagggggugagcgucaccuaccugggcuccgacauggaggugagcgggcucacggaccugugcgagaucgaggagcugaaguccaagaagcuggcgcucgccccgugcaaccaggccggcaugggcgugaucgggaaggucggcgagauccagugcagcagcgaggaguccgcccgcaccaucaagaaggacgggugcaucuggaacgccgaccuggugggcaucgagcugcggguggacgacgcggucugcuacagcaagaucaccuccguggaggccguggccaacuacagcgccauccccaccacgaucgggggccuccgcuucgagcggucccacgacagccagggcaagaucuccgggagcccccuggacaucaccgccauccgcggcuccuucagcgucaacuaccgggggcugcgccucucccugagcgagaucaccgcgaccugcaccggcgaggugacgaacguguccgggugcuacagcugcaugaccggcgccaaggucuccaucaagcugcacagcuccaagaacagcaccgcccacgugcgcugcaagggcgacgagaccgccuucuccgugcucgaggggguccacagcuacacggugagccuguccuucgaccacgcgguggucgacgagcagugccagcugaacugcggcgggcacgagagccaggugacccucaagggcaaccugaucuuccuggacgugcccaaguucgucgacggguccuacaugcagaccuaccacagcaccgugccgacgggcgccaacauccccucccccaccgacuggcucaacgcccuguucggcaacgggcugagccgguggauccucggcgugaucgggguccugcugggcggccucgcccuguucuuccugaucaugucccucuucaagcuggggaccaagcaggucuuccgcagccggaccaagcuggccuga

SEQ ID NO: 13292 - RNA, 3222 nt, Artificial Sequence
  derived and/or modified CDS sequence (opt1) from SFTSV/Phlebovirus(SDYY104/China/2011)__KU239112.1__GP
augaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcugaacagcuucucccagagcgaguuccccgacaucugcaagaucgacgggaucguguucaaccagugcgagggcgagucccucccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcaugcggguccgcccgaagugcuacggguucagccggaugauggcgacccuggaggugaacccgcccgagcagcgcaucggccagugcaccgggugccaccucgagugcaucaacggcggggugcggcugaucacgcugaccuccgagcuccgcagcgccaccgucugcgccucccacuucugcagcuccgccaccagcggcaagaaguccacggagauccacuuccacagcggcucccugguggggaagaccgccauccacgucaagggcgcgcugguggacgggaccgaguucaccuucgagggcagcugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcuccugggucaucgcgcccgugaagcugauguucgccaucaucaagaagcucaugcgcaccgugagcugccuggucgggaagcugauggaccggggccgccaggugauccacgaggagaucggcgagaacggggagggcaaccaggacgacgugcggaucgagauggcccgcccccgccggguccgccacuggauguacuccccggugauccucaccauccuggccaucgggcuggccgagggcugcgacgagauggugcacgcggacagcaagcucgucuccugccggcaggggagcggcaacaugaaggagugcaucacgaccggccgcgcccugcugcccgccgugaaccccgggcaggaggccugccuccacuucaccgcccccggcuccccggacagcaagugccugaagaucaaggugaagcggaucaaccugaagugcaagaaguccagcagcuacuucguccccgacgcgcgcucccggugcaccagcgugcgccggugccgcugggccggggacugccaguccggcugcccgccccacuucacgagcaacuccuucagcgacgacugggccgggaagauggaccgggccggccucggcuucuccgggugcagcgacggcugcgggggcgcggccugcgggugcuucaacgccgcccccuccugcaucuucuggcgcaaguggguggagaacccccacggcaucaucuggaaggucagccccugcgccgcgugggugccguccgccgugaucgagcugaccaugcccagcggcgagguccggaccuuccaccccauguccgggauccccacccagguguucaagggcgugagcgucacguaccugggguccgacauggaggugagcggccucaccgaccugugcgagaucgaggagcugaaguccaagaagcuggcccucgccccgugcaaccaggccggcauggggguggucggcaaggugggggagauccagugcagcagcgaggaguccgcgcgcaccaucaagaaggacggcugcaucuggaacgccgaccugguggggaucgagcugcgggucgacgacgccgugugcuacagcaagaucaccuccguggaggccgucgccaacuacagcgcgauccccacgaccaucggcggccuccgcuucgagcggucccacgacagccaggggaagaucuccggcagcccccuggacaucaccgccauccgcggguccuucagcgugaacuaccggggccugcgccucucccugagcgagaucaccgccacgugcaccggggaggugaccaacgucuccggcugcuacagcugcaugaccggcgccaagguguccaucaagcugcacagcuccaagaacagcaccgcgcacgugcgcugcaagggggacgagacggccuucuccguccucgagggcgugcacagcuacaucgugagccuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgguggauccucggggucaucggcgugcugcugggcgggcucgcgcuguucuuccugaucgucuuccuccugaagcugggcaccaagcaggccuuccgcucccggaccaagcucgccuga

SEQ ID NO: 13293 - RNA, 3417 nt, Artificial Sequence
  derived and/or modified CDS sequence (opt5) from ANDV(Chile-9717869)__AF291703.2__GP
auggagggcugguaccuggugguccucgggguuugcuauacccugacacuugccaugcccaagacgaucuacgaacugaaaauggaguguccucacaccgugggacucggccagggguauauuaucggaagcacagaacugggccuuauuuccaucgaggcugccucugacauuaagcuggaaagcuccugcaacuucgaucuccauaccacaucuauggcgcaaaagagcuuuacccagguggaguggagaaagaaauccgacacaaccgauacgaccaaugcugccucuacaaccuucgaggcccagacaaagaccgucaaccugcgggggacguguauccuggcuccggaacucuacgacacacugaagaaagugaagaaaaccguucuuugcuaugaucugacauguaaucagacccacugccaacccaccguguaccucaucgccccuguccugacauguaugagcauucgcuccugcauggcuagcguguuuacgucuagaauccagguuauuuaugagaagacccauugugugacaggacagcuuaucgaaggccagugcuucaaccccgcccacacccugacacucucccaaccugcgcauaccuacgacacggucacacugcccauuagcugcuuuuucaccccuaaaaagucugagcagcugaaggugaucaaaaccuuugagggcauucucacaaagaccgggugcacagaaaaugcccugcagggauacuaugugugcuuccuuggcucccacagcgagccgcugaucguccccucucucgaagauauccgguccgcugagguugugagccgcaugcuggugcacccuagaggggaagaccaugaugccauucagaacucccaaucucaccuucggaucgucggacccauuacggcuaaagugccuagcaccuccagcacagacacccugaagggcacagccuuugcggggguucccauguacucuucccucagcacccuggugcgcaaugccgauccggaguucgucuuuucuccuggaaucgugcccgagagcaaccauuccacgugugacaaaaagaccguuccuauuacauggaccggcuaucugcccaucucuggcgaaauggagaaagugacagggugcaccgucuucuguacgcucgcuggacccggcgccagcugcgaagccuacuccgagaaugggaucuuuaacauuagcucuccuacaugucuggugaauaagguccagagauuccggggauccgaacagaagaucaacuucauuugccaacgcguggaucaggacguuguggucuauuguaauggccagaaaaaggugauccuuaccaaaacacugguuauugggcagugcaucuacaccuuuaccagccucuucucucugaugccggacguggcccacucccuugccgucgagcugugugugcccggacuccacggcugggcuacagugaugcugcugagcacguuuugcuucggcuggguucucaucccugcggucacccugauuauccuuaagugucugagagugcucacauuuuccugcucucauuauaccaacgagagcaaauucaaguuuauucuggaaaaggugaaaaucgaguaccaaaagacaaugggguccauggucugcgaugugugucaccaugaaugcgagaccgccaaagaacuggagucucaccggcagagcuguauuaauggacagugccccuacuguaugacgaucacagaggcuaccgaauccgcccuucaggcccauuauagcauuugcaagcucaccggccgcuuccaagaggcucugaaaaagucucugaagaaaccugaaguuaagaaaggguguuacagaacacucggaguguuucgguauaagucccgcugcuacgucggccugguguggugucuucugcucaccugugagaucguuaucugggccgcgagcgcugagacaccccugauggaaucugggugguccgacacggcccacggcgugggagagauuccgaugaaaaccgaucuggaacuugacuucagccucccuucuagcuccagcuauucuuacagacggaagcugacaaaccccgccaacaaggaggaauccaucccuuuucacuuccagauggagaaacaggucauucaugcugagauccagccccugggccacuggauggaugccaccuuuaauauuaagacagcuuuccauuguuauggggccugccaaaaauacagcuacccuuggcagaccuccaagugcuucuuugaaaaagacuaucaguacgagacgggauggggcuguaaccccggggauugcccgggagugggcaccggguguacagcgugcggcguuuaucucgacaagcugaaaucugugggaaaggccuacaagaucaucagccuuaaauauaccagaaaggucuguauucagcugggcacagaacaaaccugcaaacacaucgaugcuaaugacugucucgugacaccuuccgugaaggucugcauuguugggaccgugucuaaacugcagcccagcgauacgcugcuuuuccucggaccccuggagcagggcgggaucauucugaagcaaugguguacaaccuccugcgccuuuggagacccuggcgacaucaugucuaccccgagcgggaugcgcugucccgaacacacaggcuccuuccggaagaucugcggauuugcuaccacgccugugugcgaguaccagggcaacacaauuagcggguauaaaagaaugauggccaccaaggauucuuuccaguccuuuaaucucacagagccccauaucaccacaaacaaacuggaauggauugacccugauggaaauacccgcgaccacgucaaccuugugcugaaucgggauguuagcuuccaggaccucucugauaaccccuguaagguggaccugcauacgcaagcgaucgagggcgccuggggguccggagucggcuuuacccugacaugcaccguggggcuuacagaauguccuagcuucaugaccucuauuaaggcuugcgaucucgccauguguuacggcuccacgguuacaaaucuggcuagaggaagcaacaccgugaaagucgugggcaaagggggacacuccggcagcucuuuuaaaugcugucaugacacagauugcagcuccgaggggcugcucgccucugcuccccaccuggaacgcguuaccggauucaaucagaucgacagcgauaagguguacgacgacggcgcuccgccuuguaccuuuaaaugcugguucacaaaguccggcgaguggcuucuggggauccucaacggaaauuggauugucguggugguccugguugugauccugauucuuucuaucauuauguucagcgugcuguguccccggagaggccacaaaaagacggucuga

SEQ ID NO: 13294 - RNA, 3417 nt, Artificial Sequence
  derived and/or modified CDS sequence (opt5) from ANDV(AH-1)__AF324901.2__GP
auggagggcugguaccugguggcccucggggucugcuauacccugacacuugcuaugcccaagacgaucuacgaacugaaaauggaguguccucacaccguuggacucggccagggguauauuaucggaagcacagaacugggccuuauuuccaucgaggccgcgucugacauuaagcuggaaagcuccugcaacuucgaucuccauaccacaucuauggcucaaaagagcuuuacccagguggaguggagaaagaaauccgacacaaccgauacgaccaaugccgccucuacaaccuucgaggcucagacaaagaccgugaaccugcgggggacguguauccuggccccggaacucuacgacacacugaagaaagucaagaaaaccgugcuuugcuaugaucugacauguaaucagacccacugccaacccaccguuuaccucaucgcuccugugcugacauguaugagcauucgcuccugcauggccagcgucuuuacgucuagaauccaggugauuuaugagaagacccauuguguuacaggacagcuuaucgaaggccagugcuucaaccccgcgcacacccugacacucucccaaccugcccauaccuacgacacggugacacugcccauuagcugcuuuuucaccccuaaaaagucugagcagcugaaggucaucaaaaccuuugagggcauucucacaaagaccggguguacagaaaaugcucugcagggauacuaugugugcuuccuuggcucccacagcgagccgcugaucgugcccucucucgaagauauccgguccgccgaggucguuagccgcaugcuggugcacccuauuggggaagaccaugaugcuauccagaacucccaaucuuaccuuagaauugugggacccaucacggccaaagucccuagcaccuccagcacagacacccugaagggcauugcguuugccggggugcccauguauucuuccuucagcacacucguucggaaugcugauccggaguuuguguucucuccuggaaucauccccgagagcaaccacuccgucugugacaaaaagaccgugccuauuacguggaccggcuaccugcccaucucuggcgaaauggagaaaguuacagggugcaccguguuuuguacacuggccggacccggcgcuagcugcgaagccuauuccgagaaugggauuuucaacaucagcucuccuaccugucucgucaauaaggugcagcgcuucagaggauccgaacagaagauuaacuuuaucugccaacgggucgaucaggacgugguuguguacuguaauggccagaaaaaggucauccugacgaaaacacuugugauugggcagugcaucuauaccuucacaagccuguuuucucucaugccggacguugcccauucccuggcuguggagcuuuguguccccggacugcacggcugggcgaccgugaugcuccugagcaccuucugcuuuggcugggugcugauuccugccguuacacucaucauucugaagugucuucgcguccugacguucuccugcucucacuacaccaacgagagcaaauuuaaguucauccucgaaaaggugaaaguggaguaccaaaagacaaugggguccauggucugcgaugugugucaucacgaaugcgagaccgcuaaagaacuggagucucauagacagagcuguauuaauggacagugccccuauuguaugacaaucaccgaggccacggaauccgcccugcaggcucacuacagcaucugcaaacuuacaggccgguuucaagaggcccucaaaaagucucugaagaaaccugaaguuaagaaaggguguuaucgcacccugggaguguucagauacaagucccggugcuaugucggccucguguggugucugcuucugaccugcgagauuguuaucugggcggcuagcgccgagacaccccucauggaaucugggugguccgacaccgcccauggcgugggagagauuccgaugaaaacagaucuggaacuggacuuuagccuuccuucuagcuccagcuacucuuaucgcagaaagcucacgaaccccgcuaacaaggaggaauccaucccuuuccacuuucagauggagaaacaggucauucacgccgagauccagccccugggccauuggauggaugcuaccuucaauaucaagacagccuuccacuguuacggggcgugccaaaaauacagcuauccuuggcagaccuccaagugcuuuuucgaaaaagacuaccaguaugagacaggauggggcuguaaccccggggauugcccgggagugggcaccggguguacggccugcggcguuuaccuggacaagcucaaaucugugggaaaggcuuauaagauuaucagccugaaauacacccggaaggucuguauucagcuuggcacagaacaaaccugcaaacauaucgaugccaaugacugucuggugacaccuuccgugaaggucugcauuguugggaccgugucuaaacuccagcccagcgauacacugcuguuucuuggaccccucgagcagggcgggaucauccugaagcaaugguguaccacguccugcgcuuucggagacccuggcgacauuaugucuacaccgagcgggaugagaugucccgaacacaccggcuccuuucgcaagaucugcggauucgccaccacaccugugugcgaguaucagggcaacaccgucagcggguacaaacggaugauggcgacgaaggauucuuuucaguccuucaaucugacagagccccacauuaccacaaacaaacucgaauggaucgacccugauggaaauaccagagaccaugugaaccugguucuuaaucgcgaugugagcuuucaggaccugucugauaaccccuguaaggucgaccuccacacacaagccauugagggcgcuuggggguccggagugggcuucacccugacgugcaccguugggcugacagaauguccuagcuuuaugaccucuaucaaagccugcgaucuugcuauguguuacggcuccacaguggccaaucucgcccggggaagcaacaccgucaaggugguuggcaaagggggacauuccggcagcucuuucaagugcugucacgacacggauugcagcuccgaggggcugcuggcuucugcgccccaucucgaaagagugacaggauuuaaucagaucgacagcgauaaggucuaugacgacggcgccccgccuuguaccuucaaaugcugguucacaaaguccggcgaguggcugcuugggauucugaacggaaauuggaucgugguggucguucucguggugauucugauccugucuauuaucauguuuagcguccuuuguccccgccggggccacaaaaagaccguguga

SEQ ID NO: 13295 - RNA, 3417 nt, Artificial Sequence
  derived and/or modified CDS sequence (opt5) from ANDV(CHI-7913)__AY228238.1__GP
auggagggcugguaccugguggcccucgggaucugcuauacccugacacuugcuaugcccaagacgaccuacgaacugaaaauggaguguccucacacagucggacucggccagggguauauuaucggaagcaccgaacugggccuuauuuccaucgaggccgcgucugacauuaagcuggaaagcuccugcaacuucgaucuccauacaaccucuauggcucaaaagagcuuuacacagguugaguggagaaagaaauccgacaccacggauaccacaaaugccgccucuaccacauucgaggcucagaccaagacggugaaccugcgggggacauguauccuggccccggaacucuacgacacccugaagaaagugaagaaaacaguccuuugcuaugaucugaccuguaaucagacccacugccaacccacaguguaccucaucgcuccuguucugacguguaugagcauucgcuccugcauggccagaguguuuaccagccggauccaggucauuuaugagaagacacauugugugaccggacagcuuaucgaaggccagugcuucaaccccgcgcacacacugacccucucucaaccugcccauacguacgacacaguuacccugcccauuuccugcuuuuucaccccuaaagagagcgagcagcugaaggugaucaagacauuugaaggcauucucaccaaaacagggugcacggagaaugcucugcagggauacuaugucugcuuccuuggcucucacuccgaaccgcugaucgugcccagccucgaggauauccgcucugccgaaguggucuccagaaugcugguucacccucgcggggaggaccaugaugcuauucagaacagccaaucccaccuucggaucgugggacccauuaccgccaaggugccuucuacaagcuccaccgacacacugaaaggcaccgcguuugccgggguccccauguacagcucucucuccacgcuggugaagaaugcugauccggaguucguuuuuagcccuggaaucauucccgaaucuaaccauagcgugugugacaaaaagaccgucccuaucacauggaccggcuaucugcccaucuccggcgagauggaaaaagugacagggugcaccguuuucuguacgcucgccggacccggcgcuucuugcgaggccuacagcgaaaaugggauuuuuaacaucuccagcccuacaugucuggugaauaagguccagagauuccggggaucugagcagaagauuaacuucaucugccaacgcguggaucaggacgucgugguuuauuguaauggccagaaaaaggugauucuuaccaaaacacuggucaucgggcagugcaucuacaccuuuaccucccucuucagccugaugccggacguggcccacucucuugcuguugagcugugugugcccggacuccacggcugggcgacagucaugcugcuguccacguuuugcuucggcugggugcucauuccugccgugacccugaucauucuuaagugucugagaguucucacauuuagcugcucccauuauaccaacgaaucuaaauucaaguuuauccuggagaaggucaaaguggaauaccaaaagacaauggggagcauggugugcgaugucugucaccaugagugcgaaaccgcuaaagagcuggagucccaccggcagucuuguauuaauggacagugccccuacuguaugacgaucacagaagccaccgagagcgcccuucaggcucauuauuccauuugcaagcucaccggccgcuuccaagaagcccugaaaaagagccugaagaaaccugaggugaagaaaggguguuacagaacacucggaguuuuucgguauaagucucgcugcuacgugggccuggucuggugucuucugcucaccugugagaucgugaucugggcggcuuccgccgaaacaccccugauggagagcggguggucugacacggcccacggcguuggagaaauuccgaugaaaaccgaucuggagcuugacuucucccucccuagcucuagcuccuauagcuacagacggaagcugacaaaccccgcuaacaaggaagagucuaucuccuuucacuuccagauggagaaacaggugauucaugccgaaauccagccucugggccacuggauggaugcuaccuuuaauacaaagaccgccuuccauuguuauggggcgugccaaaaauacagcuaccccuggcagacguccaagugcuucuuugagaaagacuaucaguacgaaaccggauggggcuguaacccuggggauugccccggagucggcacaggguguaccgccugcggcguguaucucgacaagcugaaaucuguuggaaaggcuuacaagauuaucagccuuaaauauacaagaaagguguguauccagcugggcaccgagcaaacaugcaaacacauugaugccaaugacugucucgucaccccguccgugaaggugugcaucgucgggacgguuucuaaacugcagccuagcgauacacugcuuuuccucggaccccuggaacagggcggggugauucugaagcaaugguguaccaccuccugcgcuuuuggagaccccggcgacaucaugucuacaccuagcgggaugcgcuguccggagcacaccggcuccuuccggaagauuugcggauuugccacgacacccgugugcgaguaccagggcaacaccaucagcggguauaaaagaaugauggcgacaaaggauucuuuccaguccuuuaaucucaccgaaccucauaucacagccaacaaacuggaguggauugaccccgauggaaauacccgcgaccacgucaaccuugugcugaaucgggauguuagcuuccaggaccucucugauaacccuuguaagguggaccugcauacgcaagcuaucgaaggcgccuggggguccggagucggcuuuacccugacaugcaccguggggcuuacagagugucccagcuucaugaccucuauuaaggcuugcgaucucgccauguguuacggcuccacgguugccaaucuggcuagaggaagcaacacagugaaagucgugggcaaagggggacacuccggcagcucuuuuaaaugcugucaugacaccgauugcagcuccgaagggcugcucgcgucugccccucaccuggagcgcguuacaggauucaaucagaucgacagcgauaagguguacgacgacggcgcucccccguguaccuuuaaaugcugguucaccaaguccggcgaguggcuucuggggauucucaacggaaauuggaucgucguggugguccugguugugauccugauucuuucuaucauuauguucagcgugcuguguccucggagaggccacaaaaagacagucuga

SEQ ID NO: 13296 - RNA, 3417 nt, Artificial Sequence
  derived and/or modified CDS sequence (opt5) from Hu39694(Hu39694)__AF028023.1__GP
auggagggcugguaccugaucgugcucggggucugcagcacccugacacuugccaugcccagaacgauuuaugaacugcggauggaguguccucacaccguuggacucggccagggguacaucauuggauccacagaacugggccuuaucccgauugagaccgugucugaccugaagcucgaaagcuccugcaacuucgaucugcauacaaccucuaugacacagaaaagcuauacccagguggaguggcgcaagaaauccgacacgaccgauacaaccaaugcugccucuacaaccuuugaggcgcagacgaagacagucaaccugagagggaccugugugcucgcuagcgaacuguacgacacacuuaaaaagaucaagaaaaccguucugugcuaugaucucaccuguaaucagacacacugccaacccacgguguaccugaucgccccugucuccaccuguaugagcauucggucuugcauggccuccguguucacaaaccgcauccagguuauuuaugagaagacccauugugugacaggacagcuugucgaaggccagugcuuuaaucccgcucacacccugacgcucagccaaccugcccauacauacgagauggugacccugcccgugaccuguuucuuuacaccuaaaaagucugaccagcugaaacucaucaagaccuucgagggcauuaucuccaagacagggugcacggaaaacgcucugcagggauacuaugucugcuuucuuggcagccacucugagccgcugcacguucccucccucgaagauauuagaagcguggagguguucucccggaugaucauccauccucgcggggaagaccacgaucccauucaaaauucucaaggauuucugagaaucgucggcccuauuaccgccaaagugcccagcacauccagcaccgacacacuuaaggggaccgcguucgccggaguuccgauguacucuucccugagcacgcucgugcggaccacagauccugaguaugucuuuucucccggcaucauuccugagagcaaccauuccaccugugacaaaaagacaaucccccugaccuggacgggcuaccugcccaucgcuggggaaauggagaaagugacaggaugcaccguuuucuguacacucgccggcccuggggcuucuugcgaagccuauagcgagcacggaauuuuuaauaucuccagcccgaccugucuggugcacaagguccagaaauuccgcggcucugaacagaagauuaacuucaucugccaaagaguggaucaggacgucgugguuuacuguaaugggcagaagaaagugauucuuaccaaggaccuggucaucggacagugcaucuauacauuuacgucccucuucagccugaugcccgauguggcgcauucucuugccguugagcugugugugccuggccuccacggcugggcuaccgucaugcugcuguccacauuuugcuucggguggauucucauccccgccauuacccugguggugcuuaaauuucugaagauggcuacauucagcuguucccauuacaccaacgagucuaaauuuaaguucauccucgaaaagguuaaagucgaguaccaaaagacgaugggaagcauggugugcgacauuugccaccaugaaugugagacagccaaagaacuggagucccacaagcagucuugcaucaauggccaguguccuuauugcaugaccaugaccgaggccacagaaagcgcucugcaggcgcacuacuccauuuguaaacuuaccgggcgguuucaagaggcccucaaaaagagccugaagcgccccgaagugaagaaaggaugcuauagaacacugggcgucuuccgguacaagucucgcuguuauguggggcucguuuggugcgugcugcuuacgugugagcugaucgucugggcugccuccgccgagaccccgcuccuggaaagcggcuggucugauacagcucauggagugggcgagguuccuaugaaaaccgaccuggaacuugauuuuucccuccccagcucuagcuccuacagcuauagacggaagcugacaaacccugccaauaaggaggaaucuauccccuuccacuuucagauggagaaacaggugauucaugcggagauccagacccuggggcacuggauggacgcuacguucaacauuaagaccgccuuccacugcuacggagccugucaaaaauacuccuauccuuggcagacagcuaagugcuuuuucgaaaaagauuaccaguaugagaccggcugggggugcaaccccggagacuguccgggcuuugggacaggcugcaccgccuguggagucuaccucgauaagcugaaaagcgugggcaaggcuuauaagaucauuucccuuaaauacacaagaaagguuugcauccagcuggggaccgaacaaacguguaaacauaucgacgccaaugauugccucgugacaccuucugucaagguguguauuaucggaaccgugagcaaacugcagcccuccgacacccugcuuuuccucggcccccuggagcagggagggauucugcucaagcaauggugcacaaccucuugugcguuuggcgacccuggggauaucaugagcacgacauccggcaugcgcugcccggaacacaccggaucuuuccggaagauuuguggcuuugccacaacccccgucugcgaguaucaggggaacacaaucagcggauacaaaagaaugauggcuaccaaggacuccuuccagagcuuuaaucugacggauccucauaucaccacaaacaaacuugaguggauugaccccgauggcaauacccgcgaccacguuaaccuggugcucaaucgggaugugucuuuccaggaccuguccgauaacccuugcaaggucgaccugcauacacaagccaucgaaggggcuuggggaagcggcgugggguuuacccuuacguguacaguuggccucaccgagugccccucuuucauuacauccaucaaagccugugauauggcgaugugcuacggaagcaccgugucuaaucuggccagaggcuccaacaccgucaaggugguugggaagggaggccacagcgggcugcacucccgcuguugccaugacacagauuguagcucugaaggacucguggcuagcgccccucaccuggagcgggucacgggcuuuaaucagauugacuccgacaaaguguaugaugacggcgcucccccgugcaccuucaaguguugguucacaaaaucuggggaauggcuucugggaauccucaacggcaauuggaucguuguggucgugcugguggucguucugauuuuuagcaucauucuuuucaacauccugugcccuagacgcgggcauaagaaaaccguguga

SEQ ID NO: 13297 - RNA, 3417 nt, Artificial Sequence
  derived and/or modified CDS sequence (opt5) from LECV(Of22819)__AF028022.1__GP
auggagggcugguaccugaucgugcucggggucugcagcacccugacacuugccaugcccaagacgauuuaugaacugaaaauggaguguccucacaccguuggacucggccaggggaucauugugggauccacagaacugggccuuaucccgauugagaccgcuucugaccugaagcucgaaagcuccugcaacuucgaucugcauacaaccucuaugacacagaaaagcuacacccaaguggaguggagaaagaaauccgacacgaccgauacaaccaaugccgcggcuacaaccuuugagucucaggccaagacggucaaccugcgggggacaugugugcucgccgcugaacuguaugacacccuuaagaaaguuaagaaaacagugcugugcuacgaucucaccuguaaucagacccacugccaacccacagucuaucugaucgccccugugaucacguguaugagcauucgcuccugcauggcuagcguuuucaucucucggauucagaucauuuacgagaagacccauugugugacaggacagcuuaucgaaggccagugcuuuaaccccgcccacacccugacacucgcgcaaccugcccauaccuaugagacggucacacugcccgugaccuguuucuuuaccccuaaaaaguccgaccagcugaagcucauuaaaacauucgagggcaucaucagcaagaccgggugcacagaaaaugcucugcagggauacuacgugugcuuucuuggcucucacuccgagccgcugcacguccccagccucaaagauauuagaucugccgaaguugugacgcgcaugaucgugcauccuagaggggaggaccacgaucccauucagaacucccaaggauaucugcggaucgucggcccucuuaccgcuaaggugcccagcacauccucuagcgacacccugcaggggacagccuucgcgggaguuccgauguacuccagccucucuacccuggugcgcaauacggauccugaauuugucuucucccccggcauuaucccugagagcaaccauucugccugugacaaaaagaccaucccccugacauggaccggcuaucuccccauuagcggggagauggaaaaagugacaggaugcaccguguuuuguacgcuggcuggcccuggggccuccugcgaggcuuacucugaaagcggaaucuucaauauuuccagcccgacaugucuuguuaacaagguccagaaguuuagaggcucugagcagaaaaucaauuucauuugccaacggguggaucaggacgucgugguuuauuguaacgggcagaagaaagugauccugaccaagacacucgucaucggacaaugcauuuacaccuucaccucccuguuuagccuuaugcccgacguggcccacucucuggccguugaacucugugugccuggccugcacggcugggcuacagucaugcugcucuccacguucugcuuuggguggauccugauucccgcgaucacccuuguggugcugaaaguucucaaggucgccacauucagcuguucccauuauaccaaugagucuaaguuuaaauucauucuggagaaggugaaaguggaauaccagaagacaaugggaagcauggucugcgauaucugccaccaugagugugaaaccgcuaaagagcuggaaucccacaagcagucuugcauuaacggccaguguccuuacugcaugacgaugacagaggccaccgagagcgcccuucaagcucauuuugccaucuguaagcucaccgggcgcuuccaggaagcgcugaaaaagucccugaaaaagcccgaggugagaaaaggaugcuaucggacacucggcguuuuucgcuacaagagcagauguuauguggggcuggucuggugcgugcuucugaccugugaacucaucguuugggcugccucugccgagacaccgcugcuggaguccggcuggagcgacacggcucacggagugggcgaagucccuaugaagaccgaucuugagcucgacuucucucugcccuccagcucuagcuacuccuaucggcgcaaacugacaaauccugccaacaaggaagagagcauucccuuucacuuccagauggaaaaacaggugauccaugcugagauucaaaaccucgggcacuggauggaugccaccuuuaauaucaagacagcguuccauugcuacggagccugucagaaauauucuuacccuuggcagaccgcuaagugcuucuuugagaaagacuaccaguaugaaacgggcugggggugcaaccccggagauuguccgggcguugggaccggcugcacagccuguggaguguaccuggacaaacuuaaguccgucggcaaggcuuauaagauuaucagccugaaauacaccagaaaggugugcauccaacucgggacagagcagaccuguaaacacauugaugccaaugacugccuggugacaccuuccgucaagguuuguaucgugggaaccgugucuaagcugcagcccagcgauacgcuucucuuccugggcccccuggaacaagggggaauuauccucaaacaguggugcacaaccuccugugcguuuggcgacccuggggacauuaugucuaccacaagcggcaugcggugcccggagcacaccggauccuucagaaagaucuguggcuuugccacgacacccgucugcgaauaucaggggaacaccaucucuggauacaaacgcaugauggcuacaaaggauagcuuccaguccuuuaaucugaccgacccucauauuacaaccaacaaacuugaguggaucgaucccgacggcaauacgcgggaucacgugaaccugguucucaauagagacgugagcuuccaagaucugucugacaacccuugcaaggucgaucugcauacccaggccauugagggggcuuggggauccggcgugggguuuacacuuaccuguacaguuggccucaccgaaugccccagcuucaugacgucuaucaaggccugugaccuggccaugugcuauggauccacagugcacaaucuggcucgcggcagcaacaccgucaaagugguugggaagggaggccauucuggguccagcuuuaaauguugccacgauacagacuguuccagcgagggacucguggcgucugccccucaccuggaacgggucaccggcuucaaucagauugauagcgacaagguguacgacgauggcgcucccccgugcaccuuuaaauguugguucacaaaguccggggaguggcuucugggaauccucaacggcaauuggaucguggucguugugcugguggucgugcugauuuucucuaucauucuuuuuagcauccugugcccuagacgcgggcauaagaaaacgguuuga

SEQ ID NO: 13298 - RNA, 3417 nt, Artificial Sequence
  derived and/or modified CDS sequence (opt5) from ORNV(Ol22996)__AF028024.1__GP
auggagggcugguaccugaucgugcucggggucugcagcaccguuacacuggccaugcccaagacgauuuaugaacuuaaaauggaguguccucacaccgugggacugggccagggguacaucauuggauccacagaacucaaccugaucccgauuggcgcugccucugaccuuaagcuggagagcuccugcgauuucgaccucuauaccacacccaugacccaaaaaucuuacacacagguggaauggagaaagaaaagcgagaccacggauaccacaaaugcggcugccaccacauuugagucccagaccaagacggucaaccugcgggggacauguauccuggccucugaacucuaugacacccugaauaagaucaaaaagccugugcuuugcuacgaucugaacuguaaucagacacgcugccaacccaccguuuaucucauugcuccugugaucaccuguaugagcauuagauccugcauggccagcgucucuaacucccggauccagauuaucuacgagaaaacacauugugugacgggacagcugguugaaggccagugcuucaaucccagccacacccuuacacuggcucaaccugcccauaccuacgagacagugacccucccggucacgugcuuuuucacacccaagaaaucugaccagcugaagcuggugaagaccuuugagggcauuaucaccaaaacaggguguaccgaaaacgcgcuccagggauauuacgugugcuuccugggcucccacagcgagccucuucauguccccucucuggaagauauccgcuccgccgagguugugagcagaaugauugugcacccucggggagaagaccacgaucccauccagaauagccaaggacaucuccgcauugucggcccgaucacagcuaaggugccuucuacgagcuccagcgacacccugcaggggacagccuuuucuggaguucccauguauuccagccuuucuacccuggugagaagcgcugauccugaguucgucuuuucccccggcauucuccccgagucuaaccacagcgugugugacaaaaagacacugccucugaccuggacgggcuaccucccgaucuccggggaaauggagaaaguuaccggaugcacaguguucuguacccuggccggccccggggcgagcugcgaagccuauucugagaauggaaucuuuaacauuuccagcccuacaugucuugucaauaaggugcagaaauuccggggcucugaacaaaagaucaacuuuauuugccagcgcauggaucaggacgucgugguuuacuguaaugggcagaagaaagugauccugaccaagacgcucgucauuggacaaugcaucuauacauucaccucccuguucagccuuaugcccgacguggcucauucccuggccguugagcucugugugccuggccugcacggcugggcuacagucaugcugcucucuaccuuuugcuucggguggauccugauucccgccaucacccuuguggugcugaaauuucucaagauggccacauucagcuguucccacuacacgaacgagucuaaauuuaagcugauucuggaaaagguuaaagucgaguaccagaagaccaugggaagcauggugugcgauaucugccaucacgaaugugagacagcuaaagugcuugaaucccauaagcagagcugcauuaacggccaguguccguauugcaugaccaugacagaggcgaccgagucugcccuccaagcucacuacuccaucuguaaacugacggggagauuccaggaagcccugaaaaagagccucaagaagccugaggucaaacggggaugcuaucgcacacugggcguguuuagauacaagucucgguguuauguugggcuuguguggugcguccugcucaccugugaacugauugugugggccgcuuccgccgagacaccccugcuugagagcggcuggucugacaccgcgcauggaguuggcgaaaucccuaugaaaaccgaucucgagcuggacuucagccugcccuccuccucuuccuacagcuaucgcagaaagcucacaaauccugcuaacaaggaagaguccauccccuuucacuuccagauggaaaaacaggugauucacgccgagauccaaacgcuggggcauuggauggaugccaccuuuaauauuaagacagcuuuccacugcuacggagccugucagaaauacucuuauccguggcagaccgcuaagugcuuuuucgagaaagacuaccaguaugaaacaggcugggggugcaacccuggagauugucccggcgucgggaccggcugcacggccuguggaguguaccuugacaagcugaaaagcguuggcaaggcguauaagaucauuucccucaaauacacccggaaggugugcauccaacuggggacagagcagaccuguaaacauaucgaugccaaugacugccuggucacacccucugugaagguguguauugucggaaccguuagcaaacuucagccuuccgauacacuccuguuccugggcccgcucgaacaagggggaaucauucugaagcagugguggaccacgucuugcgcuuuuggcgaccccggggacaucaugagcacaaccuccggcaugagauguccugagcacaccgggagcuuccgcaagauuugcggcuuugccacaacccccgugugugaauaucaggggaacacgaucucuggauacaaacggaugauggcuacaaaggauuccuuccagagcuuuaaucuuaccgacccucacaucacaaccaacaaacuggaguggauugaucccgacggcaauacaagagaucaugugaaccucguccugaaucgcgacgugucuuuccaagaucuguccgacaacccuugcaagguugaucuucacacccaggccaucgagggggcguggggaagcggcgugggguuuacgcugaccugcacagucggccucaccgaaugucccucuuucaugacauccauuaaagccugcgaccuggcuauguguuacggaagcaccgugacgaaucucgcccggggcuccaacacaguuaagguggucgggaagggaggccauagcgggucuagcuuuaaaugcugucacgauaccgacugcuccucugagggacugguggcuagcgccccgcaucuugaaagaguuacaggcuucaaucagaucgauuccgacaagguguaugacgauggcgccccucccuguaccuuucgcugcugguucaccaaaucuggggaguggcugcucggcauucugaacggaaacuggaucgucguggugguccugaucguugugcuuauuuuuagcaucgugcuguucuccauucucuguccucggagagggcacaagaaagcugucuga

SEQ ID NO: 13299 - RNA, 3426 nt, Artificial Sequence
  derived and/or modified CDS sequence (opt5) from BCCV__L39950.1__GP
augggcagacuguaccucaucgugcuggggguccuuauuaccgccacagcuggauucccccggagcguucacgagcugaagaucgaaugcccucauacgguggugcucggccagggguaugucaccggauccguggagcugggcuuuauugcccuugaccaaguuacagaucugaaaaucgaaucuagcuguuccuucgaccaccaugcggcuccgaccacaacccagaacuuuacacagcucaagugggccaaaaccgccucuacgaccgauacaaccaaugcugccgagacaaccuucgaaagcaaguccacggaggugcaccugaaaggggucugcacaauucccucuaacgugcuggacggaccuagccgccccguuaccggcagaaagacaguggucuguuacgaucucgcuugcaaucagacccauugucaaccuaccgugcaucugcuugcccccauccagacaugcauguccgugcggagcuguaugaucucucugcucgcgucccgcauucaggucguuuaugagaagacguacugcgugaccggccagcugaucgaagggcuuuguuuuaacccugugccgaaucuggcccucacacaacccggacacaccuaugacacauucacccugccuauuacgugcuuucuggucgcuaaaaagggcgccaaccucaaaaucgcuguggagcuggaaaagcucacaaccaaaaccgggugugccgagaaugcgcugcaggccuacuauauuugcuucaucggacagcacagcgagccccucacaguuccuaugcuggaagauuacagaucugcugagauuuuuacccggaucaugaugaaccccaagggcgaagaccacgauauggagcaguccagccaaggggcccuucgcaucgugggaccgauuaagggcaaagucccucccacagaaacgucugacaccgugcagggcaucgcuuucgccgggcugccuauguacuccagcuuuuccucucucguuagaaaggccgagcccgaguaucuguucagccccggaauuaucgcugaauccaaucauagcucuugcgauaaaaagacacugccucucaccuggcggggcuuucuguccaugagcggggagauugaacgcaucacaggauguaacguguucugcacccuugcgggcccgggggccucuugugaggcuuacagcgaaaauggaaucuucaacauuuccucucccacgugccuggucaauaaagugcagaaguuuagaggcagcgagcaacggaucaacuucauuucccagcgcaucgaccaggaugucauuguguauuguaauggccagaaaaagguuauccucaccaagacacuggugaucgggcaaugcauuuacaccuuuacaagcaucuucucucuuauuccuuccgucgcccacagccuggccguggagcucuguguucccggaauccacggcugggcuaccauugcccuggugaucacguuuugcuucggguggcugcucauuccuacaaccacaauggucgugcugaaaugucuuagacugcucaccuauucuugcucccauuacagcaccgaauccaaguuuaaagugauccuggagaagguuaaagucgaauaucagaagacaaugggaucuauggugugugacaucugccaccaugagugcgaaacggcgaaggagcuggagagccacaaaaaguccugugcugacggccagugccccuacuguaugaccauuacagaagccaccgagucugcccuucaggcucauuacgccgugugcaaacucacagggcgguuccacgaagcucugaagaaaagccugaagaagccggagguccaacgcggcuguuauagaacccucggaguguuucgguacaaauccagaugcuauguuggccugguguggaugugucuucugacgcucgagcugaucgucugggccgcgagcgccgauacaccucugcuugaacccggguggucugacaccgcucacggagugggcgauauuccuaugaagaccgaccucgagcuggauuucgccauccccuccucuucuuccuacagcuaucgccggagacugguuaacccugcuaacucugacgaaacagugcccuuucauuuccagcucgagcgccaggucauucacgccgaaauccagagccuggggcauuggauggaugcgaccuuuaauaucauuuccgccuuccacugcuacggagaguguaaaaaguauagcuacccguggcaaacagcuaaaugcuucuuugagaaggacuaccaguaugaaacgucuugguccuguaacccucccgauugccccggcguggggaccggcugcacagccuguggaaucuaccuugacaagcugaaaagcguuggcaaggcuuauaaagugauuacccucaaguacgcccggaaagucugcauccagcuggggacagagcagaccuguaagaauauugaugugaacgacugccuggugacguccucuaucaaagucuguaugaucggaaccauuagcaaguuccaaccuggcgacacacuucucuuucuggggccgcuggaagagggaggccucguucugaagcaguggugcaccacaaccuguuccuucggggaucccggcgacaucaugucuacaaccagcggaaugagaugcccugaacacacgggcuccuuucgcaaaauuuguggguucgccacaacccccgugugcgaguaucagggaaauaccgugucuggcuuuaagcggcuuauggcuacaaaagauagcuuccaauccuuuaacgucagcgaggugcauaucaccacgacaaagcuggaauggucugacccugauuccaauauuaaagaccacaucaaccucauccugaauagagauguuagcuuccaggaccugucugauaaccccuguaagguggaccuuuccacccaggcgauugauggggccuggggaagcggcgucggguuuacacuuaccugcaucgugggccugacagagugcagcuccuucaugaccagcauuaagguuugugacauggcuaugugcuacggagccuccguggucaaucuggugcgcggcagcaacacgguuaaaaucguggggaagggaggccauucugggagcaccuuucgguguugccacgauaaagacuguacauccaauggacuccuggccucugcuccucaucuugaaagagucaccggcuucaaccagauugacagcgauaagguguaugacgauggcgcgcccccgugcuccaucaaauguugguucgccaagucuggggaguggcugcucggcauucugaauggaaacuggguggucguugcugugcuggugaucauccuucugauuagcaucuuucucuucuccuuuuucugcccuauucgcucucacaagaaacaacuguga

SEQ ID NO: 13300 - RNA, 3408 nt, Artificial Sequence
  derived and/or modified CDS sequence (opt5) from DOBV(DOBV/Ano-Poroia/Afl9/1999)__NC_005234.1__GP
augaucauguggggccugcuccugaccaugauucuuaucgacuucggggccagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcgcucugucucaccgcaugguugaggaauccuauagaaaucggcgcagcgugaucuguuacgaccucucuugcaacuccacccauuguaagccuacaaugcacaugauuguccccgugcauagcugcaauaugaugaaaucuugucugguuggacuuggcccuuauagaauccagauuguguacgagcggaccuauugcacgaccgggauccugacagaaggaaaguguuuuguccccgaucaguccauugugaacgugaucaaaaauggcgucuucgacauugccagcguuuccaucgugugcuuuuucauccgcgugaagggcaccaacuacaagauuauggcuucuaucaaaacagccaccgcgaauaacuguaaugauacggacaacaagguccaaggguauuaccucugcauugugggaggcaauagcuccccuguuuacgccccgagcacaaccgauuuuagaucuauggaggcucuggccucccuucugcgggcuccccacggggaggaccacgaucucagcggagaagagguggccacauauucuaucgcgggccagauugaagggaaaaucccucauaccgccaacgcugccaacaugcuguucaccgcuuuuagcggaauccccuccuacucuagccuguccgucuucauuggcagccaggacggcccugugaucuauucucccgggcucuuuccgcgccugaaucaguccagcugcgacaagauugcccuuccucugaucugggagggauacauugaucuccccggcuauuacgaaacaguucacccuuguaacguguucugcguccugucugggcccggagccuccugugaggcuuuuagcgagggcgggaucuucaauaucacgucccccacaugccuugugucuaaacaaaacagauuccgggcggccgaacagcaggucaauuuugugugucagcgcguugaccaagauauugugaucuauugcaacggacagaagaaaacaauucugaccaagacacucgucaucggccaguguauuuacagcgugaccucccuguucucuaucaugccuggcguugcucauagcauugccaucgagcugugcgugccgggguuucacggaugggccacggcugcccuccugacaaccuucuguuuuggcuggauccuuauucuguccaucacccucgcgguccugguggugcuuaaguucuuugcugccauucugcacaauagcucucaagaaaacagauucaaaaucauucuccggaagaucaaagaggaauuugagaagacaaaaggguccaugguuugcgaggucuguaaguacgaaugcgagaccggaaaggaacugaaagcccauaaucugagcugcccccagucucaguguccuuauugcuucacacacugugagcccacggaauccgcuuuucaggcccauuacaaggugugccaagcuacccaccgcuucagagacgaucucaaaaagacaaucaccccucagagcacaucucccggcuguuaucggacccugaaccuuuuuagauacaaaagccgcugcuauauuuucacggugugggucacccugcucaucauugaguccaucaugugggccgcgagcgccucugagacagugcuggaaccguccuggaaugacaacgcucaugggguuggcguggucccuaugcacaccgaucuggagcuugacuucagccuccccuccucuagcaaguacacauauaagcggaaacugaccuccccucugaaucaggaacagucuguggaucuccacauugagaucgagagccaaggaaucuccacgucuguucaugcccugggccacugguuugacgggagacuuaaccugaagaccagcuuccauuguuacggagcuugcaccaaauacgaauaucccuggcacacagccaagugucacuuugagcgcgauuucgaauacgagaauaacuggggcugcaacccugcggacugucccgggauuggaaccggcugcaccgccugcgggcucuauaucgaccagcugaaaccggugggcuccgcuuacaagcugauuacaguccgguauagcagaaagguguguguucaguuuggagaagagaaucuuugcaaaacgaucgauaugaacgacuguuucgugacccgccaugucaaggugugcauuaucggcacagugucuaaauuuucccagggggauacccucgucuuccugggaccuauggagggcgggggacugaucuuuaaggacugguguacaucuaccugccaauucggcgaucccggggacauuaugagccccaaagauaagggcuuuuccuguccugacuucacgggacacuuucggaaaaagugcaauuucgccacaaccccgguuugugaauacgauggcaacauggugagcggguauaagaaagugauggcuaccaucgacucuuuccaguccuuuaauacaagcuccauucauuacaccgaugagagaaucgaauggaaggaccccgauggaaugcucaaagaccaccugaacauucuugucacaaaggacaucgauuucgagaaucugggcgaaaacccuugcaaaguggggcuccagacgagcucuauugagggagccuggggcagcgggguuggcuuuacccugacaugucagaucucccugaccgagugcucucgcuuccuuacaagcaucaaggccugcgacauggcuauuuguuacggagcgcaauccgugacccucauccggggccagaauacggucaaggugucugggaaaggaggccauagcggguccucuuuuaagugcugucacggaaccgauugcagccagcaaggccugcaggccuccgcuccccaccuggacaaaguuaacggcauuguggaacaggagagcgaaaaggucuaugaugacggggccccucaguguggaaucucuugcugguucgugaaauccggcgaguggauuacagggaucuuuaauggaaacuggaucguuauugugguccucguguucuuuuucauccugagccuuauucugcucucucugcugugucccaucagaaagcauaagcgcuccuga

SEQ ID NO: 13301 - RNA, 3408 nt, Artificial Sequence
  derived and/or modified CDS sequence (opt5) from DOBV(DOB/Saaremaa/160V)__AJ009774.2__GP
augaucauguggggccugcuccugaccaugagccuuauuaaccugggggccucccucagaaauguguacgacaugaagaucgagugcccccacucuauuaacuucggagaaagcuccgucacaggcaaaguugagcugccuccgauccuucugacggaugcugaagcccucgugcccgagucuagcuguaauauggacaaccaucagucccugucuauuacccaaaaggugacaaaagucagcuggcggaagaaagcggaucaggugcaggcugccaaggacuccuuugaaaccacaagcaaugagaucaaccugaaggggaccugcacacucacccaccgcaugguugaggaaucuuauagaaaucggaaauccgugaucuguuacgaucugagcugcaacucuacgcauuguaagccuaccaugcacaugauuguccccgugcauuccugcaauaugaugaaaagcugucuuguuggacugggcccuuaucgcgugcaggucguguacgagagaacauauugcaccacagggauccucaccgaaggaaaguguuucgugcccgaccaaucuauuaucuccgucauuaaaaacggcguuuuugauaucgccagcguguccauugugugcuucuuuauccgggucaagggcacgucuuacaagaucauggcuagcauuaaaacauccaauccuaacaauuguaacgacaccgauaauaaggugcagggguauuaccugugcaucguuggagccaacagcucuccgguguacgcucccuccacaaccgacuuccgcagcaccgaggcccuugcgucucugcucagaagcccucacggcgaggaucacgaccuguccggggaagaggucgccacauauucuauugcuggacagaucgaaggcaaaauuccccauacggccaacgcugccaauauggcguuuaccgccuucagcgggaucccuuccuacagcucucuguccguguuugcuggaaaccaggauggcacaaucauuuucagccccggccucuuuccgaagcugaaucaaucuuccugcgacaaaguugcccuuccucugaucugggagggguauauugaccuccccggauacuaugaaaccauccacccuuguaacguguucugcguccugagcggccccggggcuuccugugaggccuuuucugagggaggcauuuucaauaucacaagccccacaugccuuguguccaagcagaaccgguuccgcgccgcugaacagcagaucaauuuugucugucaaagaguggaucaggacauuguuaucuacugcaacgggcagaaaaagacgauucugacaaagacccucgugaucggacaauguauuuauucugucaccagccuguucuccaucaugccuagcguggcgcauucuauugccaucgagcugugcguuccgggcuuucacggcugggcuacagccgcccuccugaccacauucuguuuuggguggauccuuauucccuccaucacgcuggcugugcucauuguccugaaauucuuugccgcgauccuucacaauagcucucaggaaaaccgguucaagauuauccugcgcaaaaucaaggaggaauuugagaaaaccaagggauccauggugugcgagguguguaaguacgaaugcgagacaggcaaagaacucaaggcucauaaucugagcugcccucagucucagugucccuacugcuucacccacugugagcugacagaaagcgccuuucaagcccauuauagaguuugccaggcuacccaccgguuccgcgaugaccucaaaaagacgauuaccccucaguccacaagccccggguguuacagaacccugaaccuuuuucgguauaaaucuagaugcuacaucuucacagucuggguggugcugcucauuaucgaguccauucugugggccgcuagcgccuccgagcugguccuugaaccgaauuggaacgauaaugcgcauggagugggcaucguuccuaugcacaccgaccucgagcuggauuucucucugcccagcuccucuaaguauacguacaagcgcaaacucacaagcccuaucaaccaggaacaauccauugaccugcacaucgagauugagucucaggggaucagcaccuccgugcaugcccuuggccacugguuugauggacggcugaaccucaagaccagcuuccauuguuauggcgcuugcaccaaauacgaauaccccuggcacaccgccaagugucacuuugagagagacuucgaauaugagaauaacuggucuugcaauccucccgauuguccggggauuggaacaggcugcacggcuugcgggcuguaccuggaccagcuuaaaccugucggauccgccuauaagcucaucaccgugcgcuacagccggaagguuugugugcaguuuggcgaagagaaccugugcaaaacaaucgacaugaaugauuguuucgucaccagacaugugaagguuugcauuaucgggacagugucuaaauuuucccaaggcgacacccuggucuuccucggacccauggagggcgggggacugauuuuuaaggauugguguacgacaaccugccaguucggcgaccccggggauaucaugagcccuaaagacaagggauuuucuuguccggauuucaccggccacuuucgcaaaaagugcaacuucgcgacaacccccgugugugaauaugacgggaauaugguguccggcuacaagaaagucauggccacaauugauagcuuccaggcuuuuaacacguccuauauccauuacaccgacgagcagauugaauggaaggauccugacggaaugcuuaaagaucaccugaauauccucguuacaaaggacaucgacuucgagaaccugggcgaaaaucccugccggguggggcugcaaaccgccagcauugagggagcuuggggcucuggggugggauuuacacuuaccugucagaucagccucacggagugcuccagauuccugaccucuauuaaagccugcgauauggccaucuguuacggcgcucagagcgucacacuggugcgcgggcaaaacaccguuaagguguccggcaagggaggccauucugggagcuccuuuaaaugcugucacggaaaugacugcucucagcagggccuccaggcgagcgccccucaccuggauaaggucaacgggauuguggaacaagaguccacacagguuuaugacgauggagcuccccaguguggcaucagcugcugguucaucaaaucuggcgaauggauuaaggggaucuuuuccggaaauuggauugugaucgucgugcuuauuguucuguucauccucagccugauccugcuuucuuuucucuguccuauucggaaacauaagagauccuga

SEQ ID NO: 13302 - RNA, 3408 nt, Artificial Sequence
  derived and/or modified CDS sequence (opt5) from DOBV(East Slovakia/400Af/98)__AY168577.1__GP
augaucauguggggccugcuccugaccaugauucuuaucgacuucgggacaagccugagaaacguguacgauaugaagauugagugcccccacuccaucaauuuuggagaaucuagcgucacgggcaaaguugagcucccuccgcugcuucugaccgacgccgaagcccucgugcccgaguccucuuguaacauggauaaucaucagagcauguccauuauccaaaaggugacaaaagucucuuggcggaagaaagccgacaaggcgcaggcugccaaggauagcuucgaaaccacauccagcgaggugaaccugaaagggaccugcacacugucucaccgcaugguugaggaauccuauagaaaucggcgcagcgugaucuguuacgaccucucuugcaacuccacccauuguaagccuacgaugcacaugauuguccccgugcauagcugcaauaugaugaaaucuugucugguuggacuuggcccuuauagaauccagguggucuacgagcggaccuauugcacaaccgggauucugacagaaggaaaguguuuugugcccgaucaguccaucgugaacgucauuaaaaauggcguuuucgacaucgccagcguguccauugugugcuuuuucauccgcgucaagggcaccaacuacaagaucauggcuucuauuaaaacggccacagcuaauaacuguaaugauaccgacaacaaggugcaaggguauuaccucugcaucguuggaggcaauagcuccccuguguacgccccgagcacaaccgauuuuagaucuauggaggcgcuggccucccuucugcgggcuccccacggggaggaccacgaucucagcggagaagaggucgccaccuauucuauugcuggccagaucgaagggaaaauuccucauacagccaacgcggccaacaugcuguucacggcuuuuagcggaauccccuccuacucuagccuguccguguauaucggcagccaggacggcccuguuguguacucucccggacucuucccgaagcugaaucaguccagcugcgacaaagucgcccuuccucugauuugggagggguauaucgaucuccccggcuacuaugaaaccgugcacccuuguaacgucuuuugcgugcugucugggcccggagcuuccugugaggccuucagcgagggcgggauuuuuaauaucacauccccuaccugccuuguuucuaagcaaaaccgcuucagagccgcugaacaacaggugaauuucgucugucagcggguggaccaggauauuguuaucuacugcaacggacagaaaaagacaauccugaccaagacgcucgugauuggccaguguaucuacagcgucacaucccuguuuucuauuaugcccggcguggcgcauagcaucgccauugagcugugcgugccgggguuccacggaugggcuaccgccgcccuccugaccacauuuuguuucggcuggauccuuauucccuccaucacccuggcuguucucgucgugcugaaauuuuucgccgcgauccuucacaauagcucucaagaaaaccgcuuuaagauuauccugagaaaaauuaaggaggaauuugagaaaacaaagggguccauggugugcgaggucuguaaguaugaaugcgagacgggaaaagaacucaaggcucauaaucugagcugcccucagucucagugucccuacugcuucacccacugugagccuacagaauccgccuuccaggcccauuauaaagugugccaagcuacccaccgguuucgcgacgaucugaagaaaacaaucacgccccagagcaccucuccgggcuguuacagaacccucaaccuguuccgguauaagagcagaugcuacauuuuuacaguuugggugacccuucugaucaucgaguccauuaugugggccgcuagcgccucugagaauguccucgaaccuuccuggaacgacaaugcgcauggggugggcguugugcccaugcacacagaucuggagcuggacuucagccuuccuuccucuagcaaguauaccuacaaacgcaagcucacgucuccccugaaccaggaacaguccgucgaucugcacaucgagauugagagccaaggaaucuccacaucugugcaugcccucggccacugguucgacgggcggcugaaucuuaaaaccagcuuucauuguuacggagcuugcacaaaguaugaauacccuuggcacaccgccaaaugucacuucgagagagauuuugaauaugagaacuccuggggcugcaaccccgcugacuguccggggauuggaaccggcugcacagccugcgggcuguacaucgaccagcucaagccuguuggcagcgcguauaagcugaucacggugcgcuacucucggaaagucugugugcaguucggagaagagaaucugugcaagaccauugauaugaacgacuguuuugugacaagacaugucaaaguuugcaucauuggcaccguguccaaguucagccagggggauacacuuguguuucucggacccauggagggcgggggacugaucuucaaagacugguguaccucuacgugccaauuuggcgaucccggggacauuauguccccuaaggauaaaggcuucagcuguccggacuuuacaggacacuuccgcaagaagugcaauuuugccaccacccccgucugugaauaugauggcaacauggugucuggguacaaaaagguuauggcuacaaucgacuccuuccagagcuucaauaccuccagcauccauuacacagaugagcggauugaauggaaagacccugauggaaugcugaaggaccaccucaacauccuggugacgaaagacauugauuuugagaaucuuggcgaaaaccccugcaaggucgggcugcagaccucuagcaucgagggagccuggggcuccggggugggcuucacacucaccugucagauuucucugacagagugcagcagauuucugaccuccaucaaggcuugcgacauggccauuuguuauggagcccaaucuguuacgcuuauccgcggccagaauaccgugaaagucagcgggaagggaggccauuccgggucuagcuucaaaugcugucacggaacagauugcucccagcaaggccuccaggcuagcgcgccucaccuggacaaggugaacggcaucguugaacaggagucugaaaaaguguacgaugacggggcuccccaguguggaauuuccugcugguuugucaagagcggcgaguggaucaccgggauuuucaauggaaacuggaucgugauugugguccugaucuuuuucuuuauccucucucugauucuucugucccuccuguguccuauccggaagcauaaaagaagcuga

SEQ ID NO: 13303 - RNA, 3408 nt, Artificial Sequence
  derived and/or modified CDS sequence (opt5) from DOBV(East Slovakia/862Aa/97)__AY168578.1__GP
augaucauguggggccugcuccugaccaugagccuuauuaaccugggggccucccucagaaauguguacgaccugcggaucgagugcccccacucuauuaacuucggagaaagcuccgucacaggcaagguugagcuuccuccgaucccccugacggaugcugaaacccucgugccugagucuagcuguaauauggacaaccaucagucccugucuauuacacaaaaagugaccaaggucagcuggcgcaaaaaggccgauaaagugcaggcggcuaaggacuccuuugaaacaaccagcucugagaucaaucugaaggggacaugcacccucgcccacagaaugguugaggaauccuaucggaaccgcaaaagcgugaucuguuacgaucugucuugcaauuccacgcauuguaagcccaccauguauaugauugucccugugcacagcugcaacaugaugaaaucuugucuuguuggacugggccccuacagaauccagguggucuaugagcggacauacugcaccacagggauucucaucgaaggaaaguguuucgugccugaccaguccauuaucagcgugauuaaaaauggcgucuuugauaucgccuccguuucuaucgugugcuucuuuauucgcaucaagggcaacagcuauaagauuaugaccaauaucaaaacggcuaacccgaauaacuguaaugacacagauaacaaggugcaaggguacuaccugugcauugucggagccaacuccagccccguguaugcuccuucuaccacagacuucagauccauggagguucuugccagccugcuccggucuccccauggcgaggaucacgaccugagcggggaagagguggcgaccuacuccaucgccggacaggucgaaggcaaagugccucacaccgagaaugcugccaacaugcuguuuacagcuuucucugggauccccagcuauuccagccucucuguuuuugccggaaaucaggauggcacggugauuuacuccccgggccuguucccuaaacuuaaccagagcucuugcgaaaaagucgcgcugccccucaucugggagggguauauugaccugccuggauacuaugagaccauccaucccuguaauguguuuugcguccuuuccggccccggggccagcugugaggcuuucuccgaaggaggcauuuuuaacaucacaucuccuaccugccuggugagcaagcaaaaucgcuucagagccgcugaacagcagaucaacuucguuugucagcggguggaccaagauauugucaucuacugcaaugggcagaaaaagacaauucucaccaagacgcuggugaucggacaguguauuuacuccguuacaucucuguuuagcaucaugccgggcguggcccacuccauugccaucgagcucugcguccccggcuuccaugggugggcuaccgcggcccugcuuaccacauuuuguuucggauggauccugauuccuagcaucacccucgcuauucugaucgugcuuaaauuuuucgccgccauucugcacaacucuucccaagaaaaucgcuuuaaggugauccucagaaaaaucaaggaggaguucgaaaagacaaagggcagcaugguuugcgaggucuguaaguaugaaugcgagacggggaaagaacugaaggcucacaaccugucuugcccccagucccaguguccuuacugcuuuacccauugugagcucacagagagcgccuuccaggcgcacuaucgggugugccaagcuacccaucgcuuuagagacgaucugaaaaagacaauuacgccccagucuaccagcccgggauguuaccggacccuuaaucuguucagauauaaaucccgcugcuacaucuuuacagugugggucgugcuccugauuaucgaaagcauucugugggccgccucugcuuccgagaucguucuugaaccuagcuggaacgacaaugcccacggcgugggggucgugcccaugcauaccgaucucgagcuggacuucucccugccuucuagcuccaaguauacauacaagcggaaacucaccucucccaucaaccaggagcagagcguugaucugcacauugaaaucgagucccaaagaauuucuacgagcgugcacgcucuuggccauugguucgacggacgccugaaccucaagacauccuuucacuguuacggcgccugcaccaaauaugaauacccuuggcauacagcgcggugucacuucgagagagauuuugaauaugagaauagcuggucuugcaaccccgccgacuguccggggaucggaaccggcugcaccgcuugcgggcuguaccuggaucagcuuaagccugucggauccgccuauaaacucauuacagugcgcuacagccggaagguuugugugcaguucggcgaggaaaaucugugcaagaucaucgacaugaacgacuguuuugucucuagacacgugaaagugugcauuaucgggacggucuccaaguucagccagggcgauacccugguuuuucucggacccauggagggcgggggacugauuuucaaagacugguguacaaccacaugccaauuuggcgaucccggggacaucaugucuccuaaggauaaaggauucuccuguccggacuuuaccggccauuuccgcaagaaaugcaauuuugcuacgacacccgugugugaauaugaugggaacauggugagcggcuacaagaaggucauggccaccauugacuccuuccaggcguucaauaccagcuacauccacuauacagaugagcggauugaauggaaagacccugauggaaugcuuaaggaccauaucaacauccuggugaccaaagauauugacuuugagaaucucggcgagaaccccugcaagguugggcugcagacagccucuaucgaaggagcuuggggcagcggggugggauucacgcugaccugucagauuucccuuacagagugcucuagauuucucaccagcaucaaagccugcgacauggcuauuuguuacggcgcccaauccgucacacuggugcgcgggcagaauaccguuaaggugucuggcaagggaggccacagcggguccucuuucaaaugcugucauggaacggauugcagccagcaaggccugcaggccuccgcuccucaccucgacaaggucaacgggaucguggaacaggagagcacccagguuuaugaugacggagcgccccaauguggcaucucuugcugguuuauuaaauccggcgaauggaucaaggggauuuucaauggaaacuggaucgugauugucgugcugaucuuuuucuuuauccuuagccugauucuccugucuuuccuguguccuauccggaaacacaagagauccuga

SEQ ID NO: 13304 - RNA, 3408 nt, Artificial Sequence
  derived and/or modified CDS sequence (opt5) from DOBV(A35)__GU904036.1__GP
augaucauguggggccugcuccugacccuuagccugauuucccucggggccucucugagaaacguguacgaccuucggaucgagugcccccacagcauuaauuucggagaauccucugucacaggcaagguugagcugccuccgaucccccucacggaugcugaaacccuggugccugagagcuccuguaacauggacaaucaucagucucugagcauuacacaaaaagugaccaaggucuccuggcgcaaaaaggccgauaaagugcaggcggcuaaggacagcuuugaaacaaccucuuccgagaucaaccucaaggggacaugcacccuggcccacagaaugguugaggaaagcuaucggucucgcaaauccgugaucuguuacgaucuuagcugcaauucuacgcauuguaagcccaccauguauaugauugucccugugcacuccugcaacaugaugaaaagcugucugguuggacucggccccuacagaauccagguggucuaugagcggacauacugcaccacagggauucugaucgaaggaaaguguuucgugccugaccaguccauuaucucugugauuaaaaauggcgucuuugauaucgccagcguuuccaucgugugcuucuuuauucgcaucaagggcaacagcuauaagauuaugaccaauaucaaaacggcuaacccgaauaacuguaaugacacagauaacaaggugcaaggguacuaccuuugcauugucggagccaauucuucccccguguaugcuccuagcaccacagacuucagaucuauggagguucuggccagccuccugcggucuccccauggcgaggaucacgaccuguccggggaagagguggcgaccuacagcaucgccggacaggucgaaggcaaagugccucacaccgagaacgcugccaacaugcucuuuacagcuuucuccgggauccccagcuauucuucccugagcguuuuugccggaaaucaggauggcacggugauuuacucuccgggccuuuucccuaagcugaaccaguccagcugcgaaaaagucgcgcucccccugaucugggagggguauauugaccuuccuggauacuaugagaccauccaucccuguaauguguuuugcguccuguccggccccggggccucuugugaggcuuucagcgaaggaggcauuuuuaacaucacauccccuaccugccucgugucuaagcaaaaucgcuucagagccgcugaacagcagaucaacuucguuugucagcggguggaccaagauauugucaucuacugcaaugggcagaaaaagacaauucugaccaagacgcuggugaucggacaguguauuuacagcguuacaucccucuuuagcaucaugccgggcguggcccacucuauugccaucgagcugugcguccccggcuuccaugggugggcuaccgcggcccuucugaccacauuuuguuucggauggauccucauuccuuccaucacccuggcuauucuuaucgugcugaaauuuuucgccgccauucuccacaacagcucucaagaaaaucgcuuuaaggugauccugagaaaaaucaaggaggaguucgagaaaacaaagggcuccaugguuugcgaagucuguaaguaugaaugcgagacggggaaagaacugaaggcucacaaccucagcugcccccagucucaguguccuuacugcuuuacccauugugagcugacagagagcgccuuccaggcgcacuaucgggugugccaagcuacccaucgcuuuagagacgaucuuaaaaagacaauuacgccccaguccaccagcccgggauguuaccggacccugaaucucuucagauauaaaucucgcugcuacaucuuuacagugugggucgugcugcugauuaucgaauccauucuuugggccgccagcgcuuccgagaucguucucgaaccuucuuggaacgacaaugcccacggcgugggggucgugcccaugcauaccgaucuggagcuggacuucagccucccuuccucuagcaaguauacauacaagcggaaacugaccucccccaucaaccaggagcagucuguugaucuucacauugaaaucgagagccaaagaauuuccacgagcgugcacgcucugggccauugguucgacggacgccucaaucugaagacaucuuuucacuguuacggcgccugcaccaaauaugaauacccuuggcauacagcgcggugucacuucgagagagauuuugaauaugagaacuccuggagcugcaaccccgccgacuguccggggaucggaaccggcugcaccgcuugcgggcuguaccuugaucagcucaagccugucggaucugccuauaaacugauuacagugcgcuacucccggaagguuugugugcaguucggcgaggaaaaucugugcaagaucaucgacaugaacgacuguuuugucagcagacacgugaaagugugcauuaucgggacggucucuaaguucucccagggcgauacccucguuuuucugggacccauggagggcgggggacuuauuuucaaagacugguguacaaccacaugccaauuuggcgaucccggggacaucaugagcccuaaggauaaaggauucuccuguccggacuuuaccggccauuuccgcaagaaaugcaauuuugcuacgacacccgugugugaauaugaugggaacauggugagcggcuacaagaaggucauggccaccauugacucuuuccaggcguucaauaccagcuacauccacuauacagaugagcggauugaauggaaagacccugauggaaugcugaaggaccauaucaacauccucgugaccaaagauauugacuuugagaaucugggcgagaaccccugcaagguugggcugcagacagccuccaucgaaggagcuuggggcucuggggugggauucacgcuuaccugucagauuagccucacagagugcuccagauuucugaccucuaucaaagccugcgacauggcuauuuguuacggcgcccaaagcgucacacuggugcgcgggcagaauaccguuaagguguccggcaagggaggccacucugggagcuccuucaaaugcugucauggaacggauugcagccagcaaggccuccaggccucugcuccucaccuggacaaggucaacgggaucguggaacaggaguccacccagguuuaugaugacggagcgccccaauguggcaucagcugcugguuuauuaaaucuggcgaauggaucaaggggauuuucaauggaaacuggaucgugauugucgugcuuaucuuuuucuuuauccugucccucauucugcugagcuuccuuuguccuauccggaaacacaagagauccuga

SEQ ID NO: 13305 - RNA, 3408 nt, Artificial Sequence
  derived and/or modified CDS sequence (opt5) from DOBV(A6)__GU904033.1__GP
augaucauguggggccugcuccugaccaugauucuuaucgacuucggggccagccugagaaacguguacgauaugaagauugagugcccccacuccaucaauuuuggagaaucuagcgucacaggcaaaguugagcucccuccgcugcuucugacggacgccgaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcacccugucucaccgcaugguugaggaauccuauagaaaucggcgcagcgugaucuguuacgaccucucuugcaacuccacacauuguaagccuaccaugcacaugauuguccccgugcauagcugcaauaugaugaaaucuugucugguuggacuuggcccuuauagaauccagguggcuuacgagcggacguauugcaccacagggauucugaccgaaggaaaguguuuuguccccgaucaguccaucgugagcgugauuaaaaacggcgucuucgacaucgccuccguuucuauugugugcuuuuucauccgcgugaagggcacaaauuacaagaucauggcuagcauuaaaaccgccacggcgaacaauuguaacgauacagacaauaagguccaaggguauuaccucugcaucgugggaggcaacuccagcccuguuuacgccccgucuaccacagauuuuagauccauggaggcucuggccagccuucugcgggcuccccacggggaggaccacgaucucucuggagaagagguggccaccuauagcauugcgggccagaucgaagggaaaauuccucauaccgccaaugcugccaacaugcuguucacagcuuuuuccggaauccccucuuacagcucccugagcgucuucaucggcucucaggacggcccuauuaucuauucccccgggcucuuuccgaagcugaaccagagcucuugcgacaaaguggcccuuccucugauuugggagggauacaucgaucuccccggcuauuacgaaacgguucacccuuguaauguguucugcguccuguccgggcccggagccagcugugaggcuuuuuccgagggcgggauuuucaacaucaccucucccacaugccuugugagcaagcaaaaucgcuucagagcggccgaacagcaggucaacuuugugugucagcggguugaccaagauaucauuaucuauugcaauggacagaaaaagaccauucugacaaagacccucgugaucggccaguguauuuacuccgucacgucucuguucagcaucaugccuggcguggcucauuccauugccaucgagcugugcguuccgggguuucacggaugggccacagcugcccuccugaccaccuucuguuuuggcuggauccuuauucccagcaucacacuggcggugcucgucgugcugaaauucuuugcugccauucuucacaacucuucccaagaaaaucgcuucaagaucauucugagaaaaaucaaggaggaauuugagaaaaccaaggggagcauggugugcgagguuuguaaguacgaaugcgagacaggaaaagaacucaaggcccauaaccugucuugcccucagucccagugucccuauugcuucacgcacugugagccuaccgaaagcgcuuuucaggcccauuacaaagucugccaagcuacacaccgguuccgcgacgaucugaagaaaaccaucacaccccagucuaccagcccgggcuguuauagaacgcucaaucuguuucgguacaaguccagaugcuauauuuucaccgugugggugacacuucugaucauugagagcaucaugugggccgcgucugccuccgagaacguccucgaaccuagcuggaaugacaacgcucauggggugggcguugugcccaugcacaccgaucuggagcuggacuucucccuuccuucuagcuccaaguacacauauaaacgcaagcucaccucuccccugaaucaggaacagagcgucgaucugcacauugagaucgagucccaaggaaucucuacgagcgugcaugcccucggccacugguuugacgggcggcugaaccuuaaaacauccuuccauuguuacggagcuugcaccaaguacgaauauccuuggcacacagccaaaugucacuuugagagagauuucgaauacgagaauagcuggggcugcaaccccgcggacuguccggggauuggaaccggcugcaccgccugcgggcuguauaucgaccagcucaagccuguuggcucugcuuacaagcugauuacagugcgcuauucccggaaagucugugugcaguuuggagaagagaaccugugcaagacgaucgauaugaaugacuguuucguuaccagacaugugaaagucugcauuaucggcacagugagcaaguuuucucagggggauacccuuguguuccucggacccauggucggcgggggacugaucuuuaaagacugguguacauccacgugccaauucggcgaucccggggacauuaugagcccuaaggauaaaggcuuuucuuguccggacuucaccggacacuuucgcaagaagugcaacuucgccacaacccccguuugugaguacgauggcaauaugguguccggguauaaaaaggugauggcuaccaucgacagcuuccaguccuuuaacacaagcucuauucauuacaccgaugaacggaucgaguggaaagacccugauggaaugcugaaggaccaccucaauauucuggucacaaaagacaucgauuucgaaaaccuuggcgagaaucccugcaagguggggcugcagacgagcuccauugaaggagccuggggcucugggguuggcuuuacccucacaugucagaucagccugaccgagugcuccagauuccugacaucuaucaaggccugcgacauggcuauuuguuacggagcgcaaagcgugacccuuauccgcggccagaacacggucaaaguguccgggaagggaggccauucugggagcuccuuuaaaugcugucacggaaccgauugcagccagcaaggccuccaggccucugcuccucaccuggacaagguuaauggcauuguggagcaggauuccgaaaaagucuaugacgauggggcuccccaguguggaaucagcugcugguucgugaagucuggcgaguggauuacagggaucuuuaacggaaauuggaucguuauugugguccugguguucuuuuucauccucucccugauucuucugagccuccuguguccuauccggaagcauaaaagauccuga

SEQ ID NO: 13306 - RNA, 3408 nt, Artificial Sequence
  derived and/or modified CDS sequence (opt5) from DOBV(B13)__GU904034.1__GP
augaucauguggggccugcuccugaccaugauucuuaucgacuucggggccagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcacccugucucaccgcaugguugaggaauccuauagaaaucggcgcagcgugaucuguuacgaccucucuugcaacuccacacauuguaagccuaccaugcacaugauuguccccgugcauagcugcaauaugaugaaaucuugucugguuggacuuggcccuuauagaauccagguggucuacgagcggacguauugcaccacagggauucugaccgaaggaaaguguuuugugcccgaucaguccaucgugagcgucauuaaaaacggcguuuucgacaucgcuuccgugucuauugugugcuuuuucauccgcgucaagggcacaaauuacaagaucauggccagcauuaaaaccgcuacggccaacaauuguaacgauacagacaauaaggugcaaggguauuaccucugcaucguuggaggcaacuccagcccuguguacgcgccgucuaccacagauuuuagauccauggaggcccuggcuagccuucugcgggcuccccacggggaggaccacgaucucucuggagaagaggucgcuaccuauagcauugccggccagaucgaagggaaaauuccucauaccgcgaaugccgcuaacaugcuguucacagccuuuuccggaauccccucuuacagcucccugagcguguucaucggcucucaggacggcccuauuaucuauucccccgggcucuuuccgaagcugaaccagagcucuugcgacaaaguugcccuuccucugauuugggagggauacaucgaucuccccggcuauuacgaaacggugcacccuuguaaugucuucugcgugcuguccgggcccggagccagcugugaggccuuuuccgagggcgggauuuucaacaucaccucucccacaugccuugucagcaagcaaaaucgcuucagagcugcggaacaacaggugaacuuuguuugucagcggguggaccaggauaucauuaucuauugcaauggacagaaaaagaccauucugacaaagacccucgucaucggccaguguauuuacuccgugacgucucuguucagcaucaugccuggcguugcccauuccauugcuaucgagcugugcgugccgggguuucacggaugggccacagccgcucuccugaccaccuucuguuuuggcuggauccuuauucccagcaucacacuggccguccucguggugcugaaauucuuugcggcuauucuucacaacucuucccaagaaaaucgcuucaagaucauucugagaaaaaucaaggaggaauuugagaaaaccaaggggagcaugguuugcgaggucuguaaguacgaaugcgagacaggaaaagaacucaaggcccauaaccugucuugcccucagucccagugucccuauugcuucacgcacugugagccuaccgaaagcgccuuucaggcucauuacaaagugugccaagccacacaccgguuccgcgacgaucugaagaaaaccaucacaccccagucuaccagcccgggcuguuauagaacgcucaaucuguuucgguacaaguccagaugcuauauuuucaccgugugggucacacuucugaucauugagagcaucaugugggcugccucugcguccgagaacgugcucgaaccuagcuggaaugacaacgcccaugggguuggcgugguccccaugcacaccgaucuggagcuggacuucucccuuccuucuagcuccaaguacacauauaaacgcaagcucaccucuccccugaaucaggaacagagcguggaucugcacauugagaucgagucccaaggaaucucuacgagcguucaugcucucggccacugguuugacgggcggcugaaccuuaaaacauccuuccauuguuacggagccugcaccaaguacgaauauccuuggcacacagcuaaaugucacuuugagagagauuucgaauacgagaauagcuggggcugcaaccccgccgacuguccggggauuggaaccggcugcaccgcgugcgggcuguauaucgaccagcucaagccugugggcucugccuacaagcugauuacaguccgcuauucccggaaaguguguguucaguuuggagaagagaaccugugcaagacgaucgauaugaaugacuguuucgugaccagacaugucaaagugugcauuaucggcacagugagcaaguuuucucagggggauacccuugucuuccucggacccaugguuggcgggggacugaucuuuaaagacugguguacauccacgugccaauucggcgaucccggggacauuaugagcccuaaggauaaaggcuuuucuuguccggacuucaccggacacuuucgcaagaagugcaacuucgcuacaacccccgugugugaguacgauggcaauaugguguccggguauaaaaaggucauggccaccaucgacagcuuccaguccuuuaacacaagcucuauucauuacaccgaugaacggaucgaguggaaagacccugauggaaugcugaaggaccaccucaauauucuggugacaaaagacaucgauuucgaaaaccuuggcgagaaucccugcaagguugggcugcagacgagcuccauugaaggagcuuggggcucuggggugggcuuuacccucacaugucagaucagccugaccgagugcuccagauuccugacaucuaucaaggccugcgacauggccauuuguuacggagcucaaagcgucacccuuauccgcggccagaacacggugaaaguuuccgggaagggaggccauucugggagcuccuuuaaaugcugucacggaaccgauugcagccagcaaggccuccaggcgucugccccucaccuggacaaggugaauggcauugucgagcaggauuccgaaaaaguguaugacgauggggcuccccaguguggaaucagcugcugguucguuaagucuggcgaguggauuacagggaucuuuaacggaaauuggaucgugauugucgugcugguguucuuuuucauccucucccugauucuucugagccuccuguguccuauccggaagcauaaaagauccuga

SEQ ID NO: 13307 - RNA, 3408 nt, Artificial Sequence
  derived and/or modified CDS sequence (opt5) from DOBV(Aa1854/Lipetsk-02)__EU188453.1__GP
augaucauguggggccugcuccugaccauggcccuuauuaaccccggggcuacacugagaaauguguacgacaugcggaucgagugcccucacagcauuaacuucggagaauccucugucacgggcaagguugagcucccgcccaucccucuggccgaugcggaaacccuugugcccgagagcuccuguaauauggacaaccaucagucucugagcauuacacaaaaagugaccaaggucuccuggcgcaaaaaggcugauaaagugcaggccgccaaggacucuuuugaaacaaccagcuccgagaucaaucucaaggggacaugcacccugacgcacagaaugguugaggaaagcuaucggaaccgcaaaucugugaucuguuacgaucuguccugcaauagcacccauuguaagccuacaaugcacaugauuguccccgugcauucuugcaacaugaugaaauccugucucguuggacugggcccuuauagaauccagguggucuacgagcggaccuauugcacaaccgggauucuuacggaaggaaaguguuucgugccggaccagagcaucgugucugucauuaaaaauggcguuuuugauaucgcuuccgugagcauugugugcuucuuuauccgcaucaagggcaacuccuacaagauuauggccucuaucaaagaggcuaaucccaacaauuguaacgacacagauaauaagguccaaggguauuaccugugcauugugggagccaacagcuccccuguuuacgcgcccagcaccacagacuucagaucuguggaggcccucgcuucccugcuucggagcccucacggcgaagaucacgaccugucuggggaggaagucgccaccuauagcaucgcuggacagguggagggcaaaguuccccauaccgccaacgcggccaauaugcucuuuacagcuuucuccgggauuccgucucacagcuccuuuagcguguucacgggaaaccaggauggcaccgucaucuacucuccuggccuguuucccaagcugaaucaguccgccugcgacaaaguggcucucccucugaucugggaaggguauauugaccuucccggauacuaugagacaauccaucccuguaacgucuucugcgugcugagcggcccuggggccucuugugaggccuuuuccgaaggaggcauuuucaauaucaccagcccgacaugccucguuuccaagcaaaaccgcuucagagcugcggagcagcagauuaauuuugugugucagcgggucgaucaagacaucgugaucuacugcaacgggcagaaaaagaccauucugacgaagacacuuguuaucggacaguguauuuauucugugaccagccuguucuccaucaugcccggcgucgcccacucuauugcuaucgaacucugcgugccuggcuuucacgggugggccaccgccgcucugcugacaaccuucuguuuuggauggauucucauccccagcaucacacuggccauucuuaucgugcugaaauucuuugcggcuauucuccauaauuccagccaagagaaccgcuucaagaucauucugagaaaaaucaaggaagaguuugagcggacgaaaggcucuaugguuugcgaagucuguaaguacgagugcgaaaccgggaaggagcuuaaagcccacaaucuguccugcccucagagccagugucccuacugcuucacacauugugaacucaccgagucugccuuucaggcucacuaucgcgugugccaagccacacauagauuccgggaugaccugaagaaaaccaucacgccgcaguccaccagcccuggauguuacagaacacugaaccucuuucgcuauaagucucggugcuacauuuucaccgugugggucgugcugcuuaucauugagagcauccugugggcugccuccgcgagcgaaacaguucucgagcccaauuggaacgauaaugcccacggcgugggggucgugccuaugcacaccgaccuggaacuggauuucucucuucccuccagcuccaaauauacguacaagagaaagcucacaucuccuauuaaccaggagcagagcguugaccugcauaucgagguggaaucccaaggcaucucuaccagcguccacgcucugggacauugguuugauggccgccucaaccugaaaacauccuuccacuguuauggggccugcaccaaguacgaguaccccuggcacaccgcucggugucauuuugaaagagacuucgaguaugaaaauucuuggagcugcaacccggccgauuguccuggaauuggcacagggugcacggcgugcggacuuuaccuggaccagcucaaacccgugggcuccgccuauaagcugaucaccguucgcuacagccggagaguguguguccaguuuggggaggagaaucugugcaaaacaauugacaugaacgauuguuucgugacccgccacgugaaggucugcaucauuggcacaguuucuaaguuuucccagggagacacccuuguguuccucggccccauggaagggggaggccugaucuuuaaagauugguguacgacaaccugccaauucggggacccuggagauaucaugagcccgaaggacaaaggcuuuucuugucccgauuucaccgggcauuuucggaagaaaugcaauuucgcuacaaccccugugugugaguaugacggcaacauggucuccggauacaagaaagugauggccacaauugauagcuuccaggcuuuuaauacgucuaacauccacuauaccgacgaaagaauugaguggaaggaucccgacggcaugcugaaggaucaucucaauauccugguuacaaaagacauugacuucgaaaaccuuggggagaauccuugcaaggugggacugcagaccgccuccaucgagggcgccugggggagcggagucggcuuuacacucaccugucagauuucccugacggaaugcagccgcuuccugaccucuaucaaagccugcgauauggcgaucuguuacggggcccaaagcgugacacuuguucggggccagaacaccgugaaggucuccggaaaaggcgggcacucuggaagcuccuuuaagugcugucacggcacagacugcucucagcaagggcuccaggcuagcgcuccccaucuggauaaggugaauggaauuguugagcaggaauccacccagguguacgacgauggcgccccucaauguggcaucucuugcugguucauuaaaagcggggaguggaucaagggaauuuuuaacggcaauuggaucgucaucguggugcugauuuucuuuuucauccucucccugauucuucugagcuuucucugucccaucagaaaacacaagcggucuuga

SEQ ID NO: 13308 - RNA, 3402 nt, Artificial Sequence
  derived and/or modified CDS sequence (opt5) from DOBV(Ap/Sochi/hu)__JF920149.1__GP
auguggggccugcuccugaccaugauccuuauugacuucggggccacacugagaaacguguacgauaugcggaucgagugcccccacagcgucaauuuuggagaauccucuguuagcggcaagguggagcucccuccggugcugcuuuccgaagucgagacgcuggugcccgaaucuagcuguaacauggacaaucaucaguccaugucuauuauccaaaaaguuacccagcucacauggcgcaagaaagcugauaaggcccaggcggcuaaagacagcuucgagauuaccuccggggaggugagccugaagggaacaugcacccugacacacagaauggucgaagauucucaucggaaccgcaaguccaucaucuguuaugaccucagcugcaauucuacccacuguaaaccuacgaugcauaugauugugcccauccacuccugcaacaugaugaaaagcugucugguuggccuugggccuuaccggauucagguggucuaugagagaaccuacugcacaaccggaauccugacagaaggcaaguguuuugugcccgaucaaucuauugugaaugucaucaagaacggcguuuucgacauugccuccgugagcaucgugugcuuuuucguccgcgugaaagggaccaauuauaagaucauggccuccauuaagacggcuacaucuaacaauuguaacgauaccggaaauaaaguucagggcuacuaucucugcaucgucgggggaaacagcuccccuguguacgugccgagcacaaccgacuuuagaucuauggaggcccuggcuuccaugcuucgggcgccccacggcgaggaucaugaccuggccggggaagagguugccaccuacagcauugcuggacagguggaaggcaaggucccucacacagccucuacggcuaauaugcuccugaccgccuucagcggcauccccuccuauucuagccuguccguguuuacagggagccaggauggaccuauugucuacucucccggccucuucccgaaacugaaccaauccagcugcgacaagguggggcuuccucugaucugggagggauauaucgaccuccccggcuacuaugaaaccguucaucaguguaacguguuuugcguccugucugggccuggagcguccugugaggccuucagcgagggcggcauuuuuaauaucacaucccccaacugcauggugucuaaacagaaucgcuucagagcugccgaacagcaaguuaacuucgcuugucagcggguggaucaggacauucuuaucuuuugcaaugggcaaaagaaaaccauucugacgaagacacucgucaucggacaguguaucuacagcauuaccucccuguucucuaucaugcccggcguggcccacagcauugccaucgagcugugcgugccuggguuucacggaugggcuaccgcggcccuccugacaaccuucuguuuuggcuggguucuuauuccguccaucacacuggcuguccucguggugcugaaguucuuugccgccauucuucauaacagcucucaggaaaaucgcuucaaacugauccucaagaaaaucaaggaggaauuugagaaaacgaagggguccauggucugcgagguguguaaguaugaaugcgagaccggcaaagaacugaaggcucacaaccugagcugcccccagucucaauguccuuacugcuucacacauugugagcccaccgaauccgccuuucaggcgcacuacaaaguuugccaggcuacacauagauuccgggaugaccucaagaaaaccauuacgccucagagcaccucucccggauguuaucgcacacugaaucuuuuuagauacaagagccggugcuauaucuucaccgugugggucgugcugcucguuguggaguccgucaugugggccgccagcgcuucugagacagugcuggaaccguccuggaacgauaaugcccacggcguugggguggucccuaugcacaccgaccuggagcuugauuucagccuccccuccucuagcaaguacacguauaaaagaaagcugacauccccuauuaaccaagaacagucuguggaccugcauaucgagauugagagccagggaaucuccaccucugugcacgcucucggccauugguuugaugggcgccugaaucuuaaaaccagcuuccacuguuacggagccugcacaaaguaugaauaccccuggcacaccgcgcggugucauuuugagagagacuucgaauacgagaacuccuggggcugcaauccugccgauugucccgggaucggcacaggaugcacggcuugcggcauuuauaucgaccagcugaaaccggucgggagcgccuacaagcucauuaccguucgcuauucucggaaggugugugugcaauuuggagaagagaaccugugcaaaacaaucgacaugaacgauuguuucgucaccagacacgugaagguuugcauuaucggcacaguguccaaauuuagccagggggacacccuggucuuccuuggaccuauggagggcgggggccucaucuuuaaggauugguguacgucuacaugccaguucggagaccccggcgauauuaugucccccaaagacaagggguuuagcuguccugaauuuaccggacauuuucgcaaaaagugcaauuucgcuaccacaccggugugugaguacgauggcaacaugguuucuggguauaagaaagugauggccaccaucgacuccuuccaggcguuuaauacaagcuccauucacuacacggaugaacggaucgaguggaaggaccccgauggaaugcugaaagaccaucugaacauucucgucaccaaggauaucgacuucgaaaaucugggcgacaacccuugcaaaguggggcuucaaacaguuagcaucgagggcgccuggggaucuggcgugggguuuacccugacaugucaggucagccucaccgagugcuccagauuccugacgucuauuaaggcuugcgauaaggccaucuguuauggagcucagagcuccacccugauucgcggccaaaauacagugaaagugucugggaagggaggccacagcggcuccucuuuuaaaugcugucacgggaccgacugcagccagcagggacuucaggccuccgcuccccaucucgauaagaucaacggcauugucgaacaagagaaugaaaaaguuuacgacgauggggccccucaguguggaaucagcugcugguucgugaagucuggcgaguggauucaggggaucuuuaacggaaauuggaucgugauugucgugcugaucuucuuuuucauucugucccucauccugcuuagcauuuucugucccauccggaagcacaaaagaucuuga

SEQ ID NO: 13309 - RNA, 3402 nt, Artificial Sequence
  derived and/or modified CDS sequence (opt5) from DOBV(Ap1584/Sochi-01)__EU188450.1__GP
auguggggccugcuccugaccaugauccuuauugacuucggggccacacugagaaacguguacgauaugcggaucgagugcccccacagcgucaauuuuggagaauccucuguuagcggcaagguggagcucccuccggugcugcuuuccgaagucgagacgcuggugcccgaaucuagcuguaacauggacaaucaucaguccaugucuauuauccaaaaaguuacccagcucacauggcgcaagaaagcugauaaggcccaggcggcuaaagacagcuucgagauuaccuccggggaggugagccugaagggaacaugcacccugacacacagaauggucgaagauucucaucggaaccgcaaguccaucaucuguuaugaccucagcugcaauucuacccacuguaaaccuacgaugcauaugauugugcccauccacuccugcaacaugaugaaaagcugucugguuggccuugggccuuaccggauucagguggucuaugagagaaccuacugcacaaccggaauccugacagaaggcaaauguuuugugcccgaucaaucuauugugaaugucaucaagaacggcguuuucgacauugccuccgugagcaucgugugcuuuuucguccgcgugaaagggaccaauuauaagaucauggccuccauuaagacggcuacaucuaacaauuguaacgauaccggaaauaaaguucagggcuacuaucucugcaucgucgggggaaacagcuccccuguguacgugccgagcacaaccgacuuuagaucuauggaggcccuggcuuccaugcuucgggcgccccacggcgaggaucaugaccuggccggggaagagguugccaccuacagcauugcuggacagguggaaggcaaggucccucacacagccaaugcugccaacaugcuccugacggcguucucuggcgugcccagcuauuccucucugagcgucuuuaccgggucccaggauggaccuaucguguacagccccggccucuucccgaaacugaaccaaucuuccugcgacaagguugggcuuccucugauuugggagggauauaucgaccuccccggcuacuaugaaacagugcaucaguguaaugucuuuugcgugcugagcgggccuggagccucuugugaggcuuucuccgagggcggcaucuuuaacauuaccagccccaauugcaugguuuccaaacagaaccgcuucagagccgcugaacagcaagugaauuucgccugucagucugucgaucaggacauccuuauuuucugcaacgggcaaaagaaaacaauccugaccaagacgcucgugauuggacaguguaucuaccccaucacaagccuguucuccauuaugccuggcguggcccacucuaucgcuauugagcugugcguuccgggguuucacggaugggcgaccgccgcucuccugaccacauucuguuuuggcuggguccuuauccccagcauuacccuggccgugcucgugguccugaaguucuuugccgcuauccuucauaauuccagccaggaaaaccgguucaaacugauucucaagaaaaucaaggaggaauuugagaaaacaaaggggucuauggugugcgagguuuguaaguaugaaugcgagacgggcaaagaacugaaggcccacaaucuguccugcccucagagccaaugucccuacugcuucacccauugugagccuacagaaucugcguuucaggcucacuacaaagugugccaggccacccaucgcuucagagaugaccucaagaaaacaaucacgccccaguccaccagcccgggauguuaucggacccugaaccuuuuucgcuacaagucuagaugcuauauuuucacagucugggugguucugcucguggucgagagcgugaugugggccgcuuccgccagcgagaccguucuggaaccuucuuggaaugauaacgcucacggcgugggggucgugcccaugcacacagaccuggagcuugauuucucccucccuagcuccucuaaguacaccuauaaacggaagcugacgagccccaucaaucaagaacaguccguggaccugcauauugagaucgagucucagggaauuagcacauccguccacgcccucggccauugguuugaugggagacugaaccuuaaaaccucuuuccacuguuacggagcgugcacaaaguaugaauacccuuggcacaccgcccgcugucauuuugagcgggacuucgaauacgagaauagcuggggcugcaaccccgcugauuguccggggaucggcaccggaugcacagccugcggcaucuauauugaccagcugaaaccuguuggguccgcuuacaagcucaucacggugagauauagccgcaagguguguguccaauuuggagaagagaaccugugcaaaaccauugacaugaaugauuguuucgugacacggcacguuaaggugugcaucauuggcaccgucucuaaauuuucccagggggacacacugguguuccuuggacccauggagggcgggggccucaucuuuaaggauugguguaccagcacgugccaguucggagaccccggcgauaucaugucuccuaaagacaagggguuuuccuguccggaauuuacaggacauuuuagaaagaagugcaacuucgccaccacccccguuugugaguacgauggcaauauggugagcggguauaagaaagucauggcgacaauugacucuuuccaggccuuuaacaccuccagcauccacuacacagaugaacgcauugaguggaaggacccugauggaaugcugaaagaccaucugaauauccucgugacgaaggauauugacuucgaaaaccugggcgacucccccugcaaaguugggcuucaaaccgugagcaucgagggcgcuuggggaucuggcgucggguuuacacugaccugucaggugagccucacagagugcucccgguuccugaccucuaucaaggccugcgauaaggcuauuuguuauggagcccagagcuccacgcugaucagaggccaaaauaccgugaaagucucugggaagggaggccacagcggcuccucuuuuaaaugcugucacgggacagacugcagccagcagggacuucaggccuccgcuccucaucucgauaagauuaacggcaucguugaacaagagaaugaaaaaguguacgacgauggggcgccccaguguggaauuagcugcugguucgugaagucuggcgaguggauccaggggauuuuuaacggaaauuggaucgucaucgugguucugauuuucuuuuucauccugucccucauucugcuuagcaucuuuuguccuauucgcaagcacaaacggucuuga

SEQ ID NO: 13310 - RNA, 3408 nt, Artificial Sequence
  derived and/or modified CDS sequence (opt5) from DOBV(GER/05/477/Af)__GQ205411.1__GP
augaucauguggggccugcuccugacccuuagccugauuaaccucggggccucccugagaaauguguacgacaugaagaucgagugcccccacucuauuaacuucggagaaagcuccgucacaggcaaaguugagcuuccuccgcugcuccugacggaugcugaagcccuggugcccgagucuagcuguaauauggacaaccaucagucccucucuaucacccaaaaggugacaaaagucagcuggcggaagaaagcggauaaggugcaggcugccaaggacuccuuugaaaccacaagcucugagguuaauuucaaagggaccugcacacugacccaccgcaugguggaggaauccuauagaaaccgcaagagcgucauuuguuacgaucuuucuugcaauuccacgcauuguaaaccuaccaugcacaugaucgugcccguucauagcugcaacaugaugaagucuugucuggugggacucggcccuuaucggauccaggucguguacgagagaacauauugcaccacagggauucugaccgaaggaaaauguuuugugcccgaccaguccaucauuagcguccuuaagaauggcguuuucgauaucgccuccgugucuauugugugcuuuuucauccggauuaagggcacgagcuacaaaaucaugacauccaucaaggaggcuaacccuaauaacuguaaugacaccgauaacaaaguccaaggguauuaccugugcauugugggagccaauagcucuccgguuuacgcucccuccacaaccgacuuucgcagcguggaggcccucgcgucucugcugagaagcccucacggcgaagaucacgaccucgccggggaggaagucgcuaccuauuccaucgccggacagguggagggcaagguuccccauacagcuaacgccgcgaacaugcuguucacggccuuuucugggauuccuagcuacuccagcuucucuguguuuaccggaaaucaggaaggcaacgucaucuauucccccggccuuuucccgaaacugaaucagagcucuugcgagaagguggcucucccucugauuugggagggguacaucgaucuucccggauauuacgaaacaguccacccuuguaacguguuuugcguucuguccggccccggggccagcugugaggcuuucuccgaaggaggcaucuucaauauuaccucucccacaugccucgugagcaaacaaaaccgguuucgcgccgccgagcagcagaucaauuucgucugucagagaguggaccaagacauuguuaucuauugcaacgggcagaagaagaccauucugacgaaaacacuggugaucggacaguguaucuacuccgucaccucucucuuuagcauuaugccuggcguggcucauuccaucgcgauugaacugugcgugccgggcuuccacgggugggccaccgcugcccuucugacaaccuuuuguuucggauggauccucauucccagcaucacacuggccauucuuaucauccugaaguuuuucgcugcccucuuucacaauucuucccaagagaaccgguucaaaauuauccugaagaaaauuaaggaggaauuugagaagacgaaaggcagcaugguuugcgaagucuguaaguacgagugcgaaaccgggaaagagcugaaggcgcauaaucucucuugcccucagucccagugucccuauugcuucacacacugugagcugaccgaaagcgcuuuucaggcccauuaccgcgugugccaagccacacacagauuccgggaugaccuuaaaaagaccaucacgccucagucuaccagccccggauguuaucgcacacugaaccucuucagauacaagucccggugcuauauuuuuaccgugugggucauccugcugaucauugagagcauccuuugggcugccucugcuuccgaaacagugcucgagccgagcuggaaugauaacgcccauggcguugggguggucccuaugcacaccgaccuggagcuggauuucucccuccccucuagcuccaaauacacguauaagagaaaacugacaucuccuauuaaucaggaacagagcguggaccuucacaucgagauugaaucccaaggcaucucuaccagcguucaugcgcugggacacugguuugauggccgccucaaccugaagacauccuuccauuguuacggggccugcaccaaauacgaguaucccuggcacaccgcuaagugucacuuugaacgggacuucgaguacgagaacagcuggucuugcaauccugccgauugucccggaaucggcacagggugcacggcuugcggacuguaucuugaccagcucaagccggugggcuccgccuacaaacugauuaccgucagauauagccgcaagguguguguucaguuuggggaagagaaccugugcaaaacaaucgauaugaaugacuguuucgugacccggcaugucaaggugugcauuaucggcacagugucuaaauuuucccagggagacacccucgucuuccugggcccuauggaagggggaggccuuauuuuuaaggauugguguacgacaaccugccaauucggggaccccggagauaucaugagccccaaagacaagggcuuuucuuguccugauuucaccgggcacuucagaaagaaaugcaacuuugcgacaaccccgguuugugaguacgacggcaauaugguguccggauauaagaaagugauggccacaaucgauagcuuccaggcuuuuaacacguccaauauucauuacaccgacgaacgcaucgaguggaaggaucccgacggcaugcugaaagaucaccucaacauucuggucacaaaggacaucgauuucgagaaucugggggaaaacccuugcaaggugggacuucagaccgccagcauugacggcgcuugggggucuggaguuggcuuuacacucaccugucagaucagccugacggagugcucccgguuccugaccucuauuaaagccugcgacauggccaucuguuacggggcucaaagcgugacacucgucagaggccagaauaccgugcgcguuuccggaaagggcgggcauucuggaagcuccuuuaaaugcugucacggcacagauugcucucagcaagggcugcaggcgagcgcuccccaccuugacaaggugaacggaaucgucgaacaggaguccacccagguguaugaugacggcgccccucaauguggcauuagcugcugguucguuaaaucuggggaauggaucaagggaauuuuuaauggcaacuggaucgugauugucgugcugaucuuccucuuucugcugucccuuauccuccugagcuuccugugucccauucggaagcauaaaagaucuuga

SEQ ID NO: 13311 - RNA, 3408 nt, Artificial Sequence
  derived and/or modified CDS sequence (opt5) from DOBV(GER/07/607/Af)__GQ205410.1__GP
augaucauguggggccugcucgugacccugagccuuauuaaccugggggccucccucagaaaugucuacgacaugaagaucgagugcccccacucuauuaacuucggagaaagcuccguuacaggcaaaguggagcugccuccgcuuccccugacggaugcugaaacccucgugccugagucuagcuguaauauggacaaccaucagucccugucuaucacacaaaaggucaccaaagugagcuggcggaagaaagccgauaagguucaggcggcuaaggacuccuuugaaacaaccagcucugagaugaaucugaaagggacaugcacccucacgcaccgcaugguggaggaauccuauagaaaccgcaagagcgucauuuguuacgaucugucuugcaauuccacccauuguaaacccacaaugcacaugaucgugccuguucauagcugcaacaugaugaagucuugucuugugggacugggccccuaucggauccaggucguguacgagagaaccuauugcacaaccgggauucucacggaaggaaaauguuucgugccugaccaguccaucauuagcgucaugaagaauggcguuuuugauaucgccuccgugucuauugugugcuucuuuauccggauuaagggcacaagcuacaaaaucaugaccuccaucaaggaggccaacccgaauaacuguaaugacacagauaccaaaguccaaggguauuaccugugcauugugggagcuaacagcucucccguuuacgccccuuccaccacagacuuccgcagcguggaggcucuugccucucugcucagaagcccccacggcgaagaucacgaccuggcgggggaggaagucgccacguauuccaucgcuggacagguggagggcaagguuccucauaccgccaaugcugccaacaugcuguuuacagcguucucugggauucccagcuacuccagcuuuucuguguucaccggaaaccaggauggcacagucaucuauuccccgggccucuuuccuaaacugaaucagagcucuugcgacaagguggcccuuccccugauuugggaaggguacaucgaccucccuggauauuacgagaccguccaccccuguaacguguucugcguucuguccggccccggggcuagcugugaggccuuuuccgaaggaggcaucuucaauauuacgucuccuacaugccuugugagcaaacaaaaccgguuccgcgcugccgagcagcagaucaauuuugucugucagagaguggaucaagacauuguuaucuauugcaacgggcagaagaagaccauucugaccaaaacacucgugaucggacaguguaucuacuccgucaccucucuguucagcauuaugccgggcguggcccauuccaucgcuauugaacugugcgugcccggcuuucacgggugggcgacagccgcucuccugacgaccuucuguuuuggauggauccuuauuccuagcaucacacuggccauucucaucguucugaaguucuuugccgcccuucugcacaauucuucccaagagaaccgguucaaaaucauucucaagaaaaucaaggaagaguuugagaagaccaaaggcagcauggucugcgaaguguguaaguacgagugcgaaacagggaaagagcugaaggcucauaaucugucuugcccccagucccaguguccuuauugcuucacccacugugaacucacggagagcgcguuucaggcucauuaccgcgugugccaagccacccacagauuccgggaugaccugaaaaagacaauuacaccccagucuaccagcccgggauguuaucgcacccuuaaccuguuuagauacaagucccggugcuauaucuucacggucugggugauucuccugaucaucgagagcauucugugggccgcuucugccuccgaaacaguucuugagccuagcuggaaugauaacgcucauggcgugggggucgugcccaugcacgccgaccucgaacuggauuucucccugccuucuagcuccaaauacaccuauaagagaaaacucacaucucccaucaaucaggagcagagcguugaccugcacauugagaucgaaucccaaggcauuucuaccagcgugcaugcgcuuggacacugguuugauggccgccugaaccucaagaccuccuuccauuguuacggggccugcacaaaauacgaguauccuuggcacacggcuaagugucacuuugaacgggacuucgaguacgaaaauagcuggucuugcaaccccgccgauuguccgggaaucggcaccgggugcacagcuugcggacuguaucuggaccagcuuaagccugucggcuccgccuacaaacucaucaccgugagauauagccgcaagguuugugugcaguuuggggaggagaaccugugcaaaacaauugacaugaaugauuguuucgucacccggcaugugaaggugugcaucauuggcacggucucuaaauuuucccagggagacacacugguuuuccucggccccauggaagggggaggccugaucuuuaaggauugguguaccaccacaugccaauucggggaccccggagauauuaugagcccuaaagacaagggcuuuucuuguccggauuucaccgggcacuuuagaaagaaaugcaacuucgcgacaacgcccgugugugaguacgacggcaauaugguguccggauauaagaaagucauggccaccaucgauagcuuccaggcuuuuaacacauccaauauccauuacaccgacgaacgcauugaguggaaggauccugacggcaugcuuaaagaucaccugaacauccucgugacaaaggacauugacuucgaaaaucugggggagaaccccugcaagguuggacugcagaccgccagcaucgauggcgcuugggggucuggagugggcuuuacgcuuaccugucagauuagccucacagagugcucccgguuccugaccucuaucaaagccugcgacauggccauuuguuacggggcucaaagcgucacacuggugagaggccagaauaccguuaagguguccggaaaaggcgggcauucuggaagcuccuuuaagugcugucacggcacagauugcucucagcaagggcuccaggcgagcgccccucaccuggacaaagucaacggaaucguggaacaggaguccacccagguuuaugaugacggcgcuccccaauguggcaucagcugcugguucgugaagucuggggaauggauuaagggaaucuuuuccggcaauuggauugucaucguggugcuuauuuuccuguuucuccugagccugauccuucucucuuuccuguguccuauccgcaaacauaagcgguccuga

SEQ ID NO: 13312 - RNA, 3408 nt, Artificial Sequence
  derived and/or modified CDS sequence (opt5) from DOBV(GER/08/118/Aa)__GQ205412.1__GP
augaucauguggggccugcucgugauucugagccuuaucaaccugggggccucccucagaaaugucuacgacaugaagauugagugcccccacucuaucaacuucggagaaagcuccguuaccggcaaaguggagcugccuccgcuuccccugacagaugcugaaacgcucgugccugagucuagcuguaauauggacaaccaucagucccugucuauuacccaaaaggucacaaaagugagcuggcggaagaaagccgauaagguucaggcggcuaaggacuccuuugaaaccacaagcucugagaucaaucugaaagggaccugcacacucacccaccgcaugguggaggaauccuauagaaaccgcaagagcgucaucuguuacgaucugucuugcaauuccacgcauuguaaacccaccaugcacaugauugugccuguucauagcugcaacaugaugaagucuugucuugugggacugggccccuaucggauccaggucguguacgagagaacauauugcaccacagggauucucaccgaaggaaaauguuucgugccugaccaguccaucauuagcgucaugaagaauggcguuuuugauaucgccuccgugucuauugugugcuucuuuauccggaucaagggcacgagcuacaaaauuaugacauccaucaaggaggccaacccgaauaacuguaaugacaccgauaacaaaguccaaggguauuaccugugcauugugggagcuaauagcucucccguuuacgccccuuccacaaccgacuuccgcagcguggaggcucuugccucucugcucagaagcccccacggcgaagaucacgaccuggcgggggaggaagucgccaccuauuccaucgcuggacagguggauggcaagguuccucauacagccaacgcugccaacaugcuguuuacggcguucucugggauucccagcuacuccagcuuuucuguguucaccggaaaucaggacggcacagucaucuauuccccgggccucuuuccuaaacugaaccagagcucuugcgacaagguggcccuuccccugaucugggagggguacauugaucucccuggauauuacgaaaccguccaccccuguaauguguucugcguucuguccggccccggggcuagcugugaggccuuuuccgagggaggcaucuucaacauuacaucuccuaccugccuugugagcaaacaaaaucgguuccgcgcugccgaacagcagaucaacuuugucugucagagaguggaccaagauauuguuaucuauugcaaugggcagaagaagacgauccugacaaaaacccucgugauuggacaguguaucuacuccgucaccucucuguucagcauuaugccgggcguggcccauuccaucgcuauugagcugugcgugcccggcuuucacgggugggcgacagccgcucuccugaccacauucuguuuuggauggauccuuauuccuagcaucacgcuggccauccucauuguucugaaguucuuugccgcccuucugcacaacucuucccaagaaaaucgguucaaaaucauucucaagaaaaucaaggaggaauuugagaagaccaaaggcagcauggucugcgagguguguaaguacgaaugcgagacagggaaagaacugaaggcccauaaccugucuugcccccagucccaguguccuuauugcuucacccacugugagcucacagaaagcgcguuucaggcucauuaccgcgugugccaagccacccacagauuccgggacgaucugaaaaagacgauuacaccccagucuaccagcccgggauguuaucgcacccuuaaucuguuuagauacaagucccggugcuauaucuucacagucugggugauccuccugauuaucgagagcauucugugggccgcuucugccuccgagaccauccuugaaccuagcuggaacgacaaugcucauggcguuggggugguccccaugcacacggaucucgagcuggacuucucccugccuucuagcuccaaauacacauauaagagaaaacucaccucucccauuaaccaggaacagagcguggaucugcacaucgagaucgagucccaaggcauuucuacaagcguucaugcccuuggacacugguuugacggccgccugaaucucaagaccuccuuccauuguuacggggcgugcaccaaauacgaauauccuuggcacacagccaagugucacuuugagcgggauuucgaauacgagaacagcuggucuugcaaccccgcugacuguccgggaaucggcacggggugcaccgccugcggacuguaucuggaccagcuuaagccugugggcuccgcuuacaaacucauuacagucagauauagccgcaagguguguguucaguuuggggaagagaaucugugcaaaaccaucgauaugaacgacuguuucgugacacggcaugucaaggugugcauuaucggcaccgugucuaaauuuucccagggagauacgcuggucuuccucggccccauggaagggggaggccugaucuuuaaggacugguguacaacaaccugccaauucggggaucccggagacauuaugagcccuaaagauaagggcuuuucuuguccggacuucaccgggcacuuuagaaagaaaugcaauuucgccaccacacccguuugugaguacgauggcaacaugguguccggauauaagaaagugauggcgacgaucgacagcuuccaggccuuuaauaccuccaacauucauuacacagaugagcgcaucgaaugggaggacccugauggcaugcuuaaggaccaccugaauauucucgucaccaaagacaucgauuucgaaaaccugggggagaaucccugcaaggugggacugcagacagcuagcauugacggcgccugggggucuggaguuggcuuuacccuuacgugucagaucagccucaccgagugcucccgguuccugacaucuaucaaggcuugcgauauggccauuuguuacggggcccaaagcgugacccuggucagaggccagaacacagugaaaguuuccggaaagggcgggcauucuggaagcuccuuuaaaugcugucacggcaccgacugcucucagcaagggcuccaggcuagcgcgccucaccuggauaaggugaauggaaucgucgaacaggaguccacacagguguaugacgauggcgcuccccaauguggcauuagcugcugguucguuaaaucuggggaauggaucaagggaguguuuuccggcaacuggauugucaucguggugcuuaucuuccuguuucuccugagccugauucuucucucuuuccuguguccuauccgcaagcauaaacgguccuga

SEQ ID NO: 13313 - RNA, 3408 nt, Artificial Sequence
  derived and/or modified CDS sequence (opt5) from DOBV(GER/08/131/Af)__GQ205413.1__GP
augaucauguggggccugcuccugacccuuagccugauuaaccucggggccucccugagaaauguguacgacaugaagaucgagugcccccacucuauuaacuucggagaaagcuccgucacaggcaaaguugagcuuccuccgcugcuccugacggaugcugaaacccuggugcccgagucuagcuguaauauggacaaccaucagucccucucuaucacacaaaaggugaccaaagucagcuggcggaagaaagccgauaaggugcaggcggcuaaggacuccuuugaaacaaccagcucugagguuaaucugaaagggacaugcacccuuacgcaccgcaugguggaggaauccuauagaagccggaagucugucauuuguuacgaucuguccugcaacagcacccauuguaaaccuacaaugcacaugaucgugcccguucauucuugcaauaugaugaaguccugucucgugggacugggcccuuaucgcauccaggucguguacgagagaaccuauugcacaaccgggauucuuacggaaggaaaauguuucgugcccgaccagagcaucauuuccgucaucaagaacggcguuuuugauauugccucugugagcaucgugugcuucuuuauucggaucaagggcacauccuacaaaaucaugaccagcauuaaggagucuaauccuaacaauuguaacgacacagauaauaaaguccaaggguauuaccugugcaucgugggagccaacuccagcccgguuuacgcucccucuaccaccgacuuccgcagcguggaggcccucgcuucccugcugagaucuccuuauggcgaagaucacgaccucgccggggaggaagucgcgacauacagcauugccggacagguggagggcaagguuccccacacggcuaaugccgcuaacaugcuguuuaccgccuucuccgggaucccuagcuauucuuccuuuagcguguucacaggaaaccaggauggcaaugucauuuacucucccggccuuuuuccgaaacugaaccaguccagcugcgaaaagguggcgcucccucugaucugggagggguauaucgaccuucccggauacuaugagaccguccauccuuguaauguguucugcguucuguccggccccggggccucuugugaggcuuuuagcgagggaggcauuuucaacaucacauccccuaccugccucgugucuaaacaaaaucgguuccgcgccgcugaacagcagauuaacuuugucugucagagaguggaccaagauaucguuauuuacugcaaugggcagaagaagacgauccugacaaaaacccuggugaucggacaguguauuuacagcgucaccucccucuucagcaucaugcccggcguggcccacucuauugccaucgagcugugcgugccgggcuuucaugggugggcuacagcggcccuucugaccacauucuguuuuggauggauucucauccccuccauuacgcuggcuauccuuaucguucugaaguucuuugccgcccuccugcacaacagcucucaagaaaaucgguucaaaauuauccugaagaaaauuaaggaggaguuugaaaagaccaaaggcuccauggucugcgagguguguaaguaugaaugcgagacagggaaagaacucaaggcucacaaccugagcugcccucagucucagugucccuacugcuucacccauugugagcuuacagagagcgccuuucaggcgcacuaucgcgugugccaagcuacccauagauuccgggacgaucugaaaaagacgaucaccccucaguccacaagccccggauguuaccgcacccucaaucuguuuagauauaagucucggugcuacauuuucacagucugggugauccugcuuaucauugaauccauccucugggccgccagcgcuuccgagauuguucuggaaccgucuuggaacgacaaugcccacggcgugggggucgugccuaugcauaccgaucuggagcucgacuucagccugcccuccucuagcaaauauacguacaagagaaaacuuacauccccuaucaaccaggagcagucuguugaucugcacauugaaaucgagagccaaggcaucuccaccagcgugcacgcucucggacauugguuugacggccgccugaaucugaagacaucuuuccacuguuacggggccugcaccaaauaugaauaccccuggcauaccgcgaagugucacuuugagcgggauuucgaauaugagaacuccuggagcugcaacccugccgacugucccggaauuggcacagggugcacggcuugcggacuuuaccucgaucagcugaagccggucggcucugccuauaaacugaucaccgugagauacucccgcaagguuugugugcaguuuggggaggaaaaucucugcaaaacaauugacaugaacgacuguuucgucacccggcacgugaaggugugcaucauuggcacagucagcaaauuuucucagggagauacccugguuuuccuuggcccuauggaagggggaggccugaucuuuaaggacugguguacgacaaccugccaauucggggaucccggagacaucaugucccccaaagauaagggcuuuagcuguccugacuucaccgggcauuuuagaaagaaaugcaauuucgcuacaaccccggugugugaauaugauggcaacaugguguccggauacaagaaagucauggccacaauugacagcuuccaggcguuuaauacgucuaacauccacuacaccgaugagcgcauugaauggaaggacacagauggcaugcucaaagaccaucugaauauccuggugaccaaggauauugacuucgagaaccuuggggagaaucccugcaagguuggacuccagacagccagcaucgacggcgcuuggggguccggagugggcuuuacccugacgugucagauuucucugaccgaaugcagccgguuccucacauccaucaaagccugcgauauggcuaucuguuauggggcccaaucugucacccuggugagaggccagaacacaguucgcgugagcggaaagggcgggcacuccggaucuagcuuuaaaugcugucauggcaccgacugcucccaccaggggcuucaagccagcgcuccucaccuggauaaggucaauggaauuguggagcaggaaucuacacagguuuacgacgauggcgcgccccaguguggcaucuccugcugguucgugaaaagcggggaguggauuaagggaaucuuuucuggcaacuggauugucaucguggugcucaucuuccuguuucugcuuucccucauucugcugagcuuccucuguccuauccggaagcauaaaagauccuga

SEQ ID NO: 13314 - RNA, 3408 nt, Artificial Sequence
  derived and/or modified CDS sequence (opt5) from DOBV(GRW/Aa)__JQ026205.1__GP
augaucauguggggccugcuccugacccuuagccugauuaaccucggggccucccugagaaauguguacgacaugaagaucgagugcccccacucuauuaacuucggagaaagcuccgucacaggcaaaggggagcuuccuccgcugcuccugacggaugcugaaacccugguucccgagucuagcuguaauauggacaaccaucagucccucucuaucacacaaaaggugaccaaagugagcuggcggaagaaagccgauaagguccaggcggcuaaggacuccuuugaaacaaccagcucugaggugaaucugaaaggaacaugcacccuuacgcaccgcaugguugaggaauccuauagaagccggaagucugugauuuguuacgaucuguccugcaacagcacccauuguaaaccuacaaugcacaugaucguccccgugcauucuugcaauaugaugaaguccugucucguuggccuggggccuuaucgcauccagguggucuacgagagaaccuauugcacaaccgggauucuuacggaaggcaaauguuucgugcccgaccagagcaucauuuccgugaucaagaacggcgucuuugauauugccucuguuagcaucgugugcuucuuuauucggaucaaggggacauccuacaaaaucaugaccagcauuaaggagucuaauccuaacaauuguaacgacacagauaauaaagugcaaggauauuaccugugcaucgucggcgccaacuccagcccgguguacgcucccucuaccaccgacuuccgcagcguugaggcccucgcuucccugcugagaucuccuuauggggaagaucacgaccucgccggagaggaaguggcgacauacagcauugccggccaggucgaggggaaggugccccacacggcuaaugccgcuaacaugcuguuuaccgccuucuccggaaucccuagcuauucuuccuuuagcguuuucacaggcaaccaggauggcaaugugauuuacucucccgggcuuuuuccgaaacugaaccaguccagcugcgaaaaggucgcgcucccucugaucugggagggauauaucgaccuucccggcuacuaugagaccgugcauccuuguaaugucuucugcguguccucugggcccggagccagcugugaggcuuuuuccgaaggcgggauuuucaacaucacaucuccuaccugccugguuagcaaacaaaaucgguuccgcgccgcugaacagcagauuaacuuugugugucagagagucgaccaagauaucgugauuuacugcaauggacagaagaagacgauccucacaaaaacccugguuaucggccaguguauuuacuccgugaccagccuguucucuaucaugcccggcgucgcccacuccauugccaucgagcucugcgugccgggguuucauggaugggcuacagcggcccugcuuaccacauucuguuuuggcuggauucugauccccagcauuacgcucgcuauccugaucgugcuuaaguucuuugccgcccugcuccacaacucuucccaagaaaaucgguucaaaauuauccugaagaaaauuaaggaggaguuugaaaagaccaaagggagcaugguuugcgaggucuguaaguaugaaugcgagacaggaaaagaacugaaggcucacaaccucucuugcccucagagccagugucccuacugcuucacccauugugagcugacagaguccgccuuucaggcgcacuaucgcgugugccaagcuacccauagauuccgggacgaucuuaaaaagacgaucaccccucagagcacaucucccggcuguuaccgcacccugaaucucuuuagauauaagucccggugcuacauuuucacagugugggucauccugcugaucauugaaagcauccuuugggccgccuccgcuucugagauugugcucgaaccgagcuggaacgacaaugcccacgggguuggcguggucccuaugcauaccgaucuggagcuggacuucucccuccccucuagcuccaaauauacguacaagagaaaacugacaucuccuaucaaccaggagcagagcguggaucuucacauugaaaucgagucccaaggaaucagcaccucuguucacgcucugggccauugguuugacgggcgccucaaucugaagacauccuuccacuguuacggagccugcaccaaauaugaauaccccuggcauaccgcgaagugucacuuugagcgggauuucgaauaugagaacagcuggucuugcaacccugccgacugucccggcauugggacaggaugcacggcuugcggccuguaccuugaucagcucaagccggugggguccgccuauaaacugaucaccgucagauacagccgcaagguguguguucaguuuggcgaggaaaaucugugcaaaacaauugacaugaacgacuguuucgugacccggcacgucaaggugugcaucauuggaacagugucuaaauuuucccagggcgauacccucgucuuccuggggccuauggagggaggcgggcuuaucuuuaaggacugguguacgacaaccugccaauucggagaucccggcgacaucaugagccccaaagauaagggguuuuccuguccugacuucaccggccauuuuagaaagaaaugcaauuucgcuacaaccccgguuugugaauaugauggaaacauggugagcggcuacaagaaagugauggccacaauugacucuuuccaggcguuuaauacgagcaacauccacuacaccgaugagcgcauugaauggaaggaccccgaugggaugcugaaagaccaucucaauauccuggucacaaaggauauugacuucgagaaccugggagagaauccuugcaaggugggccuucagaccgccuccaucgacggggcuuggggaucuggcguuggguuuacacucaccugucagauuagccugacggaaugcucccgguuccugaccucuaucaaagccugcgauauggcuaucuguuauggcgcccaaagcgugacacucgucagaggacagaacaccgugcgcguuuccggcaagggaggacacucuggcagcuccuuuaaaugcugucaugggacagacugcagccaccagggacugcaagccucugcuccccaccuugauaaggugaauggcauugucgagcaggaauccacccagguguacgacgauggcgcgccucagugugggaucagcugcugguucauuaaaucuggagaguggaucaagggcaucuuuuccgggaacuggauuguuaucgugguccugauuuuccucuuucugcugagccuuauccuccuguccuuccugugucccauucggaagcauaaaagaucuuga

SEQ ID NO: 13315 - RNA, 3408 nt, Artificial Sequence
  derived and/or modified CDS sequence (opt5) from DOBV(Slo/Af-BER)__GU904035.1__GP
augaucauguggggccugcuccugaccaugauucuuaucgacuucggggccagccugagaaacguguacgauaugaagauugagugcccccacuccaucaauuuuggagaaucuagcgucacaggcaaaguugagcucccuccgcugcuucugacggacgcugaagcccucgugcccgaguccucuuguaacauggauaaucaucagagcauguccauuauccaaaaggugaccaaagucucuuggcggaagaaagcggacaaggcucaggccgccaaggauagcuucgaaacaaccuccagcgaggugaaccugaaagggacaugcacccugucucaccgcaugguugaggaauccuauagaaaucggcgcagcgugaucuguuacgaccucucuugcaacuccacacauuguaagccuaccaugcacaugauuguccccgugcauagcugcaauaugaugaaaucuugucugguuggacuuggcccuuauagaauccagguggucuacgagcggacguauugcaccacagggauucugaccgaaggaaaguguuuugugcccgaucaguccaucgugagcgucauuaaaaacggcguuuucgacaucgcuuccgugucuauugugugcuuuuucauccgcgucaagggcacaaauuacaagaucauggccagcauuaaaaccgcuacggccaacaauuguaacgauacagacaauaaggugcaaggguauuaccucugcaucguuggaggcaacuccagcccuguguacgcgccgucuaccacagauuuuagauccauggaggcccuggcuagccuucugcgggcuccccacggggaggaccacgaucucucuggagaagaggucgcuaccuauagcauugccggccagaucgaagggaaaauuccucauaccgcgaaugccgcuaacaugcuguucacagccuuuuccggaauccccucuuacagcucccugagcguguucaucggcucucaggacggcccuauuaucuauucccccgggcucuuuccgaagcugaaccagagcucuugcgacaaaguugcccuuccucugauuugggagggauacaucgaucuccccggcuauuacgaaacggugcacccuuguaaugucuucugcgugcuguccgggcccggagccagcugugaggccuuuuccgagggcgggauuuucaacaucaccucucccacaugccuugucagcaagcaaaaucgcuucagagcugcggaacaacaggugaacuuuguuugucagcggguggaccaggauaucauuaucuauugcaauggacagaaaaagaccauucugacaaagacccucgucaucggccaguguauuuacuccgugacgucucuguucagcaucaugccuggcguugcccauuccauugcuaucgagcugugcgugccgggguuucacggaugggccacagccgcucuccugaccaccuucuguuuuggcuggauccuuauucccagcaucacacuggccguccucguggugcugaaauucuuugcggcuauucuucacaacucuucccaagaaaaucgcuucaagaucauucugagaaaaaucaaggaggaauuugagaaaaccaaggggagcaugguuugcgaggucuguaaguacgaaugcgagacaggaaaagaacucaaggcccauaaccugucuugcccucagucccagugucccuauugcuucacgcacugugagccuaccgaaagcgccuuucaggcucauuacaaagugugccaagccacacaccgguuccgcgacgaucugaagaaaaccaucacaccccagucuaccagcccgggcuguuauagaacgcucaaucuguuucgguacaaguccagaugcuauauuuucaccgugugggucacacuucugaucauugagagcaucaugugggcugccucugcguccgagaacgugcucgaaccuagcuggaaugacaacgcccaugggguuggcgugguccccaugcacaccgaucuggagcuggacuucucccuuccuucuagcuccaaguacacauauaaacgcaagcucaccucuccccugaaucaggaacagagcguggaucugcacauugagaucgagucccaaggaaucucuacgagcguucaugcucucggccacugguuugacgggcggcugaaccuuaaaacauccuuccauuguuacggagccugcaccaaguacgaauauccuuggcacacagcuaaaugucacuuugagagagauuucgaauacgagaauagcuggggcugcaaccccgccgacuguccggggauuggaaccggcugcaccgcgugcgggcuguauaucgaccagcucaagccugugggcucugccuacaagcugauuacaguccgcuauucccggaaaguguguguucaguuuggagaagagaaccugugcaagacgaucgauaugaaugacuguuucgugaccagacaugucaaagugugcauuaucggcacagugagcaaguuuucucagggggauacccuugucuuccucggacccauggagggcgggggacugaucuuuaaagacugguguacauccacgugccaauucggcgaucccggggacauuaugagcccuaaggauaaaggcuuuucuuguccggacuucaccggacacuuucgcaagaagugcaacuucgcuacaacccccguuugugaauacgauggcaauaugguguccggguauaaaaaggugauggccaccaucgacagcuuccaguccuuuaacacaagcucuauucauuacaccgaugagcggaucgaauggaaagacccugauggaaugcugaaggaccaccucaauauucuggucacaaaagacaucgauuucgagaaccuuggcgaaaaucccugcaagguggggcugcagacgagcuccauugagggagcuuggggcucugggguuggcuuuacccucacaugucagaucagccugaccgagugcuccagauuccugacaucuaucaaggccugcgacauggccauuuguuacggagcucaaagcgugacccuuauccgcggccagaacacggucaaaguguccgggaagggaggccauucugggagcuccuuuaaaugcugucacggaaccgauugcagccagcaaggccuccaggcgucugccccucaccuggacaagguuaauggcauuguggaacaggauuccgagaaagucuaugacgauggggcuccccaguguggaaucagcugcugguucgugaagucuggcgaauggauuacagggaucuuuaacggaaauuggaucguuauugugguccugguguucuuuuucauccucucccugauucuucugagccuccuguguccuauccggaagcauaaaagauccuga

SEQ ID NO: 13316 - RNA, 3408 nt, Artificial Sequence
  derived and/or modified CDS sequence (opt5) from HTNV(76-118/POR)__KT885048.1__GP
augggcaucuggaaguggcuggugauggccagccucgucuggcccguucugacccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacuccgccugaucgcuuacucugggauuccgagcuauuccagccuuucuauccugaccuccagcaccgaggccaagcacguguuuucuccuggccucuuccccaaacugaaccauacaaauugcgacaaguccgcgaucccucugauuuggacgggcaugaucgaccuccccggguacuacgaagccguccaccccuguaccguguuuugcguucugagcggaccuggcgcuuccugugaggccuucucugagggaggaauuuucaacaucacaagcuccaugugccuugugucuaaacagaauagauuucggcugaccgaacagcaggucaacuucgugugucaacgcguggauauggacauuguugucuauugcaacggccagagaaaggugauccucacaaagacccuggugaucgggcaguguauuuacacgaucacaagccuguuuucccuucucccgggagucgcucacagcauugccguggagcugugcguucccggcuuccauggcugggccaccgcugcgcugcucgugaccuuuuguuucggguggguccugaucccugccauuacauuuaucauucuuaccgugcugaaauucaucgcuaauaucuuucacacaucuaaccaagaaaaucggcucaaguccguucugcgcaaaauuaaggaggaguucgagaaaacgaagggaagcauggugugcgaugucuguaaguaugagugcgaaaccuacaaagagcuuaaggcccauggcgugucuugcccccagucccaguguccuuauugcuuuacacacugugaacccaccgaggccgcuuuccaggcccauuacaaaguuugccaagugacacacagauuucgggacgaucugaagaaaaccgucacgccgcagaacuucaccccuggguguuaucgcacacucaaucuguucagauacaagagccggugcuacaucuuuaccauguggauuuuccugcucgugcuggaaucuauccuuugggcggcuagcgccuccgagacaccccugaccccuguguggaacgacaaugcccacggagucggcagcguucccaugcauacggaucucgagcuggacuuuucucugacauccagcuccaaguauaccuacagacgcaaacuuacaaacccucucgaagaggcucagucuauugaucugcacaucgaaaucgaggagcagaccauugggguggacgugcaugcccugggccacugguucgauggacggcucaaucugaagaccagcuuucacuguuauggcgcuugcacaaaauacgaauaucccuggcauacggccaagugucacuacgagagagacuaucaauacgaaaccuccugggggugcaacccgucugacuguccuggagucggcacagggugcaccgcgugcggacuuuaccuggaucagcucaaacccgugggcagcgccuauaagaucauuacaauccgcuacucccggagaguuugugugcaguucggggaggaaaaucugugcaagauuaucgacaugaacgauuguuuugucucucgccaugugaaaguuugcaucauuggcaccgugagcaaguucucccagggagacacgcugcucuuuuucggcccccuugaagggggaggccugaucuuuaaacacugguguacaucuaccugccaauucggggauccuggagacauuaugagcccgcgggauaagggcuuucugugucccgaguucccuggguccuucagaaagaagugcaauuuugcuaccacacccaucugugaguaugacggcaacauggucagcggauacaaaaaggugauggccaccauugauucuuuccaguccuuuaauacaagcacgaugcauuucaccgacgagcgcaucgaauggaaggauccugacggcaugcuccgggaucacaucaacauucugguuacaaaagacaucgacuuugauaaccuuggggagaaucccugcaagauuggacugcagaccucuuccaucgaaggcgcuugggggagcggagugggcuucacacucaccugucuggucucccugacggagugcccuaccuuucuuacaagcauuaaagccugcgacaaggcgaucuguuauggggccgagucugugacccucacaagaggccagaacaccgugaaagucagcggaaagggcgggcacuccggaucuacauucaagugcugucauggcgaagauugcagccaaauugggcugcacgcugccgcuccccaucuggacaaaguuaauggaaucuccgagaucgaaaacucuaagguguacgaugacggcgccccgcaguguggcauuaaaugcugguuugucaagagcggggaguggaucuccggaauuuucucuggcaauuggaucgugcucauugugcuguguguuuuucuucuguucagccucgugcugcuguccauccuuugcccuguccgcaaacacaaaaagagcuga

SEQ ID NO: 13317 - RNA, 3408 nt, Artificial Sequence
  derived and/or modified CDS sequence (opt5) from HTNV(76-118)__Y00386.1__GP
augggcaucuggaaguggcuggugauggccagccucgucuggcccguucugacccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacucucucugaucgcuuacagcgggauuccguccuauagcucucuuuccauccugaccagcucuaccgaggccaagcacguguuuuccccuggccucuuccccaaacugaaccauacaaauugcgacaagagcgcgaucccucugauuuggacgggcaugaucgaccuccccggguacuacgaagccguccaccccuguaccguguuuugcguucuguccggaccuggcgcuucuugugaggccuucagcgagggaggaauuuucaacaucacauccccgaugugccuugugucuaaacagaaucgcuuuagacugaccgaacagcaggucaacuucgugugucaacggguggauauggacauuguugucuauugcaacggccagcgcaaggugauccucacaaagacccuggugaucgggcaguguauuuacacgaucacaagccuguuuucccuucuccccggagucgcucacagcauugccguggagcugugcguuccuggcuuccauggcugggccaccgcugcgcugcucgugaccuuuuguuucggguggguccugauccccgccauuacauuuaucauucuuaccgugcugaaauucaucgcuaauaucuuucacacaucuaaccaagaaaauagacucaaguccguucugcggaaaauuaaggaggaguucgagaaaacgaagggaagcauggugugcgaugucuguaaguaugagugcgaaaccuacaaagagcuuaaggcccauggcgugucuugcccucagucccagugucccuauugcuuuacacacugugaaccgaccgaggccgcuuuccaggcccauuacaaaguuugccaagugacacaccgcuuuagagacgaucugaagaaaaccgucacgccucagaacuucacccccggguguuaucggacacucaaucuguuccgcuacaagagcagaugcuacaucuuuaccauguggauuuuccugcucgugcuggaaucuauccuuugggcggcuagcgccuccgagacaccucugacccccguguggaacgacaaugcccacggagucggcagcguuccuaugcauacggaucucgagcuggacuuuucucugacauccagcuccaaguauaccuaccggagaaaacuuacaaacccccucgaagaggcucagucuauugaucugcacaucgaaaucgaggagcagaccauugggguggacgugcaugcccugggccacugguucgauggacgccucaaucugaagaccagcuuucacuguuauggcgcuugcacaaaauacgaauauccguggcauacggccaagugucacuacgagcgggacuaucaauacgaaaccuccugggggugcaacccuucugacugucccggagucggcacagggugcaccgcgugcggacuuuaccuggaucagcucaaacccgugggcagcgccuauaagaucauuacaaucagauacucccgccggguuugugugcaguucggggaggaaaaucugugcaagauuaucgacaugaacgauuguuuugucucuagacaugugaaaguuugcaucauuggcaccgugagcaaguucucccagggagacacgcugcucuuuuucggcccucuugaagggggaggccugaucuuuaaacacugguguacaucuaccugccaauucggggauccgggagacauuaugagcccccgcgauaagggcuuucuguguccugaguuccccggguccuuccggaaaaagugcaauuuugcuaccacaccuaucugugaguaugacggcaacauggucagcggauacaaaaaggugauggccaccauugauucuuuccaguccuuuaauacaagcacgaugcauuucaccgacgagagaaucgaauggaaggaucccgacggcaugcuccgcgaucacaucaacauucugguuacaaaagacaucgacuuugauaaccuuggggagaauccuugcaagauuggacugcagaccucuuccaucgaaggcgcuugggggagcggagugggcuucacacucaccugucuggucucccugacggagugccccaccuuucuuacaagcauuaaagccugcgacaaggcgaucuguuauggggccgagucugugacccucacacggggccagaacaccgugaaagucagcggaaagggcgggcacuccggaucuacauucagaugcugucauggcgaagauugcagccaaauugggcugcacgcugccgcuccgcaucuggacaagguuaauggaaucuccgagaucgaaaacucuaaaguguacgaugacggcgccccucaguguggcauuaagugcugguuugugaaaagcggggaguggaucuccggaauuuucucuggcaauuggaucguccucauugugcuguguguuuuucuucuguucagccucgugcugcuguccauccuuugccccguccgcaagcacaaaaagagcuga

SEQ ID NO: 13318 - RNA, 3408 nt, Artificial Sequence
  derived and/or modified CDS sequence (opt5) from HTNV(A16)__AF288645.1__GP
augggccuguggaaguggcucaucauggccgugcuggucuggcccugcuucgcucuuagaaacguuuacgacaugaaaauugaguguccucacaccgugaauuuuggggaaaacagcguggucggauauguggagcugccgcccaugccuaucgccgauauuacacagaugaugcccgaauccucuugcagcauggacaaucaucaaucccucaacacgaucaccaaguacacacagguuucuuggcggaaaaaggcggaucaggcucagagcucccaaaccucuuucgagacagugagcuccgaagucgacuuuaaaggcaccugugugcugaagcacaagaugauugaggauagcuaucgcucuagacgguccaucaucugcuacgaccuuagcuguaauucuacauucugcaaaccuacccuguaucucauuguucccgugcaugccuguaacaugaugaaguccugccugaucgcccuggggccuuaccgcguccaggugguguaugagagaacguacuguaugagcggaguccuccuggaaggcaaaugcuuuguuccggaucagucugugguguccauuaucaagcacgggauuuucgacaucgcuagcguccauauugugugcuuuuucguugccaucaaaggauccaccuacaagauccuugaacaggugaagaaaucuuuugagcugacauguaaugauaccgacaacaagauucaaggcuauuacaucugccucgucggcgggaauagcgcucccauuuaugugccuacacuggaugacuuccgguccauggaggccuuugcgggaaucuucaaaagcccccacggcgaggaucacgaccuugccggggaagagguugcuucuuacuccauugugggaccugccaacgcuaaggucccccauagcgccucugcggacacccugggccucguggccuuuagcgggaucccguccuauucuagcuucuccguccugacgggaagcacagaugcucgccacguguucucuccuggcuuuuucccccagcugaaucagaccagaugugacaaaacagccaucccucucaccuggaccggcaugauugaucugcccggguacuaugaagcuguucaucccugcacaguguuuuguguccuuuccggaccuggcgccagcugcgaggccuucucugaagggggaaucuuuaacauuacguccccgaugugucuggugagcaagcagaaucgguuccgcuccucuaaacaacagguuaacuuugugugccagagagucgacauggauaucgugguguacuguaauggccaaaagaagguuauucucaccaaaacacuggucaucgggcagugcaucuacaccauuacaagccuuuucucccugcuccccggaguggcucacucuaucgcgguggagcugugugucccuggcuuucacggcugggccaccgcugcccugcucgugacguucugcuuuggguggguucugauucccgccgugacacuugucauccugaccauucucaaguucaucgcuaacauuuuucauaccagcaaccaggagaaucggcugaaauccgugcuuaagaaaaucaaggaagaguucgaaaagacaaaaggaagcaugguuugugacgugugcaaguaugagugcgaaaccuacaaagagcugaaggcccacggcgucucuuguccucagucccaaugccccuauuguuucacacauugcgagccgacggaagcggcuuuucaggcccacuacaaagugugucagguuacccaucgcuucagagaugaccucaagaagacagugaccccucagaacuuuacacccgggugcuaucggacccugaaucuguuccgcuacaaaagcagauguuauaucuuuacgaugugggucuuccuccugauucuugagucuauccugugggccgcuuccgccagcgaaaccccucucacacccauuuggaacgauaaugcucacggagugggcucuaucccuaugcacaccgaccuggagcuggauuuuagccuuacauccagcucuaaguacaccuaccggagaaaacucacgaacccccuggaagagacacaagccguggaccugcauauugagcucgcggaacagaccaucggggucgacguucacgcccugggccauugguucgauggacgccuuaaucugaagacauccuuucacugcuauggcgcuuguaccaaauacgaguauccguggcacaccgccaagugccauuacgaacgggacuaucaguacgagacaagcuggggguguaacccuuccgauugccccggagugggcacggggugcaccgcuuguggacucuaucuggaccagcugaagcccgugggcucugccuacaaaaucauuacaaucagauacagccgccgggucugcgugcaauucggggaggaaaaucuuuguaagguuauugauaugaacgacugcuuuguguccagacacgucaaaguguguaucauuggcaccguuucuaaguucagccagggagauacacuccuguuuuucggcccucuggaagggggaggccucaucuucaaacauuggugcaccuccacgugucaguuuggggacccgggagauaucaugucuccccgcgacaagggcuuccugugcccugaguuucccgggagcuuccggaaaaaguguaauuuugcgacaaccccucuuugcgaguaugauggcaacaugauuuccggauacaagaaagugauggccaccaucgacagcuuccagucuuuuaauacauccaccaugcacuucacagaugaaagaauugaguggaaggaccccgacggcaugcugcgcgaucauaucaacauucucgucacgaaagacaucgauuuugacaaucugggggagaacccuuguaagaucggacugcaaaccagcucuauugaaggcgcuuggggguccggagugggcuucacacuuaccugccucguuagccugacagagugccccaccuuucugacgucuaucaaagccugugauaaggcuauuugcuauggggccgaauccgugacccucacacggggccagaacaccgucaaggugagcggaaaaggcgggcacuccggaagcacauucaaguguugccacggcgaggacuguucucagaccgggcugcaugccgcugcgccgcaccuugauaaagugaauggaaucagcgaaauugagaacuccaaggucuacgacgauggcgccccucaaugcggcaucaaauguugguucguuaagucuggggaguggauuagcggaaucuuuuccggcaauuggaucgugcugauugugcucugcgucuuccugcuguuuucucuugugcuccugagcguucugugucccgugagaaagcauaaaaaguccuga

SEQ ID NO: 13319 - RNA, 3408 nt, Artificial Sequence
  derived and/or modified CDS sequence (opt5) from HTNV(A9)__AF035831.1__GP
augggcaucuggaaguggcuggugauggccagccucgucuggcccgcuuacacccugagaaacgccuaugacaugaaaauugagugcccucacacaguuuccuucggggaaaauucugugaucggauacguggagcuuccgcccauuccucuggcggauacgacccagaugguccccgaaagcuccuguucuauggacaaccaucaaagccucaauacaaucaccaaguauacacagguguccuggcggggcaaagcugaucacgcccaggccucucagaacagcuuugaggcuguuuccgccgaaguggaccugaaggggaccugcguccuuaaacauaagaugcuggaggagagcuaccgcucuagaaaguccauugcuuguuaugaucucagcugcaauucuacauacuguaaaccuacccuguauaugaucgugcccauccacgccugcaacaugaugaaguccugucugauugcgcucggaccucaucggguucaaguggucuacgaacgcacguacugcaugaccggcgugcugaucgaggggaaauguuucgugccggaccagagcgucguuucuauuaucaagcacggaauuuuugauaucgccuccgugcacauugugugcuucuuugucgcugugaaaggcaauacauauaagaucuucgaacagaucaagaaauccuuugagagcaccuguaacgacacaaagaauaaaguucagggcuacuauauuugcaucgucgggggaaacucugcccccauuuacgugccuacccuugaugacuucagaagcauggaggcuuuuuccggcaucuuccggagcccccauggggaagaucacgaccuggccggagaggaaauugcgucuuauuccaucgugggcccugccaaugcuaagguuccccauagcgccucuagcgauacgcucucccugacagcuuacucugggaucccgagcuauuccagccuuucuauucuggccggauccgccgaggcuaaacacguguuuagcccuggcuucuuuccccaacucaaccacaccaagugcgacaaaacagcgaucccucugauguggaccggcaugauugaccugcccggguacuacgaagccauccaucccuguaccgucuucugcgugcucucuggaccuggcgcuuccugugaggccuucagcgaagggggaauuuuuaauaucacauccccgaugugccuggucucuaagcagaaccgcuucagacuuacggagcaacaggugaauuuuguuugucagcggguggauauggacaucauugucuauugcaacggccagcgcaaggugauccugaccaaaacacucguuauugggcaguguaucuacaccauuacaagccuguucucccuucugcccggaguggcccacucuaucgcugucgagcucugcgugccuggcuuucauggcugggccaccgcggcucugcuggugacguucuguuuuggguggguucucauucccgccaugacauucaucguccugaccauccuuaaguuuauugccaacaucuuccacaccagcaaucaagaaaacaaacugaaguccgugcucagaaaaauuaaggaggaauuugagaagacaaaaggaagcauggugugcgaugucuguaaguaugagugcgaaaccuacaaagagcugaaggcucauggcgugucuugcccucagucccagugucccuauugcuucacacacugugaaccgacggaggccgcuuuucaggcccacuaccggguuugccaagugacccaucgcuucagagacgaucuuaaaaagacagucaccccucagaauuucacacccggguguuaucggacccugaaccucuuucgcuacaagagcagaugcuacaucuucacgauguggguguuucugcugguucucgaaucuauucugugggcggccuccgcuagcgagaucccucuuaaucccguguggaacgacaaugcccacggagucggcucugugccuaugcccaccgaucuggagcucgacuucagccugacauccagcucuaaauauaccuaccggagaaagcugacaaacccgcuugaagagucccaggcuaucaaucuccauauugaaaucgaggagcagaccauugggguugaugugcacgcccugggccacugguuugacggacgccugaaccucaaaacgagcuuccauuguuauggcgcgugcacaaaguacgaauauccuuggcacaccgccaaaugucauuacgagcgggauuaucaauacgaaacauccugggggugcaaucccucugacugucccggagucggcaccgggugcaccgcuugcggacuguaccuugaccagcugagagccgugggcagcgcuuauaagaucauuacaauccgcuacucccggagaguguguguccaguuuggggaggaaaaccucugcaagaucauugauaugaaugacuguuucguuucucgccacgugaaagugugcaucauuggcacggucagcaaguuuucccagggagauacccugcuguucuuuggcccucuugaagggggaggccucaucuucaaacauugguguacaucuaccugccaauuuggggacccgggagauauuaugagcccccgggacaagggcuuccuguguccugaguuccccggguccagcagaaagaagugcaacuuugccacaaccccucugugugaguaugauggcaauauggugucuggauacaaaaagguuauggccacgaucgacuccuuccagagcuuuaacacaucuaccaugcacuucaccgaugagcgcaucgaauggaaggaccccgauggcaugcuccgggaccacauuaacauccuggugacaaaagauauugacuuugagaaucuugggggaaacccuugcaagaucggccugcagaccuccagcauugaaggggcuuggggaucuggcgucggguucacacucacgugucuggugucccugaccgagugccccacauuucuuaccagcaucaaagcgugcgacaaggccauuuguuauggcgcugaguccguuacacucaccagaggacagaauacggugaaagucagcggcaaagggggacauucuggcagcaccuucaagugcugucacggggaagagugcucccaaaucggacugcaugccgccgcuccgcaccuggauaaagugaacggcaucucugaaauugagaauaacaagguuuacgacgauggcgccccucagugugggaucaaaugcugguuugucaagagcggagaauggauuuccggcaucuucucugggaauuggauugugcucaucgugcuguguguguuucuucuguucagccucauccugcuguccauucuuugccccguccgcaaacauaagaagucuuga

SEQ ID NO: 13320 - RNA, 3408 nt, Artificial Sequence
  derived and/or modified CDS sequence (opt5) from HTNV(84FLi)__AF345636.2__GP
augggcguguggaaguggcuggucauggccagccucguuuggcccgccugcacccugagaaacguguacgacaugaaaaucgaguguccucacacaguguccuucggggaaaauucugucauuggauauguggagcuuccgcccaugccucuggccgauacgacccagcucguucccgaaagcuccugcucuauggacaaccaucaaagccugaauacaaucaccaaguacacacagguguccuggcggaaaaaggcggaucaggcucagucuagccaaaacuccuuugagaccgucagcguggaaguugaccuuaaaggcacaugugugcugaagcacaagaugauugaggagucuuaucgcuccagaaaaagcauuaccugcuacgaucucucuuguaauuccacguauugcaagccuacccuguacaugaucguccccauccaugccuguaacaugaugaaaagcugccugaucgcccucgggccuuaucggguucagguggucuacgaacgcacauacuguaugaccggaguucugauugagggcaagugcuucgugccggaccagucuguggucuccaucauuaaacacgggaucuuugauauugcuagcgugaagaucguuuguuucuuuguggccgucaagggaaauacauauaaacuuuucgaacaggugaagaaauccuuugacucuaccugcaacgauacggagaauaagguucaaggcuacuauauuugcaucgugggcgggaacagcgcucccaucuacgucccuacacuggacgauuucagauccauggaggccuuuagcggaauuuuccggucuccccauggcgaagaccacgaucucgcgggggaggaaguggccuccuauagcaucgucggaccugcuaaugccaaagugccccacucugcuagcuccgacacccugucucuuauugccuacagcggcaucccguccuauagcucucuguccauucucacaagcucuaccgaggcgaagcauguguuuuccccuggguucuuuccccagcugaaccacaccaaaugugacaagacagccaucccucugacguggaccggaaugaucgaucuccccggcuacuacgaagcuauucaucugugcacaguguucuguguccuuagcggccccggggccuccugcgaggcuuucucugagggaggcaucuuuaauauuaccagcccuaugugucugguguccaagcagaaccaguuccgccucacaaaacaacagguuaauuuugugugccagagagucgacauggauaucgugguguauuguaacgggcaacggaagguuauucugaccaaaacgauggucaucggacagugcaucuacacaauuaccucucuuuucagccugcucccgggcguggcccacuccaucgccguggaacuguguguccccggguuucacggaugggcuaccgcggcccugcucgugacauucugcuuuggcuggguucugauuccugcugugaccuucaucauucuuacaguccugaaguuuguggccaacaucuuccauacgagcaaucaggagaaccgccucaaaucuguucugagaaagauuaaggaagaguuugaaaagaccaagggcuccauggugugugacgucugcaaauaugagugcgagacauaccgggaacuuaaggcccacggggugagcuguccccagucucaaugcccuuauuguuucacccauugcgagcccacagaagcugccuuucaggcgcacuaccgcguuugucaggugacccauagauuccgggaugaccugaaaaagacggucaccccgcagaauuucacaccuggaugcuaucgcacccucaaccuguuuagauacaagucccgguguuacaucuucacaauguggguguuucugcucgugcuggagagcauccuuugggcugccucugccagcgaagucccccugaauccuauuuggaacgauaaugcucacggcguuggguccgugcccaugcacaccgaccucgagcuggauuucagccugacgucuuccagcaaauauacauacagacgcaagcugaccaacccucucgaggaaacacaagccaucgaccugcauauugagaucgaggaacagaccauuggaguggauguccacgcucugggccauugguuugacgggcggcucaaucugaaaaccuccuuccacugcuauggcgccuguacaaaguacgaguaucccuggcacacggcgaaaugccauuacgaaagagacuaucaguacgagaccucuuggggauguaacccgagcgauugcccuggcguggggacaggaugcaccgccuguggccuuuaccuggaccagcucaagcccguuggguccgcuuauaagaucaucacaauucgcuacucucggagagugugcguccaauuuggagaagagaaucuguguaaagugaucgauaugaacgacugcuucguuagccgccacgugaaggucuguauuaucggcaccguguccaaauuuucucagggggauacgcugcuuuucuuuggcccccucgaaggaggcgggcugauuuucaagcauuggugcacaagcaccugucaguuuggagacccuggcgauaucauguccccgcgggacaaaggguuccugugccccgaguucccuggcagcuuuagaaagaaauguaauuucgccaccacaccccucugcgaguaugauggaaacaugaucucuggguacaagaagguuauggcuaccauugacuccuuucagagcuucaauacaucuacgaugcacuuuaccgaugaacgcaucgaguggaaagacccugauggcaugcugcgggaccauauuaacauccuugugacaaaggacauugauuucgacaaccugggagaaaaucccuguaaaaucggccuccaaaccuccagcaucgagggggccuggggaucuggcgucggguuuacacugaccugccuggugucccuuacggaaugcccuaccuuccucacaagcauuaaggcgugugauaaagccaucugcuauggagcugaguccgugacccugacaagaggccagaacaccgucaagguuagcgggaagggcggacacucuggcagcacauuuaaauguugccacggggaggacuguucccagaccggacugcaugccgcugcuccccaccucgauaaggugaauggcauuucugaaaucgagaacagcaaaguguacgacgauggggccccgcaaugcggaauuaaguguugguucgucacguccggcgaauggaucucuggcauuuuuagcgggaauuggaucgugcugaucguucuuugcguguuccuucucuucucccugguccugcuuucugugcucuguccuguucgcaaacauaaaaagagcuga

SEQ ID NO: 13321 - RNA, 3408 nt, Artificial Sequence
  derived and/or modified CDS sequence (opt5) from HTNV(Aa03-161)__KT934990.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccgagcaacaggugaacuuuguuugucaacggguggaugucgacauugugguguacugcaacggccagcgcaagguuauccugacgaagacacuugucaucgggcaguguauuuauaccaucaccucccuguucucucuccugcccggaguggcucacagcauugccguggaacugugcgucccuggcuuucauggcugggccacagcugcgcuccuggugaccuucuguuuuggguggguucuuauccccgccauuacauucaucauucugacgauccucaaauuuaucgcuaauauuuuccacaccuccaaccaagagaauagacuuaagagcgugcugcggaaaaucaaggaagaguuugagaaaacaaagggaucuauggucugcgauguguguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaacuucacccccggguguuaccggacacugaaucuguuucgcuauaagucuagaugcuacauuuucaccauguggaucuuucuccugguucuugaguccauucugugggcggcuagcgccucugagacgccucucacacccguguggaacgacaaugcccacggagucggcagcgugccuaugcauaccgaucuggaacuggacuucucccuuacauccucuuccaaguacaccuaucggagaaaacucaccaacccccuggaggaagcucagagcaucgaucugcacaucgagauugaggaacagacaaucgggguggacguccaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggaguuggcacagggugcaccgcgugcggacuguaccucgauagacugaaacccgugggcuccgccuacaagauuaucacgauucgcuauucucggagaguguguguccaguuuggggaagagaaucugugcaagaucaucgacaugaacgauuguuucgugagccgccauguuaaagugugcauuaucggcacagucuccaaguuuucucagggagacacccuucucuucuuuggcccucuggaagggggaggccugauuuucaaacacugguguaccagcacaugccaguuuggggauccgggagacaucaugagcccccgggauaagggcuuccucuguccugaguuccccgggagcuuucgcaaaaagugcaauuucgcuaccacaccuauuugugaauacgacggcaacauggugucuggauauagaaaaguuauggccacgaucgauuccuuucagagcuucaauaccucuacaaugcauuuuaccgacgaacggaucgaguggaaggaucccgacggcaugcugagagaucacauuaacauccuugugacaaaggacauugacuucgauaaccugggggaaaauccuugcaaaaucggacuccagaccuccagcauugagggcgcuugggggucuggagucggcuuuacgcugaccugucuggugucccuuacagagugccccaccuuccucacaagcaucaaggccugcgacaaagcgauuuguuacggggccgaauccguuacccugacacgcggccagaacaccgugaaggucagcggaaaaggcgggcacucuggaagcacguuuaagugcugucauggcgaggauugcucccagaucgggcugcacgcugccgcuccgcaucucgacaaggugaauggaaucucugaaauggagaacagcaaaguguaugaugacggcgccccucaauguggcauuaagugcugguucgucaaauccggggaauggaucucuggaauuuuuagcggcaauuggaucguucugauugugcuuuguguguuccuccuguucucccugguccugcuuucuauccucugccccgugcggaagcacaaaaagagcuga

SEQ ID NO: 13322 - RNA, 3408 nt, Artificial Sequence
  derived and/or modified CDS sequence (opt5) from HTNV(Aa03-386)__KT934991.1__GP
augggcaucuggaaguggcuggugauggccagccucgucuggcccguucugacccuuagaaacguguacgacaugaaaauugagugcccucacacaaucuccuucggggaaaauucugugauuggauaugucgagcugccgcccaugccucucgcugauacggcccagcuggugcccgaaagcuccuguucuauggacaaccaucaaagccuuaauaccaucacaaaguacacccagguuuccuggcggggcaaagcggaucagucucagagcucccaaaacagcuuugagacagugucuaccgaagucgaccugaaggggacaugcgugcucaaacacaagaugguugaggaguccuaucgcagcagaaagucuauuaccuguuacgaucuguccugcaauagcacguauuguaaaccuacccuguacaugaucgugcccauccaugcuugcaacaugaugaagucuugucucauugcccugggaccuuaucggguccaggugguguacgaacgcacauacugcaugaccggcguccuuaucgaggggaaauguuucguuccggaccaguccguggugagcauuaucaagcacggaauuuuugauaucgccuccguccauauugugugcuucuuuguugcugugaaaggcaauacauauaagaucuucgaacaggucaagaaaucuuuugagagcaccuguaacgacacggagaauaaggugcaaggcuacuauaucugcauuguugggggaaacuccgcccccaucuacgugccuacacuggaugacuucagaagcauggaggcuuuuaccggcauuuuccggucuccccacggggaggaucacgaccucgccggagaagagacagcgaccuauuccaucgucggcccugccaaugcuaaagugccccauagcgccucuagcgauacccugucccuuauugcuuuuucugggaucccgagcuacuccagccugucuauccucacauccagcacggaagccaagcacgucuucucuccuggacuguuucccaaacugaaccauaccaauugcgacaagggcgcgauuccucucauguggacaggcaugaucgaccugcccggguauuacgaggccauucaccccuguaccguguucugcguucuuuccggaccuggcgcuagcugugaggccuucuccgaagggggaaucuuuaacauuacaucuccgaugugccuggugagcaaacagaaucgcuucagacucaccgagcagcaggucaacuuugugugucaacggguugauguggacaucgucguguacugcaacggccagcgcaaggugauccugacgaagacacuuguuauugggcaguguaucuauaccauuaccucccuguucucucuccugcccggagucgcucacagcaucgccguggaacugugcgugccuggcuuucauggcugggccacagcugcgcuccuggucaccuucuguuuugggugggugcuuauucccgccaucacauucauuauccugacgauccucaaauuuauugcuaauaucuuccacaccuccaaccaagagaauagacuuaagagcguucugcggaaaauuaaggaagaguuugagaaaacaaagggaucuauggugugcgaugucuguaaguacgaaugcgagaccuauaaagaacugaaggcccauggcguguccugcccucagagccagugucccuacugcuucacacacugugagccgaccgaagccgcuuuucaggcccauuauaaaguuugccaagugacgcaccgcuucagagacgaucucaagaaaaccgucacaccucagaacuucacccccggguguuaccggacacugaaucuguuucgcuauaagucuagaugcuacaucuucaccauguggauuuuucuccuggugcuugaguccauccugugggcggcuagcgccucugagacgccucucacacccguuuggaacgacaaugcccacggagugggcagcgucccuaugcauaccgaucuggaacuggacuucucccuuacauccucuuccaaguacaccuaucggagaaaacucaccaacccccuggaggaagcucagagcaucgaucugcacauugagaucgaggaacagacaauugggguggacgugcaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggagucggcacagggugcaccgcgugcggacuguaccucgauagacugaaacccguuggcuccgccuacaagaucauuacgauccgcuauucucggagagugugugugcaguuuggggaagagaaucugugcaagaucauugacaugaacgauuguuucgucagccgccaugugaaaguuugcaucauuggcacaguguccaaguuuucucagggagacacccuucucuucuuuggcccucuggaagggggaggccugaucuucaaacacugguguaccagcacaugccaguuuggggauccgggagacauuaugagcccccgggauaagggcuuccucuguccugaguuccccgggagcuuuagaaagaagugcaauuucgcuaccacaccuaucugugaauacgacggcaacauggucucuggauauaaaaaggugauggccacgaucgauuccuuucagagcuucaauaccucuacaaugcauuuuaccgacgaacgcauugaguggaaggaucccgacggcaugcugcgggaucacaucaacauucuuguuacaaaagacaucgacuucgauaaccugggggaaaauccuugcaagauuggacuccaaaccuccagcaucgagggcgcuugggggucuggagugggcuuuacgcugaccugucuggucucccuuacagagugccccaccuuccucacaagcauuaaagccugcgacaaggcgaucuguuacggggccgaauccgugacccugacaagaggccagaacaccguuaaagugagcggaaagggcgggcacucuggaagcacguuuaagugcugucauggcgaggauugcucccagaucgggcugcacgcugccgcuccgcaucucgacaaagucaauggaauuucugaaauggagaacagcaagguguaugaugacggcgccccucaauguggcaucaaaugcugguucgugaaguccggggaauggauuucuggaaucuuuagcggcaauuggauuguccugaucguucuuuguaucuuccuccuguucucccuggugcugcuuucuauucucugccccgugcgcaaacacaaaaagagcuga

SEQ ID NO: 13323 - RNA, 3408 nt, Artificial Sequence
  derived and/or modified CDS sequence (opt5) from HTNV(Aa04-722)__KU207182.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcauuaucgaccugcccggguauuacgaggccauucaccccuguaccguuuucugcgugcuuuccggaccuggcgcuagcugugaggccuucuccgaagggggaaucuuuaacauuacaucuccgaugugccuggucagcaaacagaaucgcuucagacucaccgagcaacaggugaacuuuguuugucaacggguggaugucgacaucgugguguacugcaacggccagcgcaagguuauccugacgaagacacuugucauugggcaguguaucuauaccauuaccucccuguucucucuccugcccggaguggcucacagcaucgccguggaacugugcgucccuggcuuucauggcugggccacagcugcgcuccuggugaccuucuguuuuggguggguucuuauucccgccaucacauucauuauccugacgauccucaaauuuauugcuaauaucuuccacaccuccaaccaagagaauagacuuaagagcgugcugcggaaaauuaaggaagaguuugagaaaacaaagggaucuauggucugcgauguguguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaacuucacccccggguguuaccggacacugaaucuguuucgcuauaagucuagaugcuacaucuucaccauguggauuuuucuccugguucuugaguccauccugugggcggcuagcgccucugagacgccucucacacccguguggaacgacaaugcccacggagucggcagcgugccuaugcauaccgaucuggaacuggacuucucccuuacauccucuuccaaguacaccuaucggagaaaacucaccaacccccuggaggaagcucagagcaucgaucugcacauugagaucgaggaacagacaauugggguggacguccaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggaguuggcacagggugcaccgcgugcggacuguaccucgauagacugaaacccgugggcuccgccuacaagaucauuacgauccgcuauucucggagaguguguguccaguuuggggaagagaaucugugcaagaucauugacaugaacgauuguuucgugagccgccauguuaaagugugcaucauuggcacagucuccaaguuuucucagggagacacccuucucuucuuuggcccucuggaagggggaggccugaucuucaaacacugguguaccagcacaugccaguuuggggauccgggagacauuaugagcccccgggauaagggcuuccucuguccugaguuccccgggagcuuuagaaagaagugcaauuucgcuaccacaccuaucugugaauacgacggcaacauggugucuggauauaaaaagguuauggccacgaucgauuccuuucagagcuucaauaccucuacaaugcauuuuaccgacgaacgcauugaguggaaggaucccgacggcaugcugcgggaucacaucaacauucuugugacaaaagacaucgacuucgauaaccugggggaaaauccuugcaagauuggacuccagaccuccagcaucgagggcgcuugggggucuggagucggcuuuacgcugaccugucuggugucccuuacagagugccccaccuuccucacaagcauuaaagccugcgacaaggcgaucuguuacggggccgaauccguuacccugacaagaggccagaacaccgugaaagucagcggaaagggcgggcacucuggaagcacguuuaagugcugucauggcgaggauugcucccagaucgggcugcacgcugccgcuccgcaucucgacaaagugaauggaauuucugaaauggagaacagcaagguguaugaugacggcgccccucaauguggcaucaaaugcugguucgucaaguccggggaauggauuucuggaaucuuuagcggcaauuggauuguucugaucgugcuuuguguguuccuccuguucucccugguccugcuuucuauccucugccccgugcgcaaacacaaaaagagcuga

SEQ ID NO: 13324 - RNA, 3408 nt, Artificial Sequence
  derived and/or modified CDS sequence (opt5) from HTNV(Aa05-190)__KT934993.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucacggauaccgcucagcugguucccgaaagcuccuguucuauggacaaccaucaaagccuuaauacaauuaccaaguacacacagguguccuggcggggcaaagccgaucagucucagagcucccaaaacagcuuugagaccgucucuacagaaguggaccugaaggggaccugcguucucaaacacaagaugaucgaggaguccuaucgcagcagaaagucuauuacguguuacgaucuguccugcaauagcaccuauuguaaaccuacacuguacaugaucgugcccauccaugcgugcaacaugaugaagucuugucucauugcucugggaccuuaucggguccaggugguguacgaacgcaccuacugcaugacaggcguccuuaucgaggggaaauguuucguuccggaccaguccguggugagcauuaucaagcacggaauuuuugauaucgccuccguccauauugugugcuucuuuguugccgugaaaggcaauaccuauaagaucuucgaacaggucaagaaaucuuuugagagcacguguaacgacacagagaauaaggugcaaggcuacuauaucugcauuguugggggaaacuccgcucccaucuacgugccuacccuggaugacuucagaagcauggaagccuuuacaggcauuuuccggucuccccacggggaggaucacgaccucgcuggagaagagaccgccaccuauuccaucgucggcccugcgaaugccaaagugccccauagcgcuucuagcgauacacugucccuuauugccuuuucugggaucccgagcuacuccagccugucuauccucacguccagcaccgaagcuaagcacgucuucucuccuggacuguuucccaaacugaaccauacaaauugcgacaagggcgccauuccucucauguggaccggcaugaucgaccugcccggguauuacgaggcgauucaccccuguacaguguucugcguucuuuccggaccuggcgccagcugugaggcuuucuccgaagggggaaucuuuaacauuaccucuccgaugugccuggugagcaaacagaaucgcuucagacucacggagcagcaggucaacuuugugugucaacggguugauguggacaucgucguguacugcaacggccagcgcaaggugauccugacaaagacccuuguuauugggcaguguaucuauaccauuacaucccuguucucucuccugcccggagucgcccacagcaucgcuguggaacugugcgugccuggcuuucauggcugggccaccgccgcucuccuggucacauucuguuuugggugggugcuuauucccgcgaucacguucauuauccugaccauccucaaauuuauugccaauaucuuccacacauccaaccaagagaauagacucaagagcguucuucggaaaauuaaggaagaguuugagaaaaccaagggaucuauggugugcgaugucuguaaguacgaaugcgagacauauaaagaacugaaggcucauggcguguccugcccucagagccagugucccuacugcuucacccacugugagccgacggaagccgccuuucaggcucauuauaaaguuugccaagugacccaccgcuucagagacgaucucaagaaaacagucaccccucagaacuucacacccggguguuaccggacccugaaucuguuucgcuauaagucuagaugcuacaucuucacgauguggauuuuucuccuggugcuugaguccauccugugggccgcgagcgcuucugagacaccucucacccccguuuggaacgacaaugcccacggagugggcagcgucccuaugcauacagaucuggaacuggacuucucccuuaccagcagcuccaaguacaccuaucggagaaaacucacaaacccccuggaggaagcccagagcaucgaucugcacauugagaucgaggaacagacgauugggguggacgugcaugcucucggccacugguuugauggacgccugaaucuuaagaccuccuuccacuguuacggcgccugcacaaaauaugaguacccguggcauaccgcuaagugucacuaugaacgggacuaccaauaugagacaucuugggggugcaacccuagcgacugucccggagucggcaccgggugcacggccugcggacuguaccucgauagacugaaacccguuggcuccgcguacaagaucauuacaauccgcuauucucggagagugugugugcaguuuggggaagagaaucugugcaagaucauugacaugaacgauuguuucgucagccgccaugugaaaguuugcaucauuggcaccguguccaaguuuucucagggagacacccuucucuucuuuggcccucuggaagggggaggccugaucuucaaacacugguguacaucuaccugccaguuuggggauccgggagacauuaugucccccagagauaagggcuuccucuguccugaguuccccgggagcuuucggaaaaagugcaauuucgccacaacgccuaucugugaguacgacggcaacauggucucuggauauaaaaaggugauggcuaccaucgauuccuuucagagcuucaauacaucuaccaugcauuuuacagacgaacgcauugaguggaaggaucccgacggcaugcugcgggaucacaucaacauucuuguuaccaaagacaucgacuucgauaaccugggggaaaauccuugcaagauuggacuccaaacguccagcaucgagggcgccugggggucuggagugggcuuuacccugacaugucuggucucccuuaccgagugccccacauuccucaccagcauuaaggcuugcgacaaggccaucuguuacggggcggaauccgugacacugaccagaggccagaacacgguuaaagugagcggaaagggcgggcacucuggaagcacauuuaagugcugucauggcgaggauugcucccagaucgggcugcacgccgcugccccgcaucucgacaaagucaauggaauuucugaaauggagaacagcaagguguaugaugacggcgcuccucaauguggcaucaaaugcugguucgugaaguccggggaauggauuucuggaaucuuuagcggcaauuggauuguccugaucguucuuuguguguuccugcuguucucccuggugcugcuuucuauccucugccccguccgcaaacacaaaaagagcuga

SEQ ID NO: 13325 - RNA, 3408 nt, Artificial Sequence
  derived and/or modified CDS sequence (opt5) from HTNV(Aa09-1000)__KT935001.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccgagcaacaggugaacuuuguuugucaacggguggaugucgacauugugguguacugcaacggccagcgcaagguuauccugacgaagacacuugucaucgggcaguguauuuauaccaucaccucccuguucucucuccugcccggaguggcucacagcauugccguggaacugugcgucccuggcuuucauggcugggccacagcugcgcuccuggugaccuucuguuuuggguggguucuuauccccgccauuacauucaucauucugacgauccucaaauuuaucgcuaauauuuuccacaccuccaaccaagagaauagacuuaagagcgugcugcggaaaaucaaggaagaguuugagaaaacaaagggaucuauggucugcgauguguguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaacuucacccccggguguuaccggacacugaaucuguuucgcuauaagucuagaugcuacauuuucaccauguggaucuuucuccugguucuugaguccauucugugggcggcuagcgccucugagacgccucucacacccguguggaacgacaaugcccacggagucggcagcgugccuaugcauaccgaucuggaacuggacuucucccuuacauccucuuccaaguacaccuaucggagaaaacucaccaacccccuggaggaagcucagagcaucgaucugcacaucgagauugaggaacagacaaucgggguggacguccaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggaguuggcacagggugcaccgcgugcggacuguaccucgauagacugaaacccgugggcuccgccuacaagauuaucacgauucgcuauucucggagaguguguguccaguuuggggaagagaaucugugcaagaucaucgacaugaacgauuguuucgugagccgccauguuaaagugugcauuaucggcacagucuccaaguuuucucagggagacacccuucucuucuuuggcccucuggaagggggaggccugauuuucaaacacugguguaccagcacaugccaguuuggggauccgggagacaucaugagcccccgggauaagggcuuccucuguccugaguuccccgggagcuuuagaaagaagugcaauuucgcuaccacaccuauuugugaauacgacggcaacauggugucuggauauaaaaagguuauggccacgaucgauuccuuucagagcuucaauaccucuacaaugcauuuuaccgacgaacgcaucgaguggaaggaucccgacggcaugcugcgggaucacauuaacauccuugugacaaaagacauugacuucgauaaccugggggaaaauccuugcaagaucggacuccagaccuccagcauugagggcgcuugggggucuggagucggcuuuacgcugaccugucuggugucccuuacagagugccccaccuuccucacaagcaucaaagccugcgacaaggcgauuuguuacggggccgaauccguuacccugacaagaggccagaacaccgugaaagucagcggaaagggcgggcacucuggaagcacguuuaagugcugucauggcgaggauugcucccagaucgggcugcacgcugccgcuccgcaucucgacaaagugaauggaaucucugaaauggagaacagcaagguguaugaugacggcgccccucaauguggcauuaaaugcugguucgucaaguccggggaauggaucucuggaauuuuuagcggcaauuggaucguucugauugugcuuuguguguuccuccuguucucccugguccugcuuucuauccucugccccgugcgcaaacacaaaaagagcuga

SEQ ID NO: 13326 - RNA, 3408 nt, Artificial Sequence
  derived and/or modified CDS sequence (opt5) from HTNV(Aa09-948)__KT935000.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccugauuagcaaacagaaucgcuucagacucaccgagcagcaggucaacuuugugugucaacggguugauguggacaucgucguguacugcaacggccagcgcaaggugauccugacgaagacacuuguuauugggcaguguaucuauaccauuaccucccuguucucucuccugcccggagucgcucacagcaucgccguggaacugugcgugccuggcuuucauggcugggccacagcugcgcuccuggucaccuucuguuuugggugggugcuuauucccgccaucacauucauuauccugacgauccucaaauuuauugcuaauaucuuccacaccuccaaccaagagaauagacuuaagagcguucugcggaaaauuaaggaagaguuugagaaaacaaagggaucuauggugugcgaugucuguaaguacgaaugcgagaccuauaaagaacugaaggcccauggcguguccugcccucagagccagugucccuacugcuucacacacugugagccgaccgaagccgcuuuucaggcccauuauaaaguuugccaagugacgcaccgcuucagagacgaucucaagaaaaccgucacaccucagaacuucacccccggguguuaccggacacugaaucuguuucgcuauaagucuagaugcuacaucuucaccauguggauuuuucuccuggugcuugaguccauccugugggcggcuagcgccucugagacgccucucacacccguuuggaacgacaaugcccacggagugggcagcgucccuaugcauaccgaucuggaacuggacuucucccuuacauccucuuccaaguacaccuaucggagaaaacucaccaacccccuggaggaagcucagagcaucgaucugcacauugagaucgaggaacagacaauugggguggacgugcaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggagucggcacagggugcaccgcgugcggacuguaccucgauagacugaaacccguuggcuccgccuacaagaucauuacgauccgcuauucucggagagugugugugcaguuuggggaagagaaucugugcaagaucauugacaugaacgauuguuucgucagccgccaugugaaaguuugcaucauuggcacaguguccaaguuuucucagggagacacccuucucuucuuuggcccucuggaagggggaggccugaucuucaaacacugguguaccagcacaugccaguuuggggauccgggagacauuaugagcccccgggauaagggcuuccucuguccugaguuccccgggagcuuuagaaagaagugcaauuucgcuaccacaccuaucugugaauacgacggcaacauggucucuggauauaaaaaggugauggccacgaucgauuccuuucagagcuucaauaccucuacaaugcauuuuaccgacgaacgcauugaguggaaggaucccgacggcaugcugcgggaucacaucaacauucuuguuacaaaagacaucgacuucgauaaccugggggaaaauccuugcaagauuggacuccaaaccuccagcaucgagggcgcuugggggucuggagugggcuuuacgcugaccugucuggucucccuuacagagugccccaccuuccucacaagcauuaaagccugcgacaaggcgaucuguuacggggccgaauccgugacccugacaagaggccagaacaccguuaaagugagcggaaagggcgggcacucuggaagcacguuuaagugcugucauggcgaggauugcucccagaucgggcugcacgcugccgcuccgcaucucgacaaagucaauggaauuucugaaauggagaacagcaagguguaugaugacggcgccccucaauguggcaucaaaugcugguucgugaaguccggggaauggauuucuggaaucuuuagcggcaauuggauuguccugaucguucuuuguguguuccuccuguucucccuggugcugcuuucuauccucugccccguccgcaaacacaaaaagagcuga

SEQ ID NO: 13327 - RNA, 3408 nt, Artificial Sequence
  derived and/or modified CDS sequence (opt5) from HTNV(Aa10-434)__KT935004.1__GP
augggcaucuggaaguggcuggugauggccagccucgucuggcccguucugacccuuagaaacguguacgacaugaagauugagugcccucacacaguguccuucgggggaaauucugucaucggcuauguggaacugccgcccaugccucucgcugauacggcccagcugguucccgagagcuccuguucuauggacaaccaucaaagccuuaauaccauuacaaaguacacccagguguccuggcgggggaaagcggaucagucucagagcucccaaaucagcuuugaaacagucucuaccgagguggaccugaagggaacaugcguucucaaacacaagaugguggaagaguccuaucgcagcagaaagucuauuaccuguuacgaucuguccugcaacagcacguauuguaaaccuacccuguacaugaucguccccauccaugcuugcaauaugaugaagucuugucucauugcccugggcccuuaucggguccaggugguguacgagcgcacauacugcaugaccgggguucuuaucgaaggaaaauguuucgugccggaccaguccguggucagcauuaucaagcacggcauuuuugauaucgccuccgugcauauuguuugcuucuuuguggcugucaaaggcaacacauauaagaucuucgaacaggugaagaaaucuuuugagagcaccuguaaugacacggagaacaagguucaaggguacuauaucugcauugugggaggcaauuccgcccccaucuacgucccuacacuggaugacuucagaagcauggaggcuuuuaccgggauuuuccggucuccccacggagaagaucacgaccucgccggcgaggaaacagcgaccuauuccaucguggggccugccaacgcuaaagucccccauagcgccucuagcgauacccugucccuuauugcuuuuucuggaaucccgagcuacuccagccugucuauccucacauccagcacggaggccaagcacguguucucuccuggccuguuucccaaacugaaucauaccaacugcgacaagggcgcgauuccucucauguggacagggaugaucgaccugcccggauauuacgaagccauucaccccuguaccguuuucugcgugcuuuccggcccuggggcuagcugugaggccuucuccgagggaggcaucuuuaauauuacaucuccgaugugccuggucagcaaacagaaccgcuucagacucaccgaacaacaggugaauuuuguuugucaacggguggaugucgacaucgugguguacugcaacgggcagcgcaagguuauccugacgaagacacuugucauuggacaguguaucuauaccauuaccucccuguucucucuccugcccggcguggcucacagcaucgccguggagcugugcgucccuggcuuucaugggugggccacagcugcgcuccuggugaccuucuguuuuggauggguucuuauucccgccaucacauucauuauccugacgauccucaaauuuauugcuaacaucuuccacaccuccaaucaagaaaacagacucaagagcgugcuucggaaaauuaaggaggaauuugagaaaacaaagggcucuauggucugcgauguguguaaguacgagugcgaaaccuauaaagagcugaaggcccaugggguuuccugcccucagagccagugucccuacugcuucacacacugugaaccgaccgaggccgcuuuucaggcccauuauaaagugugccaagucacgcaccgcuucagagacgaucucaagaaaaccgugacaccucagaauuucacccccggauguuaccggacacugaaccuguuucgcuauaagucuagaugcuacaucuucaccauguggauuuuucuccugguucuugaauccauccugugggcggcuagcgccucugagacgccucucacacccguguggaaugacaacgcccacggcgucgggagcgugccuaugcauaccgaucuggagcuggacuucucccuuacauccucuuccaaguacaccuaucggagaaaacucaccaauccccuggaagaggcucagagcaucgaucugcacauugaaaucgaggagcagacaauuggcguggacguccaugcccucggacacugguuugauggccgccugaaccuuaagacguccuuccacuguuacggggcuugcaccaaauaugaauacccguggcauacagccaagugucacuaugagcgggacuaccaauaugaaaccucuuggggaugcaauccuagcgacugucccggcguugggacaggaugcaccgcgugcggccuguaccucgauagacugaaacccgugggguccgccuacaagaucauuacgauccgcuauucucggagaguguguguccaguuuggcgaggaaaaccugugcaagaucauugacaugaaugauuguuucgugagccgccauguuaaagugugcaucauuggaacaaucuccaaguuuucucagggcgacacccuucucuucuuugggccucuggagggaggcgggcugauuuucaaacacugguguaccagcacaugccaguuuggagauccgggcgacaucaugagcccccgggauaagggguuccucuguccugaguuccccggcagcuuuagaaagaagugcaacuucgcuaccacaccuaucugugaauacgacggaaauauggucucuggcuauaaaaaggugauggccacgauugauuccuuucagagcuucaacaccucuacaaugcauuuuaccgacgagcgcaucgaauggaaggaucccgacgggaugcugcgggaucacauuaauauccuuguuacaaaagacauugacuucgauaaccugggagagaacccuugcaagaucggccuccaggcuuccagcauugaaggggccuggggaucuggcgugggguuuacccugacgugucuggucucccuuaccgagugccccacauuccucaccagcaucaaagcgugcgacaaggccaucuguuacggcgcugaguccgugacacugaccagaggacagaauacaguuaaagugagcggcaaagggggacacucuggcagcaccuuuaagugcugucauggggaagauugcucccagauuggacugcacgccgcugccccgcaucucgacaaagucaacggcaucucugagauggaaaauagcaagguguaugaugacggcgccccucaaugugggauuaaaugcugguucgugaaguccggagaguggaucucuggcauuuuuagcgggaacuggaucguccugaucguucuuuguguguuccugcuguucucccuggugcugcuuucuauucucugccccguccgcaaacacaaaaagagcuga

SEQ ID NO: 13328 - RNA, 3408 nt, Artificial Sequence
  derived and/or modified CDS sequence (opt5) from HTNV(Aa10-518)__KT935005.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacgaagaauaaaguucaaggcuacuauaucugcaucgucgggggaaacuccgcccccauuuacgugccuacacuggaugacuucagaagcauggaggcuuuuaccggcaucuuccggucuccccacggggaagaucacgaccucgccggagaggaaacagcgaccuauuccauugugggcccugccaaugcuaaggucccccauagcgccucuagcgauacccugucccuuaucgcuuuuucugggauuccgagcuacuccagccugucuauccucacauccagcacggaggccaaacacguguucucuccuggacuguuucccaagcugaaccauaccaauugcgacaaaggcgcgaucccucucauguggacaggcaugauugaccugcccggguauuacgaagccauccaccccuguaccguuuucugcgugcuuuccggaccuggcgcuagcugugaggccuucuccgaagggggaauuuuuaacaucacaucuccgaugugccuggucagcaagcagaaucgcuucagacucaccgagcaacaggugaacuuuguuugucaacggguggaugucgacauugugguguacugcaacggccagcgcaagguuauccugacgaaaacacuugucaucgggcaguguauuuauaccaucaccucccuguucucucuccugcccggaguggcucacagcauugccguggagcugugcgucccuggcuuucauggcugggccacagcugcgcuccuggugaccuucuguuuuggguggguucuuauccccgccauuacauucaucauucugacgauccucaaguuuaucgcuaauauuuuccacaccuccaaccaagaaaauagacugaaaagcgugcuucggaagaucaaagaggaauuugagaagacaaagggaucuauggucugcgauguguguaaauacgagugcgaaaccuauaaggagcugaaagcccauggcguuuccugcccucagagccagugucccuacugcuucacacacugugaaccgaccgaggccgcuuuucaggcccauuauaaggugugccaagucacgcaccgcuucagagacgaucucaaaaagaccgugacaccucagaacuucacccccggguguuaccggacacugaaucuguuucgcuauaagucuagaugcuacauuuucaccauguggaucuuucuccugguucuugaauccauucugugggcggcuagcgccucugagacgccucucacacccguguggaacgacaaugcccacggagucggcagcgugccuaugcauaccgaucuggagcuggacuucucccuuacauccucuuccaaauacaccuaucggagaaagcucaccaacccccuggaagaggcucagagcaucgaucugcacaucgaaauugaggagcagacaaucgggguggacguccaugcccucggccacugguuugauggacgccugaaucuuaaaacguccuuccacuguuacggcgcuugcaccaaguaugaauacccguggcauacagccaaaugucacuaugagcgggacuaccaauaugaaaccucuugggggugcaacccuagcgacugucccggaguuggcacagggugcaccgcgugcggacuguaccucgauagacugaagcccgugggcuccgccuacaagauuaucacgauucgcuauucucggagaguguguguccaguuuggggaggaaaaucugugcaaaaucguggacaugaacgauuguuucguuagccgccaugugaaggucugcaucauuggcacaguguccaaauuuucucagggagacacccuucucuucuuuggcccucuggaagggggaggccugaucuucaagcacugguguaccagcacaugccaguuuggggauccgggagacauuaugagcccccgggauaaaggcuuccucuguccugaguuccccgggagcuuuagaaagaaaugcaauuucgcuaccacaccuaucugugaguacgacggcaacaugguuucuggauauaagaaggugauggccacgauugauuccuuucagagcuucaauaccucuacaaugcauuuuaccgacgagcgcaucgaauggaaagaucccgacggcaugcugcgggaucacaucaacauucuugucacaaaggacaucgacuucgauaaccugggggagaauccuugcaaaauuggacuccagaccuccagcaucgaaggcgcuugggggucuggagugggcuuuacgcugaccugucugguuucccuuacagagugccccaccuuccucacaagcauuaaggccugcgacaaagcgaucuguuacggggccgaguccgugacccugacaagaggccagaacaccgucaaggugagcggaaagggcgggcacucuggaagcacguuuaaaugcugucauggcgaagauugcucccagauugggcugcacgcugccgcuccgcaucucgacaaggugaauggaaucucugagauggaaaacagcaaagucuaugaugacggcgccccucaauguggcaucaagugcugguucguuaaauccggggaguggauuucuggaaucuuuagcggcaauuggauugugcugaucgugcuuugugucuuccuccuguucucccuggugcugcuuucuauucucugccccguucgcaagcacaagaaaagcuga

SEQ ID NO: 13329 - RNA, 3408 nt, Artificial Sequence
  derived and/or modified CDS sequence (opt5) from HTNV(Aa10-561)__KT935006.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaucagcuuugagacagucucuaccgaaguggaccugaaggggacaugcguucucaaacacaagaugguggaggaguccuaucgcagcagaaagucuauuaccuguuacgaucuguccugcaacagcacguauuguaaaccuacccuguacaugaucguccccauccaugcuugcaauaugaugaagucuugucucauugcccugggaccuuaucggguccaggugguguacgaacgcacauacugcaugaccggcguucuuaucgaggggaaauguuucgugccggaccaguccguggucagcauuaucaagcacggaauuuuugauaucgccuccgugcauauuguuugcuucuuuguggcugucaaaggcaacacauauaagaucuucgaacaggugaagaaaucuuuugagagcaccuguaaugacacggagaacaagguucaaggcuacuauaucugcauugucgggggaaauuccgcccccaucuacgugccuacacuggaugacuucagaagcauggaggcuuuuaccggcauuuuccggucuccccacggggaggaucacgaccucgccggagaagagacagcgaccuauuccaucgugggcccugccaacgcuaaagucccccauagcgccucuagcgauacccugucccuuauugcuuuuucugggaucccgagcuacuccagccugucuauccucacauccagcacggaagccaagcacguguucucuccuggacuguuucccaaacugaaucauaccaacugcgacaagggcgcgauuccucucauguggacaggcaugaucgaccugcccggguauuacgaggccauucaccccuguaccguuuucugcgugcuuuccggaccuggcgcuagcugugaggccuucuccgaagggggaaucuuuaauauuacaucuccgaugugccuggucagcaaacagaaccgcuucagacucaccgagcaacaggugaauuuuguuugucaacggguggaugucgacaucgugguguacugcaacggccagcgcaagguuauccugacgaagacacuugucauugggcaguguaucuauaccauuaccucccuguucucucuccugcccggaguggcucacagcaucgccguggaacugugcgucccuggcuuucauggcugggccacagcugcgcuccuggugaccuucuguuuuggguggguucuuauucccgccaucacauucauuauccugacgauccucaaauuuauugcuaacaucuuccacaccuccaaucaagagaacagacuuaagagcgugcugcggaaaauuaaggaagaguuugagaaaacaaagggaucuauggucugcgauguguguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaauuucacccccggguguuaccggacacugaaccuguuucgcuauaagucuagaugcuacaucuucaccauguggauuuuucuccugguucuugaguccauccugugggcggcuagcgccucugagacgccucucacacccguguggaaugacaacgcccacggagucggcagcgugccuaugcauaccgaucuggaacuggacuucucccuuacauccucuuccaaguacaccuaucggagaaaacucaccaauccccuggaggaagcucagagcaucgaucugcacauugagaucgaggaacagacaauugggguggacguccaugcccucggccacugguuugauggacgccugaaccuuaagacguccuuccacuguuacggcgcuugcaccaaauaugaguacccguggcauacagccaagugucacuaugaacgggacuaccaauaugagaccucuugggggugcaauccuagcgacugucccggaguuggcacagggugcaccgcgugcggacuguaccucgauagacugaaacccgugggcuccgccuacaagaucauuacgauccgcuauucucggagaguguguguccaguuuggggaagagaaccugugcaagaucauugacaugaaugauuguuucgugagccgccauguuaaagugugcaucauuggcacaaucuccaaguuuucucagggagacacccuucucuucuuuggcccucuggaagggggaggccugauuuucaaacacugguguaccagcacaugccaguuuggggauccgggagacaucaugagcccccgggauaagggcuuccucuguccugaguuccccgggagcuuuagaaagaagugcaacuucgcuaccacaccuaucugugaauacgacggcaauauggucucuggauauaaaaaggugauggccacgauugauuccuuucagagcuucaacaccucuacaaugcauuuuaccgacgaacgcaucgaguggaaggaucccgacggcaugcugcgggaucacauuaauauccuuguuacaaaagacauugacuucgauaaccugggggaaaacccuugcaagaucggacuccaggcuuccagcauugagggcgccugggggucuggagugggcuuuacccugacgugucuggucucccuuaccgagugccccacauuccucaccagcaucaaagcgugcgacaaggccaucuguuacggggcugaauccgugacacugaccagaggccagaauacaguuaaagugagcggaaagggcgggcacucuggaagcaccuuuaagugcugucauggcgaggauugcucccagauugggcugcacgccgcugccccgcaucucgacaaagucaacggaaucucugaaauggagaauagcaagguguaugaugacggcgccccucaauguggcauuaaaugcugguucgugaaguccggggaauggaucucuggaauuuuuagcggcaacuggaucguccugaucguucuuuguguguuccuccuguucucccuggugcugcuuucuauucucugccccguccgcaaacacaaaaagagcuga

SEQ ID NO: 13330 - RNA, 3408 nt, Artificial Sequence
  derived and/or modified CDS sequence (opt5) from HTNV(Aa14-172)__KT935008.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucacggauaccgcucagcugguucccgaaagcuccuguucuauggacaaccaucaaagccuuaauacaauuaccaaguacacacagguguccuggcggggcaaagccgaucagucucagagcucccaaaacagcuuugagaccgucucuacagaaguggaccugaaggggaccugcguucucaaacacaagaugaucgaggaguccuaucgcagcagaaagucuauuacguguuacgaucuguccugcaauaacaccuauuguaaaccuacacuguacaugaucgugcccauccaugcgugcaauaugaugaaaagcugucucauugcucugggaccuuaucggguccaggugguguacgaacgcaccuacugcaugacaggcguccuuaucgaggggaaauguuucguuccggaccagucugugguguccauuaucaagcacggaauuuuugauaucgccagcguccauauugugugcuucuuuguugccgugaaaggcaacaccuauaagaucuucgaacaggucaagaaauccuuugagucuacguguaaugacacagagaacaaggugcaaggcuacuauaucugcauuguugggggaaauagcgcucccaucuacgugccuacccuggaugacuucagauccauggaagccuuuacaggcauuuuccggagcccccacggggaggaucacgaccucgcuggagaagagaccgccaccuauucuaucgucggcccugcgaacgccaaagugccccauuccgcuagcucugauacacugagccuuauugccuuuuccgggaucccgucuuacagcucccugagcauccucacgucuuccaccgaagcuaagcacgucuucagcccuggacuguuucccaaacugaaucauacaaacugcgacaagggcgccauuccucucauguggaccggcaugaucgaccugcccggguauuacgaggcgauucaccccuguacaguguucugcguucuuucuggaccuggcgccuccugugaggcuuucagcgaagggggaaucuuuaauauuaccuccccgaugugccuggugucuaaacagaaccgcuucagacucacggagcagcaggucaacuuugugugucaacggguugauguggacaucgucguguacugcaauggccagcgcaaggugauccugacaaagacccuuguuauugggcaguguaucuauaccauuacaagccuguucucccuccugcccggagucgcccacucuaucgcuguggaacugugcgugccuggcuuucauggcugggccaccgccgcucuccuggucacauucuguuuugggugggugcuuauucccgcgaucacguucauuauccugaccauccucaaauuuauugccaacaucuuccacacaagcaaucaagagaacagacugaaguccguucuucggaaaauuaaggaagaguuugagaaaaccaagggaagcauggugugcgaugucuguaaguacgaaugcgagacauauaaagaacugaaggcucauggcgugucuugcccucagucccagugucccuacugcuucacccacugugagccgacggaagccgccuuucaggcucauuauaaaguuugccaagugacccaccgcuucagagacgaucucaagaaaacagucaccccucagaauuucacacccggguguuaccggacccugaaccuguuucgcuauaagagcagaugcuacaucuucacgauguggauuuuucuccuggugcuugagucuauccugugggccgcguccgcuagcgagacaccucucacccccguuuggaaugacaacgcccacggagugggcucugucccuaugcauacagaucuggaacuggacuucagccuuaccuccagcucuaaguacaccuaucggagaaaacucacaaauccccuggaggaagcccaguccaucgaucugcacauugagaucgaggaacagacgauugggguggacgugcaugcucucggccacugguuugauggacgccugaaccuuaagaccagcuuccacuguuacggcgccugcacaaaauaugaguacccguggcauaccgcuaagugucacuaugaacgggacuaccaauaugagacauccugggggugcaauccuucugacugucccggagucggcaccgggugcacggccugcggacuguaccucgauagacugaaacccguuggcagcgcguacaagaucauuacaauccgcuauucccggagagugugugugcaguuuggggaagagaaccugugcaagaucauugacaugaaugauuguuucgucucucgccaugugaaaguuugcaucauuggcaccgugagcaaguuuucccagggagacacccuucucuucuuuggcccucuggaagggggaggccugaucuucaaacacugguguacaucuaccugccaguuuggggauccgggagacauuaugagcccccgggauaagggcuuccucuguccugaguuccccggguccuuucgcaaaaagugcaacuucgccacaacgccuaucugugaguacgacggcaauauggucagcggauauaaaaaggugauggcuaccaucgauucuuuucaauccuucaacacaagcaccaugcauuuuacagacgaaagaauugaguggaaggaucccgacggcaugcugcgggaucacaucaacauucuuguuaccaaagacaucgacuucgauaaucugggggaaaacccuugcaagauuggacuccagacgucuuccaucgagggcgccugggggagcggagugggcuuuacccugacaugucuggucucucuuaccgagugccccacauuccucaccuccauuaaggcuugcgacaaggccaucuguuacggggcggaaagcgugacacugaccagaggccagaauacgguuaaaguguccggaaagggcgggcacagcggaucuacauuuaagugcugucauggcgaggauugcagccagaucgggcugcacgccgcugccccgcaucucgacaaagucaacggaauuuccgaaguggaaaauucuaagguguaugaugacggcgcuccucaauguggcaucaaaugcugguucgucaagagcggggaguggauuuccggaaucuuuucuggcaacuggauuguucugaucgugcuuuguguguuccuccuguucagccugguccugcuuuccauccucugccccgugcgcaaacacaagaagucuuga

SEQ ID NO: 13331 - RNA, 3408 nt, Artificial Sequence
  derived and/or modified CDS sequence (opt5) from HTNV(Aa14-266)__KT935013.1__GP
augggcaucuggaaguggcuggugauggccagccucgucuggcccguucugacccuuagaaacguguacgacaugaagauugagugcccucacacaguguccuucggggaaaauucugucaucggauauguggagcugccgcccaugccucucgcugauacggcccagaugguucccgaaagcuccuguucuauggacaaccaucaaagccugaauaccauuacaaaguacacccagguguccuggcggggcaaagcggaucagucucagagcaaccaaaauuccuuugagacagucagcaccgaaguggaccuuaaggggacaugcguucugaaacacaagaugguggaggagucuuaucgcuccagaaagagcaucaccuguuacgaucucucuugcaacuccacguauuguaaaccuacccuguacaugauuguccccauccaugcuugcaauaugaugaaaagcugucugaucgcccucggaccuuaucggguccaggugguguacgaacgcacauacugcaugaccggcguucugauugaggggaaguguuucgugccggaccagucuguggucuccaucauuaagcacggaaucuuugauauugccagcgugcauaucguuugcuucuuuguggcugucaaaggcaacacauauaagauuuucgaacaggugaagaaauccuuugagucuaccuguaaugacacggagaacaagguucaaggcuacuauaucugcaucgucgggggaaauagcgcccccauuuacgugccuacacuugaugacuucagauccauggaggcuuuuaccggcaucuuccggagcccccacggggaagaucacgaccuggccggagaagagauugcgacauauucuaucgugggcccugccaacgcuaaagucccccauuccgccagcucugauacccucagccugauugcuuacuccgggaucccgucuuauagcucccuuagcauccugaccucuuccacagaagccaagcacguguuuagcccuggacucuuccccaaacugaaucauacgaacugcgacaagucugcgauuccucugauguggaccggcaugaucgaccuccccggcuacuacgaggccguucaccccuguacaguguuuugcguccuguccgggccuggagcuagcugugaggccuucuccgaaggcgggauuuucaauaucaccucuccgaugugccuugugagcaaacagaaccgcuuuagacugacagagcagcagguuaacuucgugugucaacgggucgauguggacauugugguuuauugcaauggacagcgcaaggucauccucaccaagacgcuggugaucggccaguguauuuacacaaucaccucccuuuucucucugcuccccgggguggcucacagcauugccgucgaacugugcgugccuggauuccauggcugggccaccgcugcgcugcucguuacauuuuguuucggcugggugcugauccccgccauuaccuuuaucauucuuacaauccugaaauucaucgcuaacauuuuucacacguccaaucaagagaacagacucaagagcguccugcggaaaaucaaggaagaguucgagaaaaccaaggggucuauggugugcgauguuuguaaguaugaaugcgagacauacaaagaacuuaaggcccauggaguguccugcccucagagccagugucccuauugcuuuacccacugugagccgacagaagccgcuuuccaggcccauuacaaagucugccaagugacccaccgcuuuagagacgaucugaagaaaacgguuaccccucagaauuucacacccggcuguuaucggacccucaaccuguuccgcuacaagucuagaugcuacauuuuuacaauguggaucuuccugcucgugcuggaguccauucuuugggcggcuagcgccucugagaccccucugacgcccgucuggaaugacaacgcccacggggugggaagcgugccuaugcauacagaucucgaacuggacuuuucccugaccuccucuuccaaguauacauaccggagaaaacuuaccaauccccucgaggaagcucagagcaucgaucugcacaucgagauugaggaacagaccaucggcgucgacguucaugcccuggggcacugguucgauggccgccucaaccugaagacauccuuucacuguuauggagcuugcacgaaauacgaguauccguggcauaccgccaagugucacuacgaacgggacuaucaauacgagacaucuuggggcugcaauccuagcgacugucccggggugggaaccggcugcacagcgugcgggcuuuaccuggaucagcucaaacccgugggauccgccuauaagauuaucaccauuagauacucucgccgggucugugugcaguucggcgaagagaaccugugcaagacgaucgacaugaaugauuguuuuguuagcagacaugugaaagucugcaucauugggacaguguccaaguucucucagggcgacacccugcucuuuuucggaccucuugagggcgggggacugaucuuuaaacacugguguaccagcacaugccaauucggcgauccgggggacauuaugagcccccgcgauaagggauuucuguguccugaauuucccggcagcuuccggaaaaagugcaacuuugcuaccacaccuaucugugaguaugacgggaauaugguuucuggcuacaaaaaggugauggccacgauugauuccuuccagagcuuuaacaccucuacaaugcauuucaccgacgaaagaaucgaguggaaggaucccgacggaaugcuccgcgaucacaucaacauucuggucacaaaagacaucgacuuugauaaucuuggcgaaaacccuugcaagauugggcugcagaccuccagcaucgagggagcuuggggcucuggggugggauucacgcucaccugucugguuucccugacagagugccccaccuuucuuacaagcauuaaagccugcgacaaggcgaucuguuauggcgccgaauccgugacccucacacgggggcagaauaccgucaaagugagcggcaagggaggccacucugggagcacguucaagugcugucauggagaggauugcucccaaauuggccugcacgcugccgcuccgcaucuggacaaagugaacgggaucucugaaauggagaauagcaaggucuacgaugacggagccccucaguguggcaucaaaugcugguuuguuaaguccggcgaauggauuucugggaucuucagcggaaacuggauugugcucaucgugcugugugucuuucuucuguucucccucgugcugcugucuauucuuugccccguuagaaaacacaaaaagagcuga

SEQ ID NO: 13332 - RNA, 3408 nt, Artificial Sequence
  derived and/or modified CDS sequence (opt5) from HTNV(Aa14-272)__KT935014.1__GP
augggcaucuggaaguggcuggugauggccagccucgucuggcccguucugacccuuagaaacguguacgacaugaagauugagugcccucacacaguguccuucggggaaaauucugucaucggauauguggagcugccgcccaugccucucgcugauacggcccagaugguucccgaaagcuccuguucuauggacaaccaucaaagccugaauaccauuacaaaguacacccagguguccuggcggggcaaagcggaucagucucagagcaaccaaaauuccuuugagacagucagcaccgaaguggaccuuaaggggacaugcguucugaaacacaagaugguggaggagucuuaucgcuccagaaagagcaucaccuguuacgaucucucuugcaacuccacguauuguaaaccuacccuguacaugauuguccccauccaugcuugcaauaugaugaaaagcugucugaucgcccucggaccuuaucggguccaggugguguacgaacgcacauacugcaugaccggcguucugauugaggggaaguguuucgugccggaccagucuguggucuccaucauuaagcacggaaucuuugauauugccagcgugcauaucguuugcuucuuuguggcugucaaaggcaacacauauaagauuuucgaacaggugaagaaauccuuugagucuaccuguaaugacacggagaacaagguucaaggcuacuauaucugcaucgucgggggaaauagcgcccccauuuacgugccuacacuugaugacuucagauccauggaggcuuuuaccggcaucuuccggagcccccacggggaagaucacgaccuggccggagaagagauugcgacauauucuaucgugggcccugccaacgcuaaagucccccauuccgccagcucugauacccucagccugauugcuuacuccgggaucccgucuuauagcucccuuagcauccugaccucuuccacagaagccaagcacguguuuagcccuggacucuuccccaaacugaaucauacgaacugcgacaagucugcgauuccucugauguggaccggcaugaucgaccuccccggcuacuacgaggccguucaccccuguacaguguuuugcguccuguccgggccuggagcuagcugugaggccuucuccgaaggcgggauuuucaauaucaccucuccgaugugccuugugagcaaacagaaccgcuuuagacugacagagcagcagguuaacuucgugugucaacgggucgauguggacauugugguuuauugcaauggacagcgcaaggucauccucaccaagacgcuggugaucggccaguguauuuacacaaucaccucccuuuuuagccugcuccccgggguggcucacagcauugccgucgaacugugcgugccuggauuccauggcugggccaccgcugcgcugcucguuacauuuuguuucggcugggugcugauccccgccauuaccuuuaucauucuuacaauccugaaauucaucgcuaacauuuuucacacguccaaucaagagaacagacucaagagcguccugcggaaaaucaaggaagaguucgagaaaaccaaggggucuauggugugcgauguuuguaaguaugaaugcgagacauacaaagaacuuaaggcccauggaguguccugcccucagagccagugucccuauugcuuuacccacugugagccgacagaagccgcuuuccaggcccauuacaaagucugccaagugacccaccgcuuuagagacgaucugaagaaaacgguuaccccucagaauuucacacccggcuguuaucggacccucaaccuguuccgcuacaagucuagaugcuacauuuuuacaauguggaucuuccugcucgugcuggaguccauucuuugggcggcuagcgccucugagaccccucugacgcccgucuggaaugacaacgcccacggggugggaagcgugccuaugcauacagaucucgaacuggacuuuucccugaccagcuccuccaaguauacauaccggagaaaacuuaccaauccccucgaggaagcucagagcaucgaucugcacaucgagauugaggaacagaccaucggcgucgacguucaugcccuggggcacugguucgauggccgccucaaccugaagacauccuuucacuguuauggagcuugcacgaaauacgaguauccguggcauaccgccaagugucacuacgaacgggacuaucaauacgagacaucuuggggcugcaauccuagcgacugucccggggugggaaccggcugcacagcgugcgggcuuuaccuggaucagcucaaacccgugggauccgccuauaagauuaucaccauuagauacucucgccgggucugugugcaguucggcgaagagaaccugugcaagaucaucgacaugaaugauuguuuuguuagcagacaugugaaagucugcauuaucgggacgguguccaaguucucucagggcgacacacugcuuuucuucggaccucucgagggcgggggacugauuuuuaaacacugguguaccucuaccugccaauucggcgauccgggggacaucaugucuccccgcgauaagggauuucuguguccugaauuucccggcagcuuccggaaaaagugcaacuuugcuacaaccccuauuugugaguaugacgggaauaugguuucuggcuacaaaaaggugauggccacaaucgauuccuuccagagcuuuaacacgucuaccaugcauuucacagacgaaagaaucgaguggaaggaucccgacggaaugcuccgcgaucacauuaacauccuggucaccaaagacauugacuuugauaaucuuggcgaaaacccuugcaagaucgggcugcagacauccagcauugagggagcuuggggcucuggggugggauucacccucacgugucugguuucccugaccgagugccccacauuucuuaccagcaucaaagccugcgacaaggcgauuuguuauggcgccgaauccgugacacucacccgggggcagaauacagucaaagugagcggcaagggaggccacucugggagcaccuucaagugcugucauggagaggauugcucccaaaucggccugcacgcugccgcuccgcaucuggacaaagugaacgggaucucugaaauggagaauagcaaggucuacgaugacggagccccucaguguggcauuaaaugcugguuuguuaaguccggcgaauggaucucugggauuuucagcggaaacuggaucgugcucauugugcugugugucuuucuucuguucucccucgugcugcugucuauccuuugccccguuagaaaacacaaaaagagcuga

SEQ ID NO: 13333 - RNA, 3408 nt, Artificial Sequence
  derived and/or modified CDS sequence (opt5) from HTNV(Aa14-362)__KT935015.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugaggcugucucuacagaaguggaccugaaggggaccugcguucucaaacacaagaugguggaggaguccuaucgcagcagaaagucuaucacauguuacgaucuguccugcaauagcaccuauuguaaaccuacgcuguacaugauuguccccauccaugccugcaacaugaugaagucuugucucaucgcccugggaccuuaucggguccaggugguguacgaacgcaccuacugcaugacaggcguucuuauugaggggaaauguuucgugccggaccaguccguggucagcaucauuaagcacggaaucuuugauauugcuuccgugcauaucguuugcuucuuuguggccgucaaaggcaauaccuauaagauuuucgaacaggugaagaaaucuuuugagagcacauguaacgacaccgagaauaagguucaaggcuacuauaucugcaucgucgggggaaacuccgcucccauuuacgugccuacgcuggaugacuucagaagcauggaagccuuuacaggcaucuuccggucuccccacggggaggaucacgaccucgcgggagaagagaccgccacauauuccauugugggcccugcuaaugccaaagucccccauagcgcuucuagcgauacccugucccuuaucgccuuuucugggauuccgagcuacuccagccugucuauccucaccuccagcacagaagcgaagcacguguucucuccuggacuguuucccaaacugaaccauacgaauugcgacaagggcgccaucccucucauguggaccggcaugauugaccugcccggguauuacgaggcuauccaccccuguacaguuuucugcgugcuuuccggaccuggcgccagcugugaggcuuucuccgaagggggaauuuuuaacaucaccucuccgaugugccuggucagcaaacagaaucgcuucagacucacagagcaacaggugaacuuuguuugucaacggguggaugucgacauuaucguguacugcaacggccagcgcaaggugauccugaccaagacgcuuguuauugggcaguguaucuauacaauuaccucccuguucucucuccugcccggagucgcccacagcaucgccguggaacugugcgugccuggcuuucauggcugggcuaccgcggcccuccuggucacauucuguuuugggugggugcuuauucccgcuaucaccuucauuauccugacaauccucaaauuuauugccaauaucuuccacacguccaaccaagagaauagacucaagagcguucuucggaaaauuaaggaagaguuugagaaaaccaagggaucuauggugugcgaugucuguaaguacgaaugcgagacauauaaagaacugaaggcccauggcguguccugcccucagagccagugucccuacugcuucacccacugugagccgacagaagcugccuuucaggcgcauuauaaaguuugccaagugacccaccgcuucagagacgaucucaagaaaacggucaccccucagaacuucacacccggguguuaccggacccugaaucuguuucgcuauaagucuagaugcuacaucuucacaauguggauuuuucuccuggugcuugaguccauccugugggcugccagcgccucugagaccccucucacgcccguuuggaacgacaaugcucacggagugggcagcgucccuaugcauacagaucuggaacuggacuucucccuuaccuccucuuccaaguacacauaucggagaaaacucaccaacccccuggaggaagcccagagcaucgaucugcacauugagaucgaggaacagaccauugggguggacgugcaugcucucggccacugguuugauggacgccugaaucuuaagacauccuuccacuguuacggcgccugcacgaaauaugaguacccguggcauaccgcgaagugucacuaugaacgggacuaccaauaugagacaucuugggggugcaacccuagcgacugucccggagucggcaccgggugcacagccugcggacuguaccucgauagacugaaacccguuggcuccgcuuacaagaucauuaccauccgcuauucucggagagugugugugcaguuuggggaagagaaucugugcaagaucauugacaugaacgauuguuucgucagccgccaugugaaaguuugcaucauuggcacgguguccaaguuuucucagggagacacacuucucuucuuuggcccucuggaagggggaggccugaucuucaaacacugguguaccucuaccugccaguuuggggauccgggagacauuaugagcccccgggauaagggcuuccucuguccugaguuccccgggagcuuuagaaagaagugcaauuucgccacaaccccuaucugugaguacgacggcaacauggucagcggauauaaaaaggugauggcuacaaucgauuccuuucagagcuucaauacgucuaccaugcauuuuacagacgaacgcauugaguggaaggaucccgacggcaugcugcgggaucacaucaacauucuuguuaccaaagacaucgacuucgauaaccugggggaaaauccuugcaagauuggacuccagacauccagcaucgagggcgccugggggucuggagugggcuuuacccugacgugucuggucucccuuaccgagugccccacauuccucaccagcauuaaagcgugcgacaaggccaucuguuacggggcugaauccgugacacugaccagaggccagaacacaguuaaagugagcggaaagggcgggcacucuggaagcaccuuuaagugcugucauggcgaggauugcucccagaucgggcugcacgccgcugccccgcaucucgacaaagucaauggaauuucugaaauggagaacagcaagguguaugaugacggcgccccucaauguggcaucaaaugcugguucgugaaguccggggaauggauuucuggaaucuuuagcggcaauuggauuguccugaucguucuuuguguguuccugcuguucucccuggugcugcuuucuauccucugccccguccgcaaacacaaaaagagcuga

SEQ ID NO: 13334 - RNA, 3408 nt, Artificial Sequence
  derived and/or modified CDS sequence (opt5) from HTNV(Aa14-404)__KT935018.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagaugguucccgaaagcuccuguucuauggacaaccaucaaagccugaauaccauuacaaaguacacccagguguccuggcggggcaaagcggaucagucucagagcucccaaaacagcuuugagacagucucuaccgaaguggaccuuaaggggacaugcguucugaaacacaagaugguggaggaguccuaucgcagcagaaagucuaucaccuguuacgaucucuccugcaauagcacguauuguaaaccuacccuguacaugauuguccccauccaugcuugcaacaugaugaagucuugucugaucgcccucggaccuuaucggguccaggugguguacgaacgcacauacugcaugaccggcguucugauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuugaugacuucagaagcauggaggcuuuuaccggcaucuuccggucuccccacggggaagaucacgaccuggccggagaagagauugcgacauauuccaucgugggcccugccaaugcuaaagucccccauagcgccucuagcgauacccucucccugauugcuuacucugggaucccgagcuauuccagccuuucuauccugaccuccagcacagaagccaagcacguguuuucuccuggacucuuccccaaacugaaccauacgaauugcgacaaguccgcgauuccucugauguggaccggcaugaucgaccuccccggcuacuacgaggccguucaccccuguacaguguuuugcguccugagcgggccuggagcuuccugugaggccuucucugaaggcgggauuuucaacaucaccagcccgaugugccuuguguccaaacagaaucgcuuuagacugacagagcagcagguuaacuucgugugucaacgggucgauguggacauugugguuuauugcaacggacagcgcaaggucauccucaccaagacgcuggugaucggccaguguauuuacacaaucaccucucuuuuuagccugcuccccgggguggcucacuccauugccgucgaacugugcgugccuggauuccauggcugggccaccgcugcgcugcucguuacauuuuguuucggcugggugcugauccccgccauuaccuuuaucauucuuacaauccugaaauucaucgcuaauauuuuucacacgagcaaccaagagaauagacucaagucuguccugcggaaaaucaaggaagaguucgagaaaaccaagggguccauggugugcgauguuuguaaguaugaaugcgagacauacaaagaacuuaaggcccauggagugagcugcccucagucucagugucccuauugcuuuacccacugugagccgacagaagccaccuuccaggcucauuacaaagucugccaagugacgcaccgcuuuagagacgaucugaagaaaaccguuacaccucagaacuucacccccggcuguuaucggacacucaaucuguuccgcuacaaguccagaugcuacauuuuuaccauguggaucuuccugcucgugcuggagagcauucuuugggccgcgucugcuagcgagacgccucugacacccgucuggaacgacaaugcccacggggugggauccgugccuaugcauaccgaucucgaacuggacuuuagccugacaucuuccagcaaguauaccuaccggagaaaacuuaccaacccccucgaggaagcccaguccaucgaucugcacaucgagauugaggaacagacaaucggcgucgacguucaugcucuggggcacugguucgauggccgccucaaucugaagacgucuuuucacuguuauggagccugcaccaaauacgaguauccguggcauacagcuaagugucacuacgaacgggacuaucaauacgagaccagcuggggcugcaacccuuccgacugucccggggugggaacaggcugcaccgccugcgggcuuuaccuggaucagcucaaacccgugggaucugcguauaagauuaucacgauuagauacagccgccgggucugugugcaguucggcgaagagaaucugugcaagaucaucgacaugaacgauuguuuuguuuccagacaugugaaagucugcauuaucgggacagugucuaaguucagccagggcgacacccugcuguuuuucggaccucucgagggcgggggacugauuuuuaaacacugguguaccuccacaugccaauucggcgauccgggggacaucaugagcccccgcgauaagggauuucuguguccugaguuccccggcucuuuccggaaaaagugcaauuuugccaccacaccucucugugaauaugacgggaacaugguuuccggcuacaaaaaggugauggcuacgauugauagcuuccagucuuuuaauaccuccacaaugcauuucaccgacgaaagaaucgaguggaaggaucccgacggaaugcugcgcgaucacaucaacauucuugucacaaaagacaucgacuuugauaaccugggcgaaaauccuugcaagauugggcuccagaccagcucuaucgagggagccuggggcuccggggugggauucacgcugaccugucugguuagccuuacagagugccccaccuuucucacauccauuaaggcuugcgacaaagccaucuguuauggcgcggaaagcgugacccugacacgggggcagaacaccgucaaagugucuggcaagggaggccacagcggguccacguucaagugcugucauggagaggauugcucucaaauuggccugcacgccgcugccccgcaucucgacaaagugaaugggaucagcgaaauggagaacuccaaggucuacgaugacggagcuccucaguguggcaucaaaugcugguuuguuaagucuggcgaauggauuagcgggaucuucuccggaaauuggauugugcugaucgugcuuugugucuuucuucucuucucucuggugcugcuuagcauucucugccccguuagaaaacacaagaaguccuga

SEQ ID NO: 13335 - RNA, 3408 nt, Artificial Sequence
  derived and/or modified CDS sequence (opt5) from HTNV(Aa14-423)__KT935022.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagaugguucccgaaagcuccuguucuauggacaaccaucaaagccugaauaccauuacaaaguacacccagguguccuggcggggcaaagcggaucagucucagagcucccaaaacagcuuugagacagucucuaccgaaguggaccuuaaggggacaugcguucugaaacacaagaugguggaggaguccuaucgcagcagaaagucuaucaccuguuacgaucucuccugcaauagcacguauuguaaaccuacccuguacaugauuguccccauccaugcuugcaacaugaugaagucuugucugaucgcccucggaccuuaucggguccaggugguguacgaacgcacauacugcaugaccggcguucugauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuugaugacuucagaagcauggaggcuuuuaccggcaucuuccggucuccccacggggaagaucacgaccuggccggagaagagauugcgacauauuccaucgugggcccugccaaugcuaaagucccccauagcgccucuagcgauacccucucccugauugcuuacucugggaucccgagcuauuccagccuuucuauccugaccuccagcacagaagccaagcacguguuuucuccuggacucuuccccaaacugaaccauacgaauugcgacaaguccgcgauuccucugauguggaccggcaugaucgaccuccccggcuacuacgaggccguucaccccuguacaguguuuugcguccugagcgggccuggagcuuccugugaggccuucucugaaggcgggauuuucaacaucaccagcccgaugugccuuguguccaaacagaaucgcuuuagacugacagagcagcagguuaacuucgugugucaacgggucgauguggacauugugguuuauugcaacggacagcgcaaggucauccucaccaagacgcuggugaucggccaguguauuuacacaaucaccucucuuuuuagccugcuccccgggguggcucacuccauugccgucgaacugugcgugccuggauuccauggcugggccaccgcugcgcugcucguuacauuuuguuucggcugggugcugauccccgccauuacccuuaucauucugacaauccucaaauuuaucgcuaauauuuuccacacgagcaaccaagagaauagacugaagucuguccuucggaaaaucaaggaagaguuugagaaaaccaagggguccauggugugcgauguuuguaaguaugaaugcgagacauacaaagaacugaaggcccauggagugagcugcccucagucucagugucccuauugcuucacccacugugagccgacagaagccaccuuucaggcucauuacaaagucugccaagugacgcaccgcuucagagacgaucucaagaaaaccguuacaccucagaacuuuacccccggcuguuaucggacacugaaucuguuccgcuacaaguccagaugcuacauuuucaccauguggaucuuucuccuggugcuugagagcauucugugggccgcgucugcuagcgagacgccucucacacccgucuggaacgacaaugcccacggggugggauccgugccuaugcauaccgaucuggaacuggacuucagccuuacaucuuccagcaaguauaccuaccggagaaaacucaccaacccccuggaggaagcccaguccaucgaucugcacaucgagauugaggaacagacaaucggcgucgacguucaugcucucgggcacugguuugauggccgccugaaucuuaagacgucuuuccacuguuauggagccugcaccaaauacgaguauccguggcauacagcuaagugucacuacgaacgggacuaucaauacgagaccagcuggggcugcaacccuuccgacugucccggggugggaacaggcugcaccgccugcgggcuguaccucgaucagcugaaacccgugggaucugcguauaagauuaucacgauuagauacagccgccgggucugugugcaguuuggcgaagagaaucugugcaagaucaucgacaugaacgauuguuucguuuccagacaugugaaagucugcauuaucgggacagugucuaaguuuagccagggcgacacccuucucuucuuuggaccucuggagggcgggggacugauuuucaaacacugguguaccuccacaugccaauuuggcgauccgggggacaucaugagcccccgcgauaagggauuccucuguccugaauuucccggcucuuuccggaaaaagugcaauuucgccaccacaccucugugugaguaugacgggaacaugguuuccggcuacaaaaaggugauggcuacgauugauagcuuucagucuuucaauaccuccacaaugcauuuuaccgacgaaagaaucgaguggaaggaucccgacggaaugcuucgcgaucacaucaacauucuggucacaaaagacaucgacuucgauaaccucggcgaaaauccuugcaagauugggcugcagaccagcucuaucgagggagccuggggcuccggggugggauuuacgcugaccugucuuguuagccucacagagugccccaccuuccugacauccauuaaggcuugcgacaaagccaucuguuauggcgcggaaagcgugacccugacacgggggcagaacaccgucaaagugucuggcaagggaggccacagcggguccacguuuaagugcugucauggagaggauugcucucaaauuggccuccacgccgcugccccgcaucuggacaaagugaaugggaucagcgaaauggagaacuccaaggucuacgaugacggagcuccucaguguggcaucaaaugcugguucguuaagucuggcgaauggauuagcgggaucuuuuccggaaauuggauugugcuuaucgugcugugugucuuccuccuguuuucucuggugcuucucagcauucugugccccguuagaaaacacaagaaguccuga

SEQ ID NO: 13336 - RNA, 3408 nt, Artificial Sequence
  derived and/or modified CDS sequence (opt5) from HTNV(Aa15-56)__KU207187.1__GP
augggcaucuggaaguggcuggugauggccagccucgucuggcccguucugacccuuagaaacguguacgacaugaagauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggcgcaaagcggaucagucucagagcucccaaaacagcuuugagacagucucuaccgaaguggaccugaagggcacaugcguucucaaacacaagaugguggaggaguccuauagaagccggaagucuaucaccuguuacgaucuguccugcaauagcacguauuguaaaccuacccuguacaugauuguccccauccaugcuugcaacaugaugaagucuugucucaucgcccuggggccuuaucgcguccaggugguguacgaaagaacauacugcaugaccggagcccuuauugagggcaaauguuucguuccggaccaguccguggugagcaucauuaagcacgggaucuuugauauugcuuccguccauaucgugugcuucuuuguugccgugaaaggaaauacauauaagauuuucgaacaggucaagaaaucuuuugagagcaccuguaacgacacggagaauaaggugcaaggcuacuauaucugcaucguuggcgggaacuccgcucccauuuacgugccuacacuggaugacuuccggagcauggaagccuuuaccggaaucuuccgcucuccccacggcgaggaucacgaccucgcgggggaagagacagccaccuauuccauugucggaccugcuaaugccaaagugccccauagcgcuucuagcgauacccugucccuuaucgccuuuucuggcauuccgagcuacuccagccugucuauccucacauccagcacggaagcgaagcacgucuucucuccugggcuguuucccaaacugaaccauaccaauugcgacaagggagccaucccucucauguggacaggcaugauugaccugcccggcuauuacgaggcuauccaccccuguaccguguucugcguucuuuccgggccuggagccagcugugaggcuuucuccgaaggcgggauuuuuaacaucacaucuccgaugugccuggugagcaaacagaauagauuccggcucaccgagcagcaggucaacuuugugugucaacgcguugauguggacauugucguguacugcaacggacagagaaaggugauccugacgaagacacuuguuaucggccaguguauuuauaccaucaccucccuguucucucuccugcccggggucgcccacagcauugccguggaacugugcgugccuggauuucauggcugggcuacagcggcccuccuggucaccuucuguuuuggcugggugcuuauccccgcuauuacauucaucauucugacgauccucaaauuuaucgccaauauuuuccacaccuccaaccaagagaaucggcucaagagcguucuucgcaaaaucaaggaagaguuugagaaaacaaaggggucuauggugugcgaugucuguaaguacgaaugcgagaccuauaaagaacugaaggcccauggaguguccugcccucagagccagugucccuacugcuucacacacugugagccgaccgaagcugccuuucaggcgcauuauaaaguuugccaagugacgcacagauuccgggacgaucucaagaaaaccgucacaccucagaacuucacccccggcuguuaccgcacacugaaucuguuuagauauaagucucggugcuacauuuucaccauguggaucuuucuccuggugcuugaguccauucugugggcugccagcgccucugagacgccucucacacccguuuggaacgacaaugcucacggggugggaagcgucccuaugcauaccgaucuggaacuggacuucucccuuacaagcagcuccaaguacaccuauagacgcaaacucaccaacccccuggaggaagcccagagcaucgaucugcacaucgagauugaggaacagacaaucggcguggacgugcaugcucucgggcacugguuugauggccggcugaaucuuaagacguccuuccacuguuacggagccugcaccaaauaugaguacccguggcauacagcgaagugucacuaugaaagagacuaccaauaugagaccucuuggggcugcaacccuagcgacugucccggggucggaacaggcugcaccgccugcgggcuguaccucgaucgccugaaacccguuggauccgcuuacaagauuaucacgauucgguauucuagacgcgugugugugcaguuuggcgaagagaaucugugcaagaucaucgacaugaacgauuguuucgucagccggcaugugaaaguuugcauuaucgggacaguguccaaguuuucucagggcgacacccuucucuucuuuggaccucuggagggcgggggacugauuuucaaacacugguguaccagcacaugccaguuuggcgauccgggggacaucaugucccccagagauaagggauuccucuguccugaguuccccggcagcuuucgcaaaaagugcaauuucgccaccacaccuauuugugaauacgacgggaacauggucucuggcuauaaaaaggugauggcuacgaucgauuccuuucaaucuuucaauaccucuacaaugcauuuuaccgacgaacggaucgaguggaaggaucccgacggaaugcugagagaucacauuaacauccuuguuacaaaagacauugacuucgauaaccugggcgaaaauccuugcaagaucgggcuccagaccuccagcauugagggagccuggggcucuggggugggauuuacgcugaccugucuggucucccuuacagagugccccaccuuccucacaagcaucaaagcgugcgacaaggccauuuguuacggcgcugaauccgugacccugacacgcgggcagaacaccguuaaagugagcggcaagggaggccacucugggagcacguuuaagugcugucauggagaggauugcucccagaucggccugcacgccgcugccccgcaucucgacaaagucaaugggaucucugaaauggagaacagcaagguguaugaugacggagccccucaauguggcauuaaaugcugguucgugaaguccggcgaauggaucucugggauuuuuagcggaaauuggaucguccugauuguucuuuguguguuccugcuguucucccuggugcugcuuucuauccucugccccguccggaaacacaaaaagagcuga

SEQ ID NO: 13337 - RNA, 3408 nt, Artificial Sequence
  derived and/or modified CDS sequence (opt5) from HTNV(CBAa11-106)__KC576787.1__GP
augggcauguggaaguggcuggugaucgccagccucgucuggcccgcccugacccuuagaaacguuuacgacaugaaaauugagugcccucacacaguguccuucggggaaaauucugugaucggauaugucgagcugccgcccaugccucucgccgauacggcgcagauggugcccgaaagcuccuguucuauggacaaccaucaaagcaugaauaccauuacaaaguacacccagguuaucuggcggggcaaagcugauccugggcaguccucucagaacagcuuugagacaguguccaccgaaauugaccugaagggaacaugcguccuuaaacacaagaugguggaggagagcuaucgcucuagaaaguccaucaccuguuacgaucugagcugcaauucuacguauuguaaacccacccucuacaugaucguuccuauucaugccugcaacaugaugaaguccugucugaucgcccugggcccguaucgggugcaagucguguacgaacgcacauacugcaugaccggggugcucauugagggaaaauguuucguccccgaccagagcguugugucuaucauuaagcacggcaucuuugauauugcuuccgugcauaucgucugcuucuuuguggccguuaaaggcaauacauauaagcuguucgaacaggugaagaaaucuuuugaguccaccuguaacgacacggagaauaagguccagggguacuauaucugcauugugggaggcaacuucgcuccuaucuacguucccacacuugaugacuuuagaucuauggaagccuucaccgggauuuuucggagcccucacggagaggaucacgaccuggcgggcgaagagaucgccuccuauagcauuguggggcccgcuaaugccaaagucccgcauucugcuuccagcgauacacucucucugaucgccuacagcggaaucccuuccuauucuagccuuuccauucugaccagcucuaccgaagcgaagcacguguucucccccggccucuuuccuaaacugaaccauacaaauugcgacaagagcgccaucccccugacguggaccggcaugauugaccuccccggguacuacgaggcuauccacccuuguacagucuucugcgugcugucuggaccgggcgccuccugugaggcuuucagcgaagggggaauuuuuaacaucaccucccccaugugccuuguuucuaaacaaaaucgcuucagacugacagagcaacaggugaacuuugucugucagcggguggauauggacaucguuguguauugcaacggccagcgcaaggucauucucaccaagacgcuggugaucgggcaguguauuuacacaaucaccagccuuuucucccugcucccuggaguggcccacucuauugccguugaacugugcguccccggcuuucauggcugggcuaccgcggcccugcucgugacauucuguuuugggugggugcugaucccugcuauuaccuucaucauccuuacaguccugaaauuuguggccaauauuuuccacacgagcaaccaggagaauagacucaaguccguucugcggaaaaucaaggaagaguuugagaaaaccaagggaagcauggugugcgaugucuguaaguaugaaugcgagacauacaaagaacuuaaggcccauggcgugucuugcccccaaucccaguguccguauugcuucacccacugugagccuacagaagcugccuuucaggcgcauuacaaaguuugccaggugacccaccgcuucagagacgaucugaagaaaacggucacaccccaaaacuucacaccuggguguuaucggacccucaaucuguuucgcuacaagagcagaugcuacauuuucacaauguggguguuucugcucauccuggagucuguucuuugggcugccuccgccagcgagacgccccugaccccuguguggaacgacaaugcucacggagucggcucugugcccaugcauacagaucucgaacuggacuucagccugaccuccagcucuaaguauacauaccggagaaaacuuaccaacccgcucgaggaagcccaguccauugaucugcacaucgagaucgaggaacagaccauugggguggacguccaugcucugggccacugguuugauggacgccucaaucugaagaccagcuuccacuguuauggcgccugcacgaaauacgaguauccuuggcauaccgcgaagugucacuacgaacgggacuaucaguacgagacauccugggggugcaaccccucugacugucccggaguuggcaccgggugcacagccugcggacuuuaccuggaucaacucaaaccugugggcagcgcuuauaagaucauuaccaucagauacucccgccggguguguguccaguuuggggaagagaaucugugcaagauuaucgacaugaacgauuguuucgugucuagacauguuaaagugugcaucauuggcacggucagcaaguuuucccagggagacacacugcuuuucuuuggcccgcucgaagggggaggccugaucuucaaacacugguguaccucuaccugccaguuuggggaucccggagacauuaugagcccucgcgauaagggcuuccugugucccgaguucccuggguccuuucggaaaaagugcaauuucgccacaacccccaucugugaguaugacggcaacauggugagcggauacaaaaagguuauggcuacaauugauucuuuucaauccuucaauacgagcaccaugcauuuuacagacgaaagaaucgaguggaaggauccugacggcaugcuccgcgaucacaucaacauucuggugaccaaagacaucgacuucgauaaccuuggggaaaaucccugcaagauuggacugcagacaucuuccaucgagggcgccugggggagcggagucggcuuuacccucacgugucuggugucucugaccgagugcccgacauuccuuaccuccauuaaagcgugcgacaaggccaucuguuauggggcugaaagcguuacacucacccggggccagaacacagugaaagucuccggaaagggcgggcacagcggaucuaccuuuaagugcugucauggcgaggauugcagccagauugggcugcacgccgcugccccucaucuggacaaagugaauggaaucuccgaaaucgagaacucuaagguguacgaugacggcgcuccccaauguggcauuaaaugcugguucgucaagagcggggaauggaucuccggaauuuuuagcggcaauuggaucguucucauugugcuguguguguuccuucuguucagccucguccugcuguccauccuuugcccugugagaaaacacaagaagucuuga

SEQ ID NO: 13338 - RNA, 3408 nt, Artificial Sequence
  derived and/or modified CDS sequence (opt5) from HTNV(CBAa11-26)__KC576786.1__GP
augggcauguggaaguggcuggugaucgccagccucgucuggcccgcccugacccuuagaaacguuuacgacaugaagauugagugcccucacacaguguccuucggggaaaauucugugaucggauaugucgagcugccgcccaugccucucgccgauacggcgcagauggugcccgaaagcuccuguucuauggacaaccaucaaagcaugaauaccauuacaaaguacacccagguuaucuggcggggcaaagcugauccugggcaguccucucagaacagcuuugagacaguguccaccgaaauugaccugaagggaacaugcguccuuaaacacaagaugguggaggagagcuaucgcucuagaaaguccaucaccuguuacgaucugagcugcaauucuacguauuguaaacccacccucuacaugaucguuccuauucaugccugcaacaugaugaaguccugucugaucgcccugggcccguaucgggugcaagucguguacgaacgcacauacugcaugaccggggugcucauugagggaaaauguuucguccccgaccagagcguugugucuaucauuaagcacggcaucuuugauauugcuuccgugcauaucgucugcuucuuuguggccguuaaaggcaauacauauaagcuguucgaacaggugaagaaaucuuuugaguccaccuguaacgacacggagaauaagguccagggguacuauaucugcauugugggaggcaacucugcuccuaucuacguucccacacuugaugacuucagaagcauggaagccuuuaccgggauuuuccgguccccucacggagaggaucacgaccuggcgggcgaagagaucgccagcuauucuauuguggggcccgcuaaugccaaagucccgcauuccgcuagcucugauacacucagccugaucgccuacuccggaaucccuucuuauagcucccuuagcauucugaccucuuccaccgaagcgaagcacguguuuagccccggccucuucccuaaacugaaccauacaaauugcgacaagucugccaucccccugacguggaccggcaugauugaccuccccggguacuacgaggcuauccacccuuguacagucuuuugcgugcuguccggaccgggcgccagcugugaggcuuucuccgaagggggaauuuucaacaucaccucucccaugugccuuguuagcaaacaaaaucgcuuuagacugacagagcaacaggugaacuucgucugucagcggguggauauggacaucguuguguauugcaacggccaacgcaaggucauucucaccaagacgcuggugaucgggcaguguauuuacacaaucaccucccuuuuuagccugcucccuggaguggcccacagcauugccguugaacugugcguccccggcuuccauggcugggcuaccgcggcccugcucgugacauuuuguuucgggugggugcugaucccugcuauuaccuuuaucauccuuacaguccugaaauucguggccaauauuuuucacacguccaaccaggagaauagacucaagagcguucugcggaaaaucaaggaagaguucgagaaaaccaagggaucuauggugugcgaugucuguaaguaugaaugcgagacauacaaagaacuuaaggcccauggcguguccugcccccaaagccaguguccguauugcuuuacccacugugagccuacagaagcugccuuccaggcgcauuacaaaguuugccaggugacccaccgcuuuagagacgaucugaagaaaacggucacaccccaaaacuucaccccuggguguuaucggacccucaaucuguuccgcuacaagucuagaugcuacauuuuuacaauguggguguuccugcucauccuggaguccguucuuugggcugccagcgccucugagacgccccugaccccuguguggaacgacaaugcucacggagucggcagcgugcccaugcauacagaucucgaacuggacuuuucccugaccagcagcuccaaguauacauaccggagaaaacuuaccaacccgcucgaggaagcccagagcauugaucugcacaucgagaucgaggaacagaccauugggguggacguccaugcucugggccacugguucgauggacgccucaaucugaagacauccuuucacuguuauggcgccugcacgaaauacgaguauccuuggcauaccgcgaagugucacuacgaacgggacuaucaguacgagacaucuugggggugcaaccccagcgacugucccggaguuggcaccgggugcacagccugcggacuuuaccuggaucaacucaaaccugugggcuccgcuuauaagaucauuaccaucagauacucucgccggguguguguccaguucggggaagagaaucugugcaagauuaucgacaugaacgauuguuuugugagcagacauguuaaagugugcaucauuggcacggucuccaaguucucucagggagacacacugcucuuuuucggcccgcuugaagggggaggccugaucuuuaaacacugguguaccucuaccugccaguucggggaucccggagacauuauguccccucgcgauaagggcuuucugugucccgaguucccugggagcuuccggaaaaagugcaauuuugccacaacccccaucugugaguaugacggcaacauggugucuggauacaaaaagguuauggcuacaauugauuccuuccagagcuuuaauacgucuaccaugcauuucacagacgaaagaaucgaguggaaggauccugacggcaugcuccgcgaucacaucaacauucuggugaccaaagacaucgacuuugauaaccuuggggaaaaucccugcaagauuggacugcagacauccagcaucgagggcgccugggggucuggagucggcuucacccucacgugucuggugucccugaccgagugcccgacauuucuuaccagcauuaaagcgugcgacaaggccaucuguuauggggcugaauccguuacacucacccggggccagaacacagugaaagucagcggaaagggcgggcacucuggaagcaccuucaagugcugucauggcgaggauugcucccagauugggcugcacgccgcugccccucaucuggacaaagugaauggaaucucugaaaucgagaacagcaagguguacgaugacggcgcuccccaauguggcauuaaaugcugguuugucaaguccggggaauggaucucuggaauuuucagcggcaauuggaucguucucauugugcuguguguguuucuucuguucucccucguccugcugucuauccuuugcccugugagaaaacacaaaaagagcuga

SEQ ID NO: 13339 - RNA, 3408 nt, Artificial Sequence
  derived and/or modified CDS sequence (opt5) from HTNV(Fuyuan-Aa-145)__KJ857336.1__GP
augggcauguggaaguggcuggugaucgccagccucgucuggcccgcccugucccuuagaaacguuuacgacaugaaaauugagugcccucacaccgugucuuucggggaaaauagcgugaucggauaugucgagcugccgcccaugccucucgccgauacagcgcagauggugcccgaauccucuuguagcauggacaaccaucaauccauuaauacgaucaccaaguacacacagguuauuuggcggggcaaagcugauccugggcagucuagccagaacuccuuugagaccgugagcacagaagucgaccugaagggaaccugcgugcuuaaacacaagaugguugaggagucuuaucgcuccagaaagagcaucacauguuacgaucugucuugcaauuccaccuucuguaaacccacgcucuauaugaucgugccuauucaugccugcaacaugaugaaaagcugucugaucgcccugggcccguaccggguccaagugguguaugaacgcaccuacugcaugacagggguccucauugagggaaaguguuuuguucccgaccagucugugguguccaucauuaagcacggcaucuucgauauugcuagcguccaugugguuugcuuuuucguggccgucaaaggcaauaccuacaagcuguuugaacaggugaagaaauccuucgagucuacauguaacgacaccgagaauaagguucagggguauuacaucugcaucgugggaggcaacagcgcuccuauuuauguccccacgcuugaugacuuuagauccauggaagccuucacagggaucuuuaaaagcccucacggagaggaucacgaccuggcgggcgaagagauugccucuuacuccaucguggggcccgcuaaugccaaggucccgcauagcgcuucuagcgauacccucucccugauugccuauucuggaaucccuagcuacuccagccuuucuauccugacauccagcaccgacgcgaaacacguguucucucccggccucuuuccuaagcugaaccauaccaauugcgacaaauccgccauuccccugacauggacgggcaugaucgaucuccccggguauuacgaagcuauucacccuuguaccguuuucugcgugcugagcggaccgggcgccuccugugaggcuuucucugaagggggaaucuuuaacauuacaagccccaugugccuugucuccaagcaaaaucgguuccgccugaccgagcaacaggugaacuuuguuugucagagaguggacauggauaucgucguguacugcaacggccagcggaaggugauccucacaaaaacccugguuauugggcaguguaucuauacgauuacaucucuuuucagccugcucccuggagucgcccacuccaucgccguggagcugugcgugcccggcuuucauggcugggcuaccgcggcccugcucgucaccuucuguuuugggugggugcugauuccugcuguuacauucaucauucuuaccgugcugaaguuuaucgccaauaucuuccacacaagcaaccaggaaaaucgccucaaaucuguccugagaaagauuaaagaggaauuugagaagacgaagggauccauggugugcgacguuuguaaauacgagugcgaaaccuauaaggagcuuaaagcccauggcgugagcugcccccaaucucaguguccguacugcuucacacacugugaaccuaccgaggcugccuuucaggcgcauuauaaggucugccaggugacacaccgguuccgcgaugaccugaaaaagaccguuacgccccaaaacuucaccccuggguguuacagaacacucaaucuguuucgguauaagucccgcugcuacaucuucaccauguggguguuucugcucauucuggaaagcguccuuugggcugccucugccagcgagacaccccugaccccuguguggaacgauaaugcucacggagugggcuccguccccaugcauacggaccucgagcuggauuucagccugacaucuuccagcaaauacaccuauagacggaaacuuacaaacccgcucgaagaggcccaguccaucgaccugcacauugaaaucgaggagcagaccaucgggguugaugugcaugcucugggccacugguuugacggaagacucaaucugaagaccucuuuccacuguuacggcgccugcacaaaguaugaauacccuuggcauacggcgaaaugucacuaugagcgcgacuaccaguaugaaaccagcugggggugcaaccccuccgauugucccggagugggcacagggugcaccgccugcggacuuuaccuggaccaacucaagccugucggcucugcuuacaagauuaucacaauucgguauagcagacgcguguguguucaguuuggggaggaaaaucugugcaaaaucauugauaugaacgacuguuucgugucccggcaugucaaggugugcaucaucggcaccguuucuaaauuuagccagggagauacgcugcuuuucuuuggcccgcucgaagggggaggccugauuuucaagcacugguguacauccacaugccaguuuggggaccccggagauaucaugagcccuagagacaaaggcuuccugugucccgaguucccugggucuuuucgcaagaaaugcaauuucgccaccacccccauuugugaguacgauggcaacaugguguccggauauaagaaggucauggcuaccaucgacagcuuucaaucuuucaauacauccacgaugcauuuuaccgaugagcggauugaauggaaagacccugauggcaugcucagagaccacaucaacauccuggugacaaaggacauugauuucgacaaccuuggggagaaucccugcaaaaucggacugcagaccagcucuauugaaggcgccuggggguccggaguuggcuuuacacucaccugucuggugagccugacggagugcccgaccuuccuuacauccaucaaggcgugcgauaaagccauuuguuacggggcugagagcgucacccucacacgcggccagaacaccgugaaggugucuggaaagggcgggcacagcggauccacauuuaaaugcugucauggcgaagacugcucuaagaucgggcugcacgccgcugccccucaucuggauaaagucaauggaauuagcgagaucgaaaacuccaagguuuaugacgauggcgcuccccaguguggcaucaaaugcugguucgugaagucuggggaguggauuagcggaaucuuuuccggcaauuggauugugcucaucguccuguguguguuccuucuguucucucucguucugcugagcauucuuugcccugugcggaagcacaaaaaguccuga

SEQ ID NO: 13340 - RNA, 3408 nt, Artificial Sequence
  derived and/or modified CDS sequence (opt5) from HTNV(Fuyuan-Aa-26)__KJ857334.1__GP
augggcauguggaaguggcuggugaucgccagccucgucuggcccgcccugucccuuagaaacguuuacgacaugaaaauugagugcccucacaccgugucuuucggggaaaauagcgugaucggauaugucgagcugccgcccaugccucucgccgauacagcgcagauggugcccgaauccucuuguagcauggacaaccaucaauccauuaauacgaucaccaaguacacacagguuauuuggcggggcaaagcugauccugggcagucuagccagaacuccuuugagaccgugagcacagaagucgaccugaagggaaccugcgugcuuaaacacaagaugguugaggagucuuaucgcuccagaaagagcaucacauguuacgaucugucuugcaauuccaccuauuguaaacccacgcucuacaugaucgugccuauucaugccugcaacaugaugaaaagcugucugaucgcccugggcccguaucggguccaagugguguacgaacgcaccuacugcaugacagggguccucauugagggaaaguguuucguucccgaccagucugugguguccaucauuaagcacggcaucuuugauauugcuagcguccauaucgugugcuucuuuguugccgugaaaggcaauaccuauaagcuguucgaacaggucaagaaauccuuugagucuacauguaacgacaccgagaauaaggugcagggguacuauaucugcauuguuggaggcaacagcgcuccuaucuacgugcccacgcuugaugacuucagauccauggaagccuuuacagggauuuucaaaagcccucacggagaggaucacgaccuggcgggcgaagagaucgccucuuauuccauugucgggcccgcuaaugccaaggugccgcauagcgcuucuagcgauacccucucccugaucgccuacucuggaaucccuagcuauuccagccuuucuauucugacauccagcaccgacgcgaaacacgucuuuucucccggccucuucccuaagcugaaccauaccaauugcgacaaauccgccaucccccugacauggacgggcaugauugaucuccccggguacuacgaagcuauccacccuuguaccguguuuugcguucugagcggaccgggcgccuccugugaggcuuucucugaagggggaauuuucaacaucacaagccccaugugccuuguguccaagcaaaaucgguuucgccugaccgaacagcaggucaacuucgugugucagagaguugacauggauaucguggucuauugcaacggccaacggaaggugauucucacaaaaacccuggugaucgggcaguguauuuacacgaucacaucucuuuuuagccugcucccuggaguugcccacuccauugccgucgagcugugcgugcccggcuuccauggcugggcuaccgcggcccugcucgugaccuuuuguuucggguggguccugaucccugcugugacauuuauuauccuuaccguucugaaguucaucgccaauauuuuucacacaagcaaccaggaaaaucgccucaaaucugugcugagaaagaucaaagaggaguucgagaagacgaagggauccauggucugcgacguguguaaauaugagugcgaaaccuacaaggagcuuaaagcccauggcguuagcugcccccaaucucaguguccguauugcuuuacacacugugaaccuaccgaggcugccuuccaggcgcauuacaaggugugccaggucacacaccgguuucgcgaugaccugaaaaagaccgugacgccccaaaacuucaccccuggguguuauagaacacucaaucuguuccgguacaagucccgcugcuacauuuuuaccauguggguuuuccugcucauccuggaaagcgugcuuugggcugccucugccagcgagacaccccugaccccugucuggaacgauaaugcucacggagugggcuccgugcccaugcauacggaccucgagcuggauuuuagccugacaucuuccagcaaauauaccuacagacggaaacuuacaaacccgcucgaagaggcccaguccauugaccugcacaucgaaaucgaggagcagaccauuggggucgauguucaugcucugggccacugguucgacggaagacucaaucugaagaccucuuuucacuguuauggcgccugcacaaaguacgaauauccuuggcauacggcgaaaugucacuacgagcgcgacuaucaguacgaaaccagcugggggugcaaccccuccgauugucccggagugggcacagggugcaccgccugcggacuuuaccuggaccaacucaagccugugggcucugcuuauaagaucauuacaauccgguacagcagacgcgucugugugcaguucggggaggaaaaucugugcaaaauuaucgauaugaacgacuguuuuguuucccggcaugugaaggucugcaucauuggcaccgugucuaaauucagccagggagauacgcugcucuuuuucggcccgcuugaagggggaggccugaucuuuaagcacugguguacauccacaugccaguucggggaccccggagauauuaugagcccuagagacaaaggcuuucugugucccgaguucccugggucuuuccgcaagaaaugcaauuuugccaccacccccaucugugaguaugauggcaacaugguuuccggauacaagaaggugauggcuaccauugacagcuuccaaucuuuuaauacauccacgaugcauuucaccgaugagcggaucgaauggaaagacccugauggcaugcucagagaccacaucaacauucuggucacaaaggacaucgauuuugacaaccuuggggagaaucccugcaaaauuggacugcagaccagcucuaucgaaggcgccuggggguccggagugggcuucacacucaccugucugguuagccugacggagugcccgaccuuucuuacauccauuaaggcgugcgauaaagccaucuguuauggggcugagagcgugacccucacacgcggccagaacaccgucaaggugucuggaaagggcgggcacagcggauccacauucaaaugcugucauggcgaagacugcucuaagauugggcugcacgccgcugccccucaucuggauaaagugaauggaaucagcgagaucgaaaacuccaaggucuacgacgauggcgcuccccaguguggcauuaaaugcugguuuguuaagucuggggaguggaucagcggaauuuucuccggcaauuggaucgugcucauugugcugugugucuuucuucuguucucucucgugcugcugagcauccuuugcccuguucggaagcacaaaaaguccuga

SEQ ID NO: 13341 - RNA, 3408 nt, Artificial Sequence
  derived and/or modified CDS sequence (opt5) from HTNV(JS1)__KP970560.1__GP
augggcaucuggaaguggcuggugauggccagccucgucuggcccguucugacccuuagaaacguguacgacaugaagauugagugcccucacacaguguccuucgggggaaauucugucaucggcuauguggaacugccgcccguuccucucgcugauacggcccagauggugcccgagagcuccuguucuauggacaaccaucaaagccugaauaccauugcgaaguacacacaggucuccuggcgggggaaagcugaucagucucagagcucccaaaacagcuuugaaaccgugucuacagagguugaccuuaagggaaccugcgugcugaaacacaagauggucgaagaguccuaucgcagcagaaagucugugacauguuacgaucucuccugcaauagcaccuauuguaaaccuacgcuguacaugaucgugcccauucaugccugcaacaugaugaagucuugucugaucgcccucggcccuuaucggguccagguuguguacgagcgcaccuacugcaugacaggggugcugaucgaaggaaaauguuucgucccggaccaguccgugguuagcauuaucaagcacggcauuuuugauaucgcuuccgugcauauugucugcuucuuuguggccguuaaaggcaauaccuauaagaucuucgaacaggugaagaaaucuuuugaaagcacauguaacgacaccgagaauaagguccaaggguacuauauuugcaucgugggaggcaacuccgcucccaucuacgucccuacgcuugaugacuucagaagcauggaggccuuuacagggauuuuccggucuccccacggagaagaucacgaccuggcgggcgaggaaaucgccuccuauagcauuguggggccugcuaaugccaaaguuccccauucugcuagcuccgauacccucucucugaucgccuacagcgggauuccguccuauagcucucuuuccauccugacaagcucuaccgaggcgaagcacguguuuuccccuggccucuuccccaaacugaaccauaccaauugcgacaagagcgccaucccucugauuuggacaggcaugaucgaccuccccggguacuacgaagcuguccaccccuguacgguguuuugcguucuguccggaccuggcgccucuugugaggcuuucagcgagggaggaauuuucaacaucaccuccccgaugugccuugugucuaaacagaaucgcuuuagacugacagaacagcaggucaacuucgugugucaacggguggauauggacauuguugucuauugcaacggccagcgcaaggugauccucaccaagacacuggugaucgggcaguguauuuacaccaucacgagccuguuuucccuucuccccggagucgcccacagcauugccguggagcugugcguuccuggcuuccauggcugggcuacagcggcccugcucgugaccuuuuguuucggguggguccugauccccgcuauuaccuuuaucauucuuacagugcugaaauucaucgccaauaucuuucacaccucuaaccaagaaaauagacucaaguccguucugcggaaaauuaaggaggaguucgagaaaacaaagggaagcauggugugcgaugucuguaaguaugagugcgaaacguacaaagagcuuaaggcccauggcgugucuugcccucagucccagugucccuauugcuuuacccacugugaaccgacagaggcugccuuccaggcgcauuacaaaguuugccaagugacccaccgcuuuagagacgaucugaagaaaacagucaccccucagaacuucacgcccggguguuaucggacccucaaucuguuccgcuacaagagcagaugcuacaucuuuacaauguggauuuuccugcucgugcuggaaucuauccuuugggcugccagcgccuccgagaccccucugacacccguguggaacgacaaugcucacggagucggcagcguuccuaugcauaccgaucucgagcuggacuuuucucugacguccagcuccaaguauacauaccggagaaaacuuaccaacccccucgaagaggcccagucuauugaucugcacaucgaaaucgaggagcagacaauugggguggacgugcaugcucugggccacugguucgauggacgccucaaucugaagaccagcuuucacuguuauggcgccugcaccaaauacgaauauccguggcauacagcgaagugucacuacgagcgggacuaucaauacgaaacguccugggggugcaacccuucugacugucccggagucggcaccgggugcacagccugcggacuuuaccuggaucagcucaaacccgugggcagcgcuuauaagaucauuaccaucagauacucccgccggguuugugugcaguucggggagggcaaucugugcaagauuaucgacaugaacgauuguuuugucucuagacaugugaaaguuugcaucauuggaacagugagcaaguucucccagggcgacacccugcucuuuuucgggccucuugaaggaggcgggcugaucuuuaaacacugguguacgagcacaugccaauucggagauccgggcgacauuaugucuccccgcgauaagggguuucuguguccugaguuccccggcuccuuccggaaaaagugcaauuuugccaccaccccuaucugugaguaugacggaaacauggucagcggcuacaaaaaggugauggcuacaauugauucuuuccaguccuuuaauaccagcacaaugcauuucacggacgaaagaaucgaguggaaggaucccgacgggaugcuccgcgaucacaucaacauucugguuaccaaagacaucgacuuugauaaccuuggagaaaauccuugcaagauuggccugcagacaucuuccaucgagggggccuggggaagcggcgugggguucacccucacaugucuggucucccugaccgaaugccccacguuucuuaccagcauuaaagcgugcgacaaggccaucuguuauggcgcugagucugugacacucacccggggacagaacacagugaaagucagcggcaaagggggacacuccggcucuaccuucaagugcugucauggggaggauugcagccaaauuggacugcacgccgcugccccgcaucuggacaagguuaauggcaucuccgaaaucgagaacucuaagguguacgaugacggcgccccucagugugggauuaaaugcugguuugucaagagcggagaauggaucuccggcauuuucucugggaauuggaucgugcucauugugcuguguguuuuucuucuguucagccucgugcugcuguccauccuuugccccgucagaaaacacaaaaagagcuga

SEQ ID NO: 13342 - RNA, 3408 nt, Artificial Sequence
  derived and/or modified CDS sequence (opt5) from HTNV(LongquanAa-08-150)__JQ912803.1__GP
augggcaucuggaaguggcuggugauggccagccucgucuggcccgcuuucacccugagaaacguuuacgacaugaaaauugagugcccucacacaguguccuuuggggaaaauucugugaucggauaugucgagcuuccgcccaugccucuggccgauacggcgcagauggugcccgaaagcuccuguaacauggacaaucaucaaucuaugaacaccauuacaaaguacacccagguuagcuggcggggcaaagcugaucaggcccaggccucccaaaauucuuucgaggcugugagcgccgaagucgaccucaaggggaucugcgugcugaaacacaagaugcuugaggaguccuaucgcagcagaaagucuauuacauguuacgaucuguccugcaacagcaccuauuguaaaccuacacucuacaugaucguucccauccaugcuugcaauaugaugaagucuugucugauugcccugggaccuuaucgggugcaggucguguacgaacgcaccuacugcaugacgggcgugcuccuggaggggaaauguuuugucccggaccaguccguugugagcaucauuaagcacggaaucuucgauauugcgucugugcauaucgucugcuuuuucguggccguuaaaggcaacaccuauaagcuccuggaacaggugaagaaauccuuucaaagcacauguaaugacaccgagaacaagguccagggcuacuauauuugcaucguugggggaaauuccgcucccaucuacgugccuacacucgaugacuucagaucuauggaggccuuuagcggcauuuuccggagcccccacggggaagaucacgaccuggcuggagaggaaaucgccagcuauucuauugugggcccugcgaacgccaaagucccccauuccgcuagcucugauacccuuagccugaucgccuacuccgggauuccgucuuauagcucccucagcauccuggcuucuuccacggaggccaagcacguguuuagcccuggauucuuuccccagcugaaucauacaaaaugcgacaagaccgccaucccucucauuuggacaggcaugaucgaccugcccggcuacuacgaagcuauucaccccuguaccgucuucugcgugcuuucugggccuggagcguccugugaggccuucagcgagggcgggaucuuuaacauuaccuccccgaugugccugguuucuaaacagaaucgcuucagacucacagaacaacaggugaacuuugucugucagcggguggauguugacaucaucguguauugcaacggacaacgcaaggucauucugacgaagacccuugugaucggccaguguauuuacacaaucaccagccuguucucccuccugcccgggguggcucacucuauugccguugagcugugcgucccuggauuucauggcugggccacagcugcccuccuggugaccuucuguuuuggcugggugcuuauccccgcgcugacgcucauuauccugacaauccuuaaauucauugcuaauaucuuucauaccugcaaccaggaaaauagacugaaguccguccuccggaaaauuaaggaggaauuugagaaaaccaagggguccauggugugugauguuugcaaguaugagugcgaaacauacaaagagcugaaggcccacggagugagcuguccucagucucaaugccccuauuguuuuacccacugcgaaccgacagaggccgcuuuccaggcccauuaccgcgucugucaggugacgcacagauuucgggacgaucugaaaaagaccguuacaccucagaacuucacccccggcugcuaucgcacacucaaucuguucagauacaaaucccgguguuacaucuuuaccaugugggugugccuucugguccucgaaagcauucugugggcugccucugcguccgaggugccucugaaccccguuuggaaugacaacgcccacggggugggaagcgucccuaugcauacggaucuugagcucgacuucucucugaccagcuccagcaaguauacauacagacgccggcugaccaauccccucgaagagacacaaucuaucaaccugcacaucgaaauugaggagcagaccaucggcguggaugugcaugcucuugggcacugguuugacggcagacugaaucucaagacguccuuccacuguuauggagccugcacaaaauacgaauauccguggcauaccgcuaagugucacuacgagcgcgauuaucaguacgaaacaagcuggggcugcaacccugccgacugccccggggucggaaccggcuguaccgcgugcgggcuguaccuggaccagcuuaaacccguuggauccgccuauaagauuaucacaauucgguacucuagaaaagugugugugcaauuuggcgaggaaaaucucugcaaggucaucgauaugaacgacuguuucgugacgcgccauguuaaggugugcaucauugggaccgucagcaaauuuucccagggcgauacacugcuguucuuuggaccucucgagggcgggggacugaucuucaagcacugguguaccucuacaugccaguuuggcgacccgggggauauuaugagcccccgggacaaaggauuccuuuguccugaguuucccggcuccuucagaaagaaaugcaauuucgcuaccacgccucugugugaauaugaugggaacauggugucuggcuacaagaaaguuauggccacaaucgacagcuuucaguccuucaacaccagcaccaugcauuuuacagaugagcgcauugaauggaaggaccccgauggaaugcuccgggaccacaucaauauccuggugaccaaggauauugacuucgacaaccugggcgagaauccuugcaaaaucgggcuucaaacaucuuccauugaaggagcuuggggcagcggggucggauuuacgcuuaccugccugaucucucugacagagugucccaccuuccucacauccauuaaggccugcgauaaagccaucuguuauggcgcugagagcgugacccugacgagagggcagaacaccguuaaggugucuggcaaaggaggccacuccgggagcacauuuaagugcugucauggagaagagugcucccagauuggccuucacgcggccgcuccgcaucuggacaaggucaaugggaucagcgaaaucgagaacaauaaaguguacgaugacggagccccucaauguggcgugaagugcugguucgucaaaucuggcgaauggauuagcgggaucuuuuccggaaacuggauuguucucaucgugcuguguguguuccugcuuuucucucucguccugcugagcgugcucugccccguucgcaagcacaaaaaguccuga

SEQ ID NO: 13343 - RNA, 3408 nt, Artificial Sequence
  derived and/or modified CDS sequence (opt5) from HTNV(LongquanAa-08-157)__JQ912804.1__GP
auggagaucuggaaguggcuggugauggccagccucgucuggcccgcuuucacccugagaaacguuuacgacaugaaaauugaaugcccucacacaguguccuuuggcgagaauagcgugaucggguaugucgaacuuagcccgaugccccuggccgauacggcgcagauggugccugaguccucuuguaacauggacaaucaucaaagcaugaacaccauuacaaaguacacccagguuuccuggcggggaaaagcugaucaggcccaggccucucaaaauagcuucgaagcuguguccgccgaggucgaccucaagggcacaugcgugcugaaacacaagaugcuugaggaaagcuaucgcucuagaaaguccaucaccuguuacgaucugagcugcaacucuacauauuguaaacccacccucuacaugauuguuccuauccaugcuugcaauaugaugaaguccugucugaucgcccuggggcccuaucgggugcaggucguguacgagcgcacguacugcaugaccggagugcucauugaaggcaaauguuuugucccugaccagagcguugugucuaucauuaagcacgggaucuucgauauugcguccgugcauaucgucugcuuuuucguggccguuaaaggaaacacauauaagcuguuugaacaggugaagaaaucuuuccaauccaccuguaauggcacagagaacaagguccagggcuacuauauuugcaucguugggggaaauucugcuccgaucuacgugcccacccuugacgauuuuagaagcauggaagccuucuccggcauuuuucggagcccucacggggaggaccacgaucuggcuggagaagagaucgccucuuauuccauugugggccccgcgaacgccaaagucccucauagcgcuucuagcgacacgcucucccugaucgccuacucugggauucccagcuauuccagccuuucuauccuggcuuccagcacagaagccaagcacguguucucuccgggauuuuucccucagcucaaucauaccaaaugcgauaagacagccaucccccugaccuggaccggcaugauugaccugccuggcuacuacgaggcuauccaccccuguacagucuucugcgugcucuccgggcccggagcgagcugugaggccuuuuccgaaggcgggauuuucaacaucacgucuccuaugugccugguuagcaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccucccuguuuucucuucugccggggguggcucacagcaucgccguggaacucugcguucccggauuccauggcugggccacggcugcccugcuggucacauuuuguuucggcugggugcucauuccugcgcugacccuuaucauucugaccauccucaaauuuaucgcuaaucuguuccacacauccaaccaggagaauagacuuaagagcgugcugcggaaaauuaaggaagaguuugagaaaaccaaggggucuauggucugcgacguguguaaguaugaaugcgagacauacaaagaacucaaggcccauggaguuuccugcccccagagccaauguccuuauugcuucacgcacugugagcccaccgaagccgcuuuucaggcccauuaccgcgugugccaggucacacacagauuccgggaugaccugaaaaagaccgugacaccgcagaacuucaccccuggcuguuaucgcacgcugaaucucuuuagauacaaaucucggugcuacaucuucaccauguggguuugucugcuugugcuggaguccauucucugggcugccagcgcgucugaggucccccugaacccuguguggaaugauaacgcccacgggguuggaagcgugcccaugcauacagaccuggaacuugauuuuucccucaccucuagcuccaaguauacauacagacgccggcugaccaauccucuggaggaaacgcaaagcaucaaccuccacauugagaucgaggaacagacaaucggcgucgacgugcaugcucuggggcacugguucgauggcagacuuaaucugaagaccuccuuucacugcuauggagccuguacaaaauacgaguaucccuggcauaccgcuaagugccacuacgaacgcgacuaucaguacgagaccucuuggggcuguaacccggccgauugcccuggggugggaacaggcugcacggcgugugggcucuaccuggaccagcugaaacccgucggaagcgccuauaagauuaucaccauucgguacuccagaaaaguuugcgugcaauucggcgaagagaaucuuuguaaggugaucgacaugaacgauugcuuugucacacgccaugugaagguuuguauuaucgggaccgugucuaaauucagccagggcgacacacuccuguuuuucggaccccuggagggcgggggacucaucuuuaagcacuggugcaccuccacgugucaguucggcgauccuggggacauuaugucuccgcgggauaaaggauuucugugccccgaguucccuggcagcuucagaaagaaauguaauuuugcuacaacaccccuuugcgaguaugacgggaacauggucuccggcuacaagaaagugauggccaccaucgauagcuuccagucuuuuaacaccuccaccaugcauuucacagacgaacgcauugaguggaaggauccugacggaaugcugcgggaucacaucaauauucucguuacgaaggacaucgauuuugacaaccugggcgaaaaucccuguaaaaucgggcugcaaaccagcucuauugagggagcuuggggcuccggggugggauucacacuuaccugccucaucagccugacagagugcccuaccuuucugacgucuauuaaggccugugacaaagccaucugcuauggcgcugaauccgucacccucacaagagggcagaacaccgugaagguuagcggcaaaggaggccacuccgggagcacauucaaguguugccauggagaggaauguucucagauuggccugcacgcggccgcuccccaucuugauaaggugaaugggaucagcgagauugaaaacaauaaagucuacgacgauggagccccgcaaugcggcgugaaguguugguuugugaaauccggcgaguggaucucugggaucuucagcggaaacuggauuguccugaucguucucugcguguuucugcuguucucccuugugcuccugucuguccuguguccugugcgcaagcacaaaaagagcuga

SEQ ID NO: 13344 - RNA, 3408 nt, Artificial Sequence
  derived and/or modified CDS sequence (opt5) from HTNV(LongquanAa-08-196)__JQ912805.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccuccuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaagcaaccaggagaauagacugaaguccgugcuucggaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuaccgcgugugccaggucacacacagauuccgggaugaccucaaaaagaccgugacaccucagaacuucacccccggcuguuaucgcacgcugaaucuguuuagauacaaaagccggugcuacauuuucaccauguggguuugucuccuggugcuugagucuauccugugggcugccuccgcgagcgaggucccucucaaccccguguggaaugauaacgcccacgggguuggaucugugccuaugcauacagaccuggaacuggauuuuagccuuaccuccagcucuaaguauacauacagacgccggcucaccaauccccuggaggaaacgcaauccauuaaccugcacaucgagaucgaggaacagacaauuggcgucgacgugcaugcucucgggcacugguucgauggcagacugaaucuuaagaccagcuuucacugcuauggagccuguacaaaauacgaguauccguggcauaccgcuaagugccacuacgaacgcgacuaucaguacgagaccuccuggggcuguaacccugccgauugccccggggugggaacaggcugcacggcgugugggcuguaccucgaccagcugaaacccgucggaucugccuauaagaucauuaccauccgguacagcagaaaaguuugcgugcaauucggcgaagagaaucuguguaaggugauugacaugaacgauugcuuugucacacgccaugugaagguuuguaucaucgggaccguguccaaauucucucagggcgacacacuucucuuuuucggaccucuggagggcgggggacugauuuuuaagcacuggugcaccagcacgugucaguucggcgauccgggggacaucaugucuccccgggauaaaggauuucucugcccugaguuccccggcuccuucagaaagaaauguaauuuugcuacaaccccucugugcgaguaugacgggaacauggucagcggcuacaagaaagugauggccaccauugauuccuuccagagcuuuaacacaucuaccaugcauuucacagacgaacgcaucgaguggaaggaucccgacggaaugcuucgggaucacauuaauauccugguuacgaaggacaucgauuuugacaaccucggcgaaaauccuuguaaaauugggcugcaaaccuccagcaucgagggagcuuggggcucuggggugggauucacacugaccugccuuauuucccucacagagugccccaccuuucugacgagcaucaaggccugugacaaagccauuugcuauggcgcugaaucugucacccugacaagagggcagaacaccgugaagguuuccggcaaaggaggccacagcggguccacauucaaguguugccauggagaggaauguagccagaucggccuccacgcggccgcuccgcaucuggauaaggugaaugggauuucugagaucgaaaacaauaaagucuacgacgauggagccccucaaugcggcgugaaguguugguuugugaaaagcggcgaguggaucuccgggauuuucucuggaaacuggaucguccuuauuguucugugcguguuucuccuguucagccuggugcuucucuccguccugugucccgugcgcaagcacaaaaagucuuga

SEQ ID NO: 13345 - RNA, 3408 nt, Artificial Sequence
  derived and/or modified CDS sequence (opt5) from HTNV(LongquanAa-08-235)__JQ912810.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccuccuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaagcaaccaggagaauagacugaaguccgugcuucggaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuaccgcgugugccaggucacacacagauuccgggaugaccucaaaaagaccgugacaccucagaacuucacccccggcuguuaucgcacgcugaaucuguuuagauacaaaagccggugcuacauuuucaccauguggguuugucuccugguguuugagucuauccuuugggcugccuccgcgagcgaggucccucugaaccccguguggaaugauaacgcccacgggguuggaucugugccuaugcauacagaccucgaacuggauuucagccugaccuccagcucuaaguauacauacagacgccggcuuaccaauccccucgaggaaacgcaauccauuaaccugcacaucgagaucgaggaacagacaauuggcgucgacgugcaugcucuggggcacugguuugauggcagacucaaucugaagaccagcuuccacugcuauggagccuguacaaaauacgaguauccguggcauaccgcuaagugccacuacgaacgcgacuaucaguacgagaccuccuggggcuguaacccugccgauugccccggggugggaacaggcugcacggcgugugggcuuuaccuggaccagcucaaacccgucggaucugccuauaagaucauuaccauccgguacagcagaaaaguuugcgugcaauuuggcgaagagaaucuguguaaggugauugacaugaacgauugcuucgucacacgccaugugaagguuuguaucaucgggaccguguccaaauuuucucagggcgacacacugcuuuucuuuggaccucucgagggcgggggacugauuuucaagcacuggugcaccagcacgugucaguuuggcgauccgggggacaucaugucuccccgggauaaaggauuccugugcccugaguuccccggcuccuuuagaaagaaauguaauuucgcuacaaccccucucugcgaguaugacgggaacauggucagcggcuacaagaaagugauggccaccauugauuccuuucagagcuucaacacaucuaccaugcauuuuacagacgaacgcaucgaguggaaggaucccgacggaaugcugcgggaucacauuaauauccuuguuacgaaggacaucgauuucgacaaccugggcgaaaauccuuguaaaauugggcuccaaaccuccagcaucgagggagcuuggggcucuggggugggauuuacacugaccugccugauuucccuuacagagugccccaccuuccucacgagcaucaaggccugugacaaagccauuugcuauggcgcugaaucugucacccugacaagagggcagaacaccgugaagguuuccggcaaaggaggccacagcggguccacauuuaaguguugccauggagaggaauguagccagaucggccugcacgcggccgcuccgcaucucgauaaggugaaugggauuucugagaucgaaaacaauaaagucuacgacgauggagccccucaaugcggcgugaaguguugguucgugaaaagcggcgaguggaucuccgggauuuucucugucaacuggaucguucugauugugcuuugcguguuccugcucuuuagccugguccugcuuuccgugcucugucccguucgcaagcacaaaaagucuuga

SEQ ID NO: 13346 - RNA, 3408 nt, Artificial Sequence
  derived and/or modified CDS sequence (opt5) from HTNV(LongquanAa-09-171)__JQ912824.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccagcuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaaacaaucaggagaacagacugaaguccgugcuucggaaaaucaaggaagaguuugagaaaaccaagggguccauggucugcgacguguguaaguaugaaugcgagacauacaaagaacugaaggcccauggaguuagcugcccucagucucaaugucccuauugcuucacgcacugugagccgaccgaagccgcuuuucaggcccauuaccgcgugugccaggucacacacagauuccgggaugaccucaaaaagaccgugacaccucagaauuucacccccggcuguuaucgcacgcugaaccuguuuagauacaaaucccggugcuacauuuucaccauguggguuugucuccuggugcuugagagcauccugugggcugccucugcguccgaggucccucucaaucccguguggaacgauaaugcccacgggguuggaagcgugccuaugcauacagaccuggaacuggauuuuucucuuaccagcuccagcaaguauacauacagacgccggcucaccaacccccuggaggaaacgcaaucuauuaaucugcacaucgagaucgaggaacagacaauuggcgucgacgugcaugcucucgggcacugguucgauggcagacugaaccuuaagaccuccuuucacugcuauggagccuguacaaaauacgaguauccguggcauaccgcuaagugccacuacgaacgcgacuaucaguacgagaccagcuggggcuguaauccugccgauugccccggggugggaacaggcugcacggcgugugggcuguaccucgaccagcugaaacccgucggauccgccuauaagaucauuaccauccgguacucuagaaaaguuugcgugcaauucggcgaagagaaccuguguaaggugauugacaugaaugauugcuuugucacacgccaugugaagguuuguaucaucgggaccgugagcaaauucucccagggcgacacacuucucuuuuucggaccucuggagggcgggggacugauuuuuaagcacuggugcaccucuacgugucaguucggcgauccgggggacaucaugagcccccgggauaaaggauuucucugcccugaguuccccggcuccuucagaaagaaauguaacuuugcuacaaccccucugugcgaguaugacgggaacauggucucuggcuacaagaaagugauggccaccauugauagcuuccaguccuuuaauacaagcaccaugcauuucacagacgaacgcaucgaguggaaggaucccgacggaaugcuucgggaucacauuaacauccugguuacgaaggacaucgauuuugacaaucucggcgaaaacccuuguaaaauugggcugcaaaccucuuccaucgagggagcuuggggcagcggggugggauucacacugaccugccuuauuucucucacagagugccccaccuuucugacguccaucaaggccugugacaaagccauuugcuauggcgcugaaagcgucacccugacaagagggcagaauaccgugaagguuucuggcaaaggaggccacuccgggagcacauucaaguguugccauggagaggaauguucccagaucggccuccacgcggccgcuccgcaucuggauaaggugaacgggauuagcgagaucgaaaauaacaaagucuacgacgauggagccccucaaugcggcgugaaguguugguuugugaaaucuggcgaguggaucagcgggauuuucuccggaaauuggaucguccuuauuguucugugcguguuucuccuguucucucuggugcuucucagcguccugugucccgugcgcaagcacaaaaaguccuga

SEQ ID NO: 13347 - RNA, 3408 nt, Artificial Sequence
  derived and/or modified CDS sequence (opt5) from HTNV(LongquanAa-09-191)__JQ912825.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcggaugccccuggccgauacggcgcagauggugccugagagcuccuguaacauggacaaucaucaaucuaugaacaccauuacaaaguacacccagguuagcuggcgcggaaaagcugaucaggcccaggccucccaaaauucuuucgaagcugugagcgccgaggucgaccucaagggcacaugcgugcugaaacacaagaugcuugaggaauccuauagaagccggaagucuaucaccuguuacgaucuguccugcaacagcacauauuguaaacccacccucuacaugauuguuccuauccaugcuugcaauaugaugaagucuugucugaucgcccuggggcccuaucgcgugcaggucguguacgagagaacguacugcaugaccggagugcucauugaaggcaaauguuuugucccugaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcuccgaucuacgugcccacccuugacgauuuucggucuauggaggccuucagcggcauuuuucgcuccccucacggggaggaccacgaucuggcuggagaagagaucgccagcuauucuauugugggccccgcgaacgccaaagucccucauuccgcuagcucugacacgcucagccugaucgccuacuccgggauucccucuuauagcucccuuagcauccuggcuucuuccacagaagccaagcacguguucagcccgggauuuuucccucagcucaaucauaccaaaugcgauaagacagccaucccccugaccuggaccggcaugauugaccugccuggcuacuacgaggcuauccaccccuguacagucuucugcgugcucucugggcccggagcguccugugaggccuuuagcgaaggcgggauuuucaacaucacguccccuaugugccugguuucuaaacagaauagauuucggcuuaccgagcaacaggugaacuucgucugucagcgcguggacauggauauuaucguuuauugcaacggacaaagaaaggugauccugacaaagacccucgucauuggccaguguaucuacacaauuaccagccuguuuucccuucugccggggguggcucacucuaucgccguggaacucugcguucccggauuccauggcugggccacggcugcccugcuggucacauuuuguuucggcugggugcucauuccugcgcugacccuuaucauucugaccauccucaaauuuaucgcuaauauuuuccacacaagcaaccaggagaaucggcugaaguccgugcuucgcaaaaucaaggaagaguuugagaaaaccaaggggagcauggucugcgacguguguaaguaugaaugcgagacauacaaagaacugaaggcccauggaguuucuugcccccagucccaauguccuuauugcuucacgcacugugagcccaccgaagccgcuuuucaggcccauuacagagugugccaggucacacaccgguuccgcgaugaccucaaaaagaccgugacaccgcagaacuucaccccuggcuguuauagaacgcugaaucuguuucgguacaaaagcagaugcuacauuuucaccauguggguuugucuccuggugcuugagucuauccugugggcugccuccgcgagcgaggucccccucaacccuguguggaaugauaacgcccacgggguuggaucugugcccaugcauacagaccuggaacuggauuuuagccuuaccuccagcucuaaguauacauaccgccggagacucaccaauccucuggaggaaacgcaauccauuaaccugcacaucgagaucgaggaacagacaauuggcgucgacgugcaugcucucgggcacugguucgauggccgccugaaucuuaagaccagcuuucacugcuauggagccuguacaaaauacgaguaucccuggcauaccgcuaagugccacuacgaacgggacuaucaguacgagaccuccuggggcuguaacccggccgauugcccuggggugggaacaggcugcacggcgugugggcuguaccucgaccagcugaaacccgucggaucugccuauaagaucauuaccaucagauacagccgcaaaguuugcgugcaauucggcgaagagaaucuguguaaggugauugacaugaacgauugcuuugucacacggcaugugaagguuuguaucaucgggaccguguccaaauucucucagggcgacacacuucucuuuuucggaccccuggagggcgggggacugauuuuuaagcacuggugcaccagcacgugucaguucggcgauccuggggacaucauguccccgagagauaaaggauuucucugccccgaguucccuggcucuuuccgcaagaaauguaauuuugcuacaacaccccugugcgaguaugacgggaacauggucagcggcuacaagaaagugauggccaccauugauuccuuccagagcuuuaacaccucuaccaugcauuucacagacgaacggaucgaguggaaggauccugacggaaugcuuagagaucacauuaauauccugguuacgaaggacaucgauuuugacaaccucggcgaaaaucccuguaaaauugggcugcaaaccuccagcaucgagggagcuuggggcucuggggugggauucacacugaccugccuuauuucccucacagagugcccuaccuuucugacgagcaucaaggccugugacaaagccauuugcuauggcgcugaaucugucacccugacacgcgggcagaacaccgugaagguuuccggcaaaggaggccacagcggguccacauucaaguguugccauggagaggaauguagccagaucggccuccacgcggccgcuccccaucuggauaaggugaaugggauuucugagaucgaaaacaauaaagucuacgacgauggagccccgcaaugcggcgugaaguguugguuugugaaaagcggcgaguggaucuccgggauuuucucuggaaacuggaucguccuuauuguucugugcguguuucuccuguucagccuggugcuucucuccguccuguguccugugcggaagcacaaaaagucuuga

SEQ ID NO: 13348 - RNA, 3408 nt, Artificial Sequence
  derived and/or modified CDS sequence (opt5) from HTNV(LongquanAa-09-350)__JQ912835.1__GP
auggagaucuggaaguggcuggugauggccagccucgucuggcccgcuuucaccagacggaacguuuacgacaugaaaauugaaugcccucacacaguguccuuuggcgaaaauucugugaucggguaugucgaacugccgcccaugccucuugccgauacggcgcagauggugcccgagagcuccuguaacauggacaaucaucaaucuaugaacaccauuacaaaguacacccagguuagcuggcgcggaaaagcugaucaggcccaggccucccaaaauucuuucgaagcugugagcgccgaggucgaccugaagggcacaugcgugcucaaacacaagaugcuggaggaauccuauagaagccggaagucuaucaccuguuacgaucuuuccugcaacagcacauauuguaaaccuacccuguacaugauuguucccauccaugcuugcaauaugaugaagucuugucucaucgcccuggggccuuaucgcgugcaggucguguacgagagaacguacugcaugaccggagugcugauugaaggcaaauguuuugucccggaccaguccguugugagcaucauuaagcacgggaucuucgauauugcgucugugcauaucgucugcuuuuucguggccguuaaaggaaacacauauaagcucuuugaacaggugaagaaauccuuccaaagcaccuguaauggcacagagaacaagguccagggcuacuauauuugcaucguugggggaaauuccgcucccaucuacgugccuacccuggacgauuuucggucuauggaggccuucagcggcauuuuucgcagcccccacggggaggaccacgaucuugcuggagaagagaucgccuccuauucuauugugggcccugcgaacgccaaagucccccauuccgcuagcucugacacgcugagccucaucgccuacuccgggauuccgucuuauagcucccugagcauccuugcuucuuccacagaagccaagcacguguucagcccuggauuuuucccccagcugaaucauaccaaaugcgauaagacagccaucccucucaccuggaccggcaugauugaccugcccggcuacuacgaggcuauccaccccuguacagucuucugcgugcugucugggccuggagcguccugugaggccuuuagcgaaggcgggauuuucaacaucacguccccgaugugccucguuucuaaacagaauagauuucggcugaccgagcaacaggugaacuucgucugucagcgcguggacauggauauuaucguuuauugcaacggacaaagaaaggugauccuuacaaagacccuggucauuggccaguguaucuacacaauuaccagccucuuuucccugcuucccgggguggcucacucuaucgccguggaacugugcguuccuggauuccauggcugggccacggcugcccuccuggucacauuuuguuucggcugggugcugauucccgcgcucacccugaucauucuuaccauccugaaauuuaucgcuaauauuuuccacacaagcaaccaggagaaucggcucaaguccgugcugcgcaaaaucaaggaagaguuugagaaaaccaaggggagcauggucugcgacguguguaaguaugaaugcgagacauacaaagaacuuaaggcccauggaguuucuugcccucagucccaaugucccuauugcuucacgcacugugagccgaccgaagccgcuuuucaggcccauuacagagugugccaggucacacaccgguuccgcgaugaccugaaaaagaccgugacaccucagaacuucacccccggcuguuauagaacgcucaaucuguuucgguacaaaagcagaugcuacauuuucaccauguggguuugucugcucgugcuggagucuauccuuugggcugccuccgcgagcgaggucccucugaaccccguguggaaugauaacgcccacgggguuggaucugugccuaugcauacagaccucgaacuggauuuuagccugaccuccagcucuaaguauacauaccgccggagacuuaccaauccccucgaggaaacgcaauccauuaaccugcacaucgagaucgaggaacagacaauuggcgucgacgugcaugcucuggggcacugguucgauggccgccucaaucugaagaccagcuuucacugcuauggagccuguacaaaauacgaguauccguggcauaccgcuaagugccacuacgaacgggacuaucaguacgagaccuccuggggcuguaacccugccgauugccccggggugggaacaggcugcacggcgugugggcuuuaccuggaccagcucaaacccgucggaucugccuauaagaucauuaccaucagauacagccgcaaaguuugcgugcaauucggcgaagagaaucuguguaaggugauugacaugaacgauugcuuugucacacggcaugugaagguuuguaucaucgggaccguguccaaauucucucagggcgacacacugcuguuuuucggaccucucgagggcgggggacugauuuuuaagcacuggugcaccagcacgugucaguucggcgauccgggggacaucaugucccccagagauaaaggauuucugugcccugaguuccccggcucuuuccgcaagaaauguaauuuugcuacaaccccucucugcgaguaugacgggaacauggucagcggcuacaagaaagugauggccaccauugauuccuuccagagcuuuaacacaucuaccaugcauuucacagacgaacggaucgaguggaaggaucccgacggaaugcugagagaucacauuaauauccuuguuacgaaggacaucgauuuugacaaccugggcgaaaauccuuguaaaauugggcuccaaaccuccagcaucgagggagcuuggggcucuggggugggauucacacugaccugccugauuucccuuacagagugccccaccuuucucacgagcaucaaggccugugacaaagccauuugcuauggcgcugaaucugucacccugacacgcgggcagaacaccgugaagguuuccggcaaaggaggccacagcggguccacauucaaguguugccauggagagaaguguagccagaucggccugcacgcggccgcuccgcaucucgauaaagugaaugggauuucugaaaucgagaacaauaaggucuacgacgauggagccccucaaugcggcgugaaauguugguuugucaagagcggcgaauggaucuccgggauuuucucuggaaacuggaucgugcugauuguucuuugcguguuucuucucuucagccuggugcugcuuuccguccucugucccgugcggaaacacaagaagucuuga

SEQ ID NO: 13349 - RNA, 3408 nt, Artificial Sequence
  derived and/or modified CDS sequence (opt5) from HTNV(LongquanAa-09-489)__JQ912844.1__GP
auggagaucuggaaguggcuggugauggccagccucgucuggcccgcuuucacccugagaaacguuuacgacaugaaaauugaaugcccucacacaguguccuuuggcgagaauagcgugaucggguaugucgaacuuccgcggaugccccuggccgauacggcgcagauggugccugagagcuccuguaacauggacaaucaucaaucuaugaacaccauuacaaaguacacccagguuagcuggcgcggaaaagcugaucaggcccaggccucccaaaauucuuucgaagcugugagcgccgaggucgaccucaagggcacaugcgugcugaaacacaagaugcuugaggaauccuauagaagccggaagucuaucaccuguuacgaucuguccugcaacagcacauauuguaaacccacccucuacaugauuguuccuauccaugcuugcaauaugaugaagucuugucugaucgcccuggggcccuaucgcgugcaggucguguacgagagaacguacugcaugaccggagugcucauugaaggcaaauguuuugucccugaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcuccgaucuacgugcccacccuugacgauuuucggucuauggaggccuucagcggcauuuuucgcuccccucacggggaggaccacgaucuggcuggagaagagaucgccagcuauucuauugugggccccgcgaacgccaaagucccucauuccgcuagcucugacacgcucagccugaucgccuacuccgggauucccucuuauagcucccuuagcauccuggcuucuuccacagaagccaagcacguguucagcccgggauuuuucccucagcucaaucauaccaaaugcgauaagacagccaucccccugaccuggaccggcaugauugaccugccuggcuacuacgaggcuauccaccccuguacagucuucugcgugcucucugggcccggagcguccugugaggccuuuagcgaaggcgggauuuucaacaucacguccccuaugugccugguuucuaaacagaauagauuucggcuuaccgagcaacaggugaacuucgucugucagcgcguggacauggauauuaucguuuauugcaacggacaaagaaaggugauccugacaaagacccucgucauuggccaguguaucuacacaauuaccagccuguuuucccuucugccggggguggcucacucuaucgccguggaacucugcguucccggauuccauggcugggccacggcugcccugcuggucacauuuuguuucggcugggugcucauuccugcgcugacccuuaucauucugaccauccucaaauuuaucgcuaauauuuuccacacaagcaaccaggagaaucggcugaaguccgugcuucgcaaaaucaaggaagaguuugagaaaaccaaggggagcauggucugcgacguguguaaguaugaaugcgagacauacaaagaacugaaggcccauggaguuucuugcccccagucccaauguccuuauugcuucacgcacugugagcccaccgaagccgcuuuucaggcccauuacagagugugccaggucacacaccgguuccgcgaugaccucaaaaagaccgugacaccgcagaacuucaccccuggcuguuauagaacgcugaaucuguuucgguacaaaagcagaugcuacauuuucaccauguggguuugucuccuggugcuugagucuauccugugggcugccuccgcgagcgaggucccccucaacccuguguggaaugauaacgcccacgggguuggaucugugcccaugcauacagaccugcaacuggauuuuagccuuaccuccagcucuaaguauacauaccgccggagacucaccaauccucuggaagagacgcaguccauuaaccugcacaucgaaaucgaggagcagacaauuggcgucgacgugcaugcucucgggcacugguucgauggccgccugaaucuuaagaccagcuuucacugcuauggagccuguacaaaauacgaauaucccuggcauaccgcuaagugccacuacgagcgggacuaucaguacgaaaccuccuggggcuguaacccggccgauugcccuggggugggaacaggcugcacggcgugugggcuguaccucgaccaacugaaacccgucggaucugccuauaagaucauuaccaucagauacagccgcaaaguuugcgugcaguucggcgaggaaaaucuguguaaggugauugacaugaacgauugcuuugucacacggcaugugaagguuuguaucaucgggaccguguccaaauucucucagggcgacacacuucucuuuuucggaccccuggagggcgggggacugauuuuuaagcacuggugcaccagcacgugucaguucggcgauccuggggacaucauguccccgagagauaaaggauuucucugccccgaguucccuggcucuuuccgcaagaaauguaauuuugcuacaacaccccugugcgaauaugacgggaacauggucagcggcuacaagaaagugauggccaccauugauuccuuccaaucuuuuaacaccucuaccaugcauuucacagacgagcggaucgaauggaaggauccugacggaaugcuuagagaucacauuaauauccugguuacgaaggacaucgauuuugacaaccucggcgagaaucccuguaaaauugggcugcagaccuccagcaucgaaggagcuuggggcucuggggugggauucacacugaccugccuuauuucccucacagagugcccuaccuuucugacgagcaucaaggccugugacaaagccauuugcuauggcgcugagucugucacccugacacgcgggcagaacaccgugaagguuuccggcaaaggaggccacagcggguccacauucaaguguugccauggagaagaguguagccaaaucggccuccacgcggccgcuccccaucuggauaaggugaaugggauuucugaaaucgagaacaauaaagucuacgacgauggagccccgcagugcggcgugaaguguugguuugugaaaagcggcgaauggaucuccgggauuuucucuggaaacuggaucguccuuauuguucugugcguguuucuccuguucagccuggugcuucucuccguccuguguccugugcggaagcacaaaaagucuuga

SEQ ID NO: 13350 - RNA, 3408 nt, Artificial Sequence
  derived and/or modified CDS sequence (opt5) from HTNV(LongquanAa-09-541)__JQ912850.1__GP
augggcaucuggaaguggcuggugauggccagccucgucuggcccgcuuucacccugagaaacguuuacgacaugaaaauugagugcccucacacaguguccuuuggggaaaauucugugaucggauaugucgagcuuccgcccaugccucuggccgauacggcgcagauggugcccgaaagcuccuguaacauggacaaucaucaaucuaugaacaccauuacaaaguacacccagguuagcuggcggggcaaagcugaucaggcccaggccucccaaaauucuuucgaggcugugagcgccgaagucgaccucaaggggaucugcgugcugaaacacaagaugcuugaggaguccuaucgcagcagaaagucuauuacauguuacgaucuguccugcaacagcaccuauuguaaaccuacacucuacaugaucguucccauccaugcuugcaauaugaugaagucuugucugauugcccugggaccuuaucgggugcaggucguguacgaacgcaccuacugcaugacgggcgugcuccuggaggggaaauguuuugucccggaccaguccguugugagcaucauuaagcacggaaucuucgauauugcgucugugcauaucgucugcuuuuucguggccguuaaaggcaacaccuauaaacuuuuugaacaggugaagaaguccuuccaaagcacauguaauggcaccgagaacaagguccagggguacuauauuugcaucgugggaggcaauuccgcucccaucuacguuccuacacuggacgauuuuagaucuauggaggccuucagcgggauuuuucggagcccccacggagaagaccacgaucucgcuggcgaggaaaucgccagcuauucuauuguggggccugcgaacgccaaagucccccauuccgcuagcucugacacccugagccuuaucgccuacuccgggauuccgucuuauagcucccugagcauccucgcuucuuccacggaggccaagcacguguucagcccuggcuuuuucccccagcugaaucauacaaaaugcgauaagaccgccaucccucugacauggaccggcaugauugaccuccccggguacuacgaagcuauccaccccuguaccgucuucugcgugcugucuggaccuggcgcguccugugaggccuuuagcgagggaggaauuuucaacaucacauccccgaugugccuuguuucuaaacagaaucgcuuuagacugacggaacaacaggugaacuucgucugucagcggguggacauggauauuaucguuuauugcaacggccaacgcaaggugauccucaccaagacacuggucauugggcaguguaucuacaccauuacaagccuguuuucccuucuccccggaguggcucacucuaucgccguggagcugugcguuccuggcuuccauggcugggccaccgcugcccugcucgucacguuuuguuucgggugggugcugauucccgcgcuuacacugaucauucucaccauccugaaauuuaucgcuaauauuuuccacaccagcaaccaggaaaauagacuuaaguccgugcugcggaaaaucaaggaggaauuugagaaaacaaagggaagcauggucugcgacguguguaaguaugagugcgaaaccuacaaagagcucaaggcccauggcguuucuugcccucagucccaaugucccuauugcuucacacacugugaaccgacggaggccgcuuuucaggcccauuaccgcgugugccaggucacccacagauuccgggaugaccugaaaaagacagugaccccucagaacuucacacccggguguuaucgcacccugaaucucuuuagauacaaaagccggugcuacauuuucacgauguggguuugucugcuugugcuggaaucuauccucugggcugccuccgcgagcgaggucccucugaaccccguguggaaugauaacgcccacggaguuggcucugugccuaugcauaccgaccuggagcuugauuuuagccucacauccagcucuaaguauaccuacagacgccggcugacaaauccccuggaagagacccaauccauuaaccuccacaucgaaaucgaggagcagacgauuggggucgacgugcaugcucugggccacugguucgauggaagacuuaaucugaagacauccuuucacugcuauggcgccuguaccaaauacgaauauccguggcauacagcuaagugccacuacgagcgcgacuaucaguacgaaaccuccuggggguguaacccugccgauugccccggagugggcaccgggugcacagcguguggacucuaccuggaccagcugaaacccgucggcucugccuauaagaucauuacgauccgguacagcagaaaaguuugcgugcaauucggggaggaaaaucuuuguaaggugauugacaugaacgauugcuuugucacccgccaugugaagguuuguaucaucggcacaguguccaaauucucucagggagacacccuccuguuuuucggcccucuggaagggggaggccucauuuuuaagcacuggugcacaagcaccugucaguucggggauccgggagacaucaugucuccccgggauaaaggcuuucugugcccugaguuccccggguccuucagaaagaaauguaauuuugcuacgacaccucuuugcgaguaugacggcaacauggucagcggauacaagaaagugauggccaccauugauuccuuccagagcuuuaacaccucuacaaugcauuucaccgacgagcgcaucgaauggaaggaucccgacggcaugcugcgggaucacauuaauauccucguuacaaaggacaucgauuuugacaaccugggggagaauccuuguaaaauuggacugcaaacguccagcaucgaaggcgcuugggggucuggagugggcuucacccuuacaugccucauuucccugaccgagugccccacauuucugaccagcaucaaggccugugacaaagccauuugcuauggggcugagucugucacgcucaccagaggccagaacacagugaagguuuccggaaaaggcgggcacagcggauccaccuucaaguguugccauggcgaagaguguagccagaucgggcugcacgcggccgcuccgcaucuugauaaggugaauggaauuucugaaaucgagaacaauaaagucuacgacgauggcgccccucaaugcggcgugaaguguugguuugugaaaagcggggaauggaucuccggaauuuucucuggcaacuggaucguccugauuguucucugcguguuucugcuguucagccuugugcuccuguccguccugugucccgugcgcaagcacaaaaagucuuga

SEQ ID NO: 13351 - RNA, 3408 nt, Artificial Sequence
  derived and/or modified CDS sequence (opt5) from HTNV(LongquanAa-09-698)__JQ912854.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcauccugaaacacaagaugcuugaggaauccuaucgcagcagaaagucuauuaccuguuacgaucuguccugcaacagcacauauuguaaaccuacccucuacaugaucgugcccauccaugcuugcaauaugaugaagucuugucugauugcccuggggccuuaucggguucagguggucuacgagcgcacguacugcaugaccggagugcucaucgaaggcaaauguuuugugccggaccaguccgucguuagcauuaucaagcacgggauuuucgauaucgcgucugugcauauugugugcuuuuucgucgccgugaaaggaaacacauauaagcuguuugagcagguuaagaaauccuuccaaagcaccuguaauggcacagagaacaaggugcagggcuacuauaucugcaucgucgggggaaauuccgcucccauuuacgugccuacccuugacgauuuuagaucuauggaagccuucagcggcaucuuucggagcccccacggggaggaccacgaucuggcuggagaagagauugccuccuauucuaucguuggcccugcgaacgccaaagugccccauuccgcuagcucugacacgcucagccugauugccuacuccgggaucccgucuuauagcucccuuagcauccuggcuucuuccacagaagccaagcacgucuucagcccuggauuuuucccccagcucaaucauaccaaaugcgauaagacagccauuccucugaccuggaccggcaugaucgaccugcccggcuacuacgaggcuauucaccccuguacaguguucugcguccucucugggccuggagcguccugugaggccuuuagcgaaggcgggaucuucaacauuacguccccgaugugccuggugucuaaacagaaucgcuuuagacuuaccgagcaacagguuaacuucgugugucagcgggucgacauggauaucaucguguauugcaacggacaacgcaagguuauucugacaaagacccucgugaucggccaguguauuuacacaaucaccagccuguuuucccuucugcccggggucgcucacucuauugccguggaacucugcgugccuggauuccauggcugggccacggcugcccugcugguuacauuuuguuucggcuggguccucauccccgcgcugacccuuauuauccugaccauccucaaauuuauugcuaauaucuuccacacaagcaaccaggagaauagacugaaguccgugcuucggaaaauuaaggaagaguuugagaaaaccaaggggagcauggugugcgacgucuguaaguaugaaugcgagacauacaaagaacugaaggcccauggagugucuugcccucagucccaaugucccuauugcuucacgcacugugagccgaccgaagccgcuuuucaggcccauuaccgcguuugccaggugacacacagauuccgggaugaccucaaaaagaccgucacaccucagaacuucacccccggcuguuaucgcacgcugaaucuguuuagauacaaaagccggugcuacaucuucaccaugugggugugucuccugguucuugagucuauucugugggcugccuccgcgagcgaggugccucucaaccccgucuggaaugauaacgcccacggggugggaucuguuccuaugcauacagaccuggaacuggauuuuagccuuaccuccagcucuaaguauacauacagacgccggcucaccaauccccuggaggaaacgcaauccaucaaccugcacaucgagauugaggaacagacaaucggcguggacguccaugcucucgggcacugguucgauggcagacugaaucuuaagaccagcuuucacugcuauggagccuguacaaaauacgaguauccguggcauaccgcuaagugccacuacgaacgcgacuaucaguacgagaccuccuggggcuguaacccugccgauugccccggggugggaacaggcugcacggcgugugggcuguaccucgaccagcugaaacccgugggaucugccuauaagauuaucaccauucgguacagcagaaaagucugcguucaauucggcgaagagaaucuguguaaggugaucgacaugaacgauugcuuugugacacgccaugucaagguguguaucauugggaccguuuccaaauucucucagggcgacacacuucucuuuuucggaccucuggagggcgggggacugaucuuuaagcacuggugcaccagcacgugucaguucggcgauccgggggacauuaugucuccccgggauaaaggauuucucugcccugaguuccccggcuccuucagaaagaaauguaauuuugcuacaaccccucugugcgaguaugacgggaacauggugagcggcuacaagaaagucauggccaccaucgauuccuuccagagcuuuaacacaucuaccaugcauuucacagacgaacgcauugaguggaaggaucccgacggaaugcuucgggaucacaucaauauccuggugacgaaggacauugauuuugacaaccucggcgaaaauccuuguaaaaucgggcugcaaaccuccagcauugagggagcuuggggcucugggguuggauucacacugaccugccuuaucucccucacagagugccccaccuuucugacgagcauuaaggccugugacaaagccaucugcuauggcgcugaaucugugacccugacaagagggcagaacaccgucaagguguccggcaaaggaggccacagcggguccacauucaaguguugccauggagaggaauguagccagauuggccuccacgcggccgcuccgcaucuggauaagguuaaugggaucucugagaucgaaaacaauaaaguguacgacgauggagccccucaaugcggcgucaaguguugguuugugaaaagcggcgaguggauuuccgggaucuucucuggaaacuggauugugcuuaucguccugugcguuuuucuccuguucagccuggugcuucucuccgugcugugucccguccgcaagcacaaaaagucuuga

SEQ ID NO: 13352 - RNA, 3408 nt, Artificial Sequence
  derived and/or modified CDS sequence (opt5) from HTNV(LongquanAa-10-393)__JQ912859.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccuccuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcagagugcucauucccgcgcugacccuuaucauucugaccauccucaaauuuaucgcuaauauuuuccacacaagcaaccaggagaaucggcugaaguccgugcuucgcaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuacagagugugccaggucacacaccgguuccgcgaugaccucaaaaagaccgugacaccucagaacuucacccccggcuguuauagaacgcugaaucuguuucgguacaaaagcagaugcuacauuuucaccauguggguuugucuccuggugcuugagucuauccugugggcugccuccgcgagcgaggucccucucaaccccguguggaaugauaacgcccacgggguuggaucugugccuaugcauacagaccuggaacuggauuuuagccuuaccuccagcucuaaguauacauaccgccggagacucaccaauccccuggaggaaacgcaauccauuaaccugcacaucgagaucgaggaacagacaauuggcgucgacgugcaugcucucgggcacugguucgauggccgccugaaucuuaagaccagcuuucacugcuauggagccuguacaaaauacgaguauccguggcauaccgcuaagugccacuacgaacgggacuaucaguacgagaccuccuggggcuguaacccugccgauugccccggggugggaacaggcugcacggcgugugggcuguaccucgaccagcugaaacccgucggaucugccuauaagaucauuaccaucagauacagccgcaaaguuugcgugcaauucggcgaagagaaucuguguaaggugauugacaugaacgauugcuuugucacacggcaugugaagguuuguaucaucgggaccguguccaaauucucucagggcgacacacuucucuuuuucggaccucuggagggcgggggacugauuuuuaagcacuggugcaccagcacgugucaguucggcgauccgggggacaucaugucccccagagauaaaggauuucucugcccugaguuccccggcucuuuccgcaagaaauguaauuuugcuacaaccccucugugcgaguaugacgggaacauggucagcggcuacaagaaagugauggccaccauugauuccuuccagagcuuuaacacaucuaccaugcauuucacagacgaacggaucgaguggaaggaucccgacggaaugcuuagagaucacauuaauauccugguuacgaaggacaucgauuuugacaaccucggcgaaaauccuuguaaaauugggcugcaaaccuccagcaucgagggagcuuggggcucuggggugggauucacacugaccugccuuauuucccucacagagugccccaccuuucugacgagcaucaaggccugugacaaagccauuugcuauggcgcugaaucugucacccugacacgcgggcagaacaccgugaagguuuccggcaaaggaggccacagcggguccacauucaaguguugccauggagaggaauguagccagaucggccuccacgcggccgcuccgcaucuggauaaggugaaugggauuucugagaucgaaaacaauaaagucuacgacgauggagccccucaaugcggcgugaaguguugguuugugaaaagcggcgaguggaucuccgggauuuucucuggaaacuggaucguccuuauuguucugugcguguuucuccuguucagccuggugcuucucuccguccugugucccgugcggaagcacaaaaagucuuga

SEQ ID NO: 13353 - RNA, 3408 nt, Artificial Sequence
  derived and/or modified CDS sequence (opt5) from HTNV(LongquanAa-10-58)__JQ912861.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccuccuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaagcaaccaggagaauagacugaaguccgugcuucggaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuaccgcgugugccaggucacacacagauuccgggaugaccucaaaaagaccgugacaccucagaacuucacccccggcuguuaucgcacgcugaaucuguuuagauacaaaagccggugcuacauuuucaccauguggguuugucuccuggugcuugagucuauccugugggcugccuccgcgagcgaggucccucucaaccccguguggaaugauaacgcccacgggguuggaucugugccuaugcauacagaccuggaacuggauuuuagccuuaccuccagcucuaaguauacauacagacgccggcucaccaauccccuggaggaaacgcaauccauuaaccugcacaucgagaucgaggaacagacaauuggcgucgacgugcaugcucucgggcacugguucgauggcagacugaaucuuaagaccagcuuucacugcuauggagccuguacaaaauacgaguauccguggcauaccgcuaagugccacuacgaacgcgacuaucaguacgagaccuccuggggcuguaacccugccgauugccccggggugggaacaggcugcacggcgugugggcuguaccucgaccagcugaaacccgucggaucugccuauaagaucauuaccauccgguacagcagaaaaguuugcgugcaauucggcgaagagaaucuguguaaggugauugacaugaacgauugcuuugucacacgccaugugaagguuuguaucaucgggaccguguccaaauucucucagggcgacacacuucucuuuuucggaccucuggagggcgggggacugauuuuuaagcacuggugcaccagcacgugucaguucggcgauccgggggacaucaugucuccccgggauaaaggauuucucugcccugaguuccccggcuccuucagaaagaaauguaauuuugcuacaaccccucugugcgaguaugacgggaacauggucagcggcuacaagaaagugauggccaccauugauuccuuccagagcuuuaacacaucuaccaugcauuucacagacgaacgcaucgaguggaaggaucccgacggaaugcuucgggaucacauuaauauccugguuacgaaggacaucgauuuugacaaccucggcgaaaauccuuguaaaauugggcugcaaaccuccagcaucgagggagcuuggggcucuggggugggauucacacugaccugccuuauuucccucacagagugccccaccuuucugacgagcaucaaggccugugacaaagccauuugcuauggcgcugaaucugucacccugacaagagggcagaacaccgugaagguuuccggcaaaggaggccacagcggguccacauucaaguguugccauggagaggaauguagccagaucggccuccacgcggccgcuccgcaucuggauaaggugaaugggauuucugagaucgaaaacaauaaagucuacgacgauggagccccucaaugcggcgugaaguguugguuugugaaaagcggcgaguggaucuccgggauuuucucuggaaacuggaucguccuuauuguucugugccucuuucugcuguucagccuugugcuccuguccgugcugugucccguccgcaagcacaaaaagucuuga

SEQ ID NO: 13354 - RNA, 3408 nt, Artificial Sequence
  derived and/or modified CDS sequence (opt5) from HTNV(LongquanAa-10-74)__JQ912864.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccagcuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaagcaaccaggagaauagacugaaguccgugcuucggaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuaccgcgugugccaggucacacacagauuccgggaugaccucaaaaagaccgugacaccucagaacuucacccccggcuguuaucgcacgcugaaucuguuuagauacaaaagccggugcuacauuuucaccauguggguuugucuccuggugcuugagucuauccugugggcugccuccgcgagcgaggucccucucaaccccguguggaaugauaacgcccacgggguuggaucugugccuaugcauacagaccuggaacuggauuuuagccuuaccuccagcucuaaguauacauacagacgccggcucaccaauccccuggaggaaacgcaauccauuaaccugcacaucgagaucgaggaacagacaauuggcgucgacgugcaugcucucgggcacugguucgauggcagacugaaucuuaagaccagcuuucacugcuauggagccuguacaaaauacgaguauccguggcauaccgcuaagugccacuacgaacgcgacuaucaguacgagaccuccuggggcuguaacccugccgauugccccggggugggaacaggcugcacggcgugugggcuguaccucgaccagcugaaacccgucggaucugccuauaagaucauuaccauccgguacagcagaaaaguuugcgugcaauucggcgaagagaaucuguguaaggugauugacaugaacgauugcuuugucacacgccaugugaagguuuguaucaucgggaccguguccaaauucucucagggcgacacacuucucuuuuucggaccucuggagggcgggggacugauuuuuaagcacuggugcaccagcacgugucaguucggcgauccgggggacaucaugucuccccgggauaaaggauuucucugcccugaguuccccggcuccuucagaaagaaauguaauuuugcuacaaccccucugugcgaguaugacgggaacauggucagcggcuacaagaaagugauggccaccauugauuccuuccagagcuuuaacacaucuaccaugcauuucacagacgaacgcaucgaguggaaggaucccgacggaaugcuucgggaucacauuaauauccugguuacgaaggacaucgauuuugacaaccucggcgaaaauccuuguaaaauugggcugcaaaccuccagcaucgagggagcuuggggcucuggggugggauucacacugaccugccuuauuucccucacagagugccccaccuuucugacgagcaucaaggccugugacaaagccauuugcuauggcgcugaaucugucacccugacaagagggcagaacaccgugaagguuuccggcaaaggaggccacagcggguccacauucgaguguugccauggagaagaguguagccagaucggccuccacgcggccgcuccgcaucuggauaaggugaaugggauuucugaaaucgagaacaauaaggucuacgacgauggagccccucaaugcggcgugaaauguugguuugugaaguccggcgaguggaucuccgggauuuucucuggaaacuggaucguccuuauuguucugugcguguuucuccuguucagccuggugcuucucuccguccugugucccgugcgcaaacacaagaaaucuuga

SEQ ID NO: 13355 - RNA, 3408 nt, Artificial Sequence
  derived and/or modified CDS sequence (opt5) from HTNV(LongquanAa-10-98)__JQ912866.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgagcuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcugcuugaacaggugaagaaauccuuucaaagcaccuguaaugacacagagaacaagguccagggcuacuauauuugcaucgugggcggaaauuccgcucccaucuacguuccuacccuggaugacuucagaucuauggaggccuuuagcgggauuuuccggagcccccacggcgaggaucacgaccucgcuggggaagagaucgccuccuauucuauugugggaccugcgaacgccaaagucccccauuccgcuagcucugauacgcugagccuuaucgccuacuccggcauuccgucuuauagcucccugagcauccucgcuucuuccacagaagccaagcacguguuuagcccuggguucuuuccccagcugaaucauaccaaaugcgacaagacagccaucccucugaccuggaccggaaugauugaccuccccggcuacuacgaggcuauccaccccuguacagucuucugcgugcugucuggcccuggggcguccugugaggccuucagcgaaggaggcauuuuuaacaucacguccccgaugugccuuguuucuaaacagaaucgcuucagacugaccgagcaacaggugaacuuugucugucagcggguggauauggacauuaucguuuauugcaacgggcaacgcaaggugauccucacaaagacccuggucauuggacaguguaucuacacaauuaccagccuuuucucccugcuccccggcguggcucacucuaucgccguggaacugugcguuccuggguuucauggaugggccacggcugcccugcucgucacauucuguuuuggcugggugcugauucccgcgcuuacccugaucauucucaccauccugaaauucaucgcuaauauuuuucacacaagcaaccaggagaauagacuuaaguccgugcugcggaaaaucaaggaagaguucgagaaaaccaagggcagcauggucugcgauguguguaaguaugaaugcgagacauacaaagaacucaaggcccaugggguuucuugcccucagucccaaugucccuauugcuuuacgcacugugagccgaccgaagccgcuuuccaggcccauuaccgcgugugccaggucacacacagauuucgggacgaucugaaaaagaccgugacaccucagaacuucacccccggauguuaucgcacgcugaaucucuucagauacaaaagccggugcuacauuuuuaccauguggguuugucugcuugugcuggagucuauccucugggcugccuccgcgagcgaggucccucugaaccccguguggaaugacaacgcccacggcguugggucugugccuaugcauacagaucuggaacuugacuucagccucaccuccagcucuaaguauacauacagacgccggcugaccaauccccuggaggaaacgcaauccauuaaccuccacaucgagaucgaggaacagacaauuggagucgaugugcaugcucugggccacugguuugacgggagacuuaaucugaagaccagcuuccacugcuauggcgccuguacaaaauacgaguauccguggcauaccgcuaagugccacuacgaacgcgauuaucaguacgagaccuccuggggauguaacccugccgacugccccggcguggggacaggaugcacggcguguggccucuaccuggaccagcugaaacccgucgggucugccuauaagaucauuaccauccgguacagcagaaaaguuugcgugcaauuuggagaagagaaucuuuguaaggugauugauaugaacgacugcuucgucacacgccaugugaagguuuguaucaucggcaccguguccaaauuuucucagggggauacacuccuguucuuuggcccucuggagggaggcgggcucauuuucaagcacuggugcaccagcacgugucaguuuggagacccgggcgauaucaugucuccccgggacaaaggguuccugugcccugaauuucccggauccuucagaaagaaauguaauuucgcuacaaccccucuuugcgaguaugauggcaacauggucagcggguacaagaaagugauggccaccauugacuccuuucagagcuucaacacaucuaccaugcauuuuacagaugaacgcaucgaguggaaggaccccgauggcaugcugcgggaccacauuaauauccucguuacgaaggauaucgacuucgacaaccugggagaaaauccuuguaaaauuggccugcaaaccuccagcaucgagggggcuuggggaucuggcgugggguuuacacuuaccugccucauuucccugacagagugccccaccuuccugacgagcaucaaggccugugauaaagccauuugcuauggagcugaaucugucacccucacaagaggccagaacaccgugaagguuuccgggaaaggcggacacagcggcuccacauuuaaguguugccauggggaggaauguagccagaucggacugcacgcggccgcuccgcaucuugacaaggugaauggcauuucugagaucgaaaacaauaaagucuacgaugacggggccccucaaugcggagugaaguguugguucgugaaaagcggcgaguggaucuccggcaucuuuucugggaacuggauuguccugauuguucucugcguguuccugcuguuuagccuugugcuccuguccguccugugucccgugcgcaagcacaaaaagucuuga

SEQ ID NO: 13356 - RNA, 3408 nt, Artificial Sequence
  derived and/or modified CDS sequence (opt5) from HTNV(LongquanAa-11-452)__KC344264.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgagcuuccgcccaugccucuggccgauacggcgcagauggugcccgagagcuccuguaacauggacaaucaucaaucuauuaacaccaucacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuauuaccuguuacgaucuguccugcaacagcacauauuguaaaccuacccucuacaugaucguucccauccaugcuugcaauaugaugaagucuugucugauugcccuggggccuuaucgggugcaggucguguacgagcgcacguacugcaugaccggagugcucaucgaaggcaaauguuuugucccggaccaguccguugugagcauuaucaagcacgggauuuucgauaucgcgucugugcauauugucugcuuuuucguggccguuaaaggaaacacauauaagcugcuugaacaggugaagaaauccuuucaaagcaccuguaaugacacagagaacaagguccagggcuacuauaucugcaucgugggcggaaauuccgcucccauuuacguuccuacccuggaugacuucagaucuauggaggccuuuagcgggaucuuccggagcccccacggcgaggaucacgaccucgcuggggaagagauugccuccuauucuaucauuggaccugcgaacgccaaagugccccauuccgcuagcucugauacgcugagccuuaucgccuacuccggcaucccgucuuauagcucccugagcauucucgcuucuuccacagaagccaagcacgucuuuagcccuggguucuuuccccagcugaaucauaccaaaugcgacaagacagccaucccucugaccuggaccggaaugauugaccuccccggcuacuacgaggcuauccaccccuguacaguguucugcguccugucuggcccuggggcguccugugaggccuucagcgaaggaggcauuuuuaacaucacguccccgaugugccuugugucuaaacagaaucgcuucagacugaccgagcaacagguuaacuuugugugucagcgggucgauauggacaucauuguguauugcaacgggcaacgcaagguuauccucacaaagacccuggugauuggacaguguaucuacacaauuaccagccuuuucucccugcuccccggcgucgcucacucuaucgccguggaacugugcgugccuggguuucauggaugggccacggcugcccugcucguuacauucuguuuuggcuggguccugauucccgcgcuuacccugaucauccucaccauucugaaauucaucgcuaauauuuuucacacaagcaaccaggagaauagacuuaaguccgugcugcggaaaaucaaggaagaguucgagaaaaccaagggcagcauggugugcgaugucuguaaguaugaaugcgagacauacaaagaacucaaggcccauggggugucuugcccucagucccaaugucccuauugcuuuacgcacugugagccgaccgaagccgcuuuccaggcccauuaccgcguuugccaggugacacacagauuucgggacgaucugaaaaagaccgucacaccucagaacuucacccccggauguuaucgcacgcugaaucucuucagauacaaaagccggugcuacauuuuuaccaugugggugugucugcuuguucuggagucuauccucugggcugccuccgcgagcgaggugccucugaaccccgucuggaaugacaacgcccacggcguggggucuguuccuaugcauacagaucuggaacuugacuucagccucaccuccagcucuaaguauacauacagacgccggcugaccaauccccuggaggaaacgcaauccaucaaccuccacauugagaucgaggaacagacaauuggaguggauguccaugcucugggccacugguuugacgggagacuuaaucugaagaccagcuuccacugcuauggcgccuguacaaaauacgaguauccguggcauaccgcuaagugccacuacgaacgcgauuaucaguacgagaccuccuggggauguaacccugccgacugccccggcguggggacaggaugcacggcguguggccucuaccuggaccagcugaaacccguggggucugccuauaagaucauuaccauccgguacagcagaaaagucugcguucaauuuggagaagagaaucuuuguaaggugaucgauaugaacgacugcuucgugacacgccaugucaagguguguauuaucggcaccguuuccaaauuuucucagggggauacacuccuguucuuuggcccucuggagggaggcgggcucauuuucaagcacuggugcaccagcacgugucaguuuggagacccgggcgauaucaugucuccccgggacaaaggguuccugugcccugaauuucccggauccuucagaaagaaauguaauuucgcuacaaccccucuuugcgaguaugauggcaacauggugagcggguacaagaaagucauggccaccauugacuccuuucagagcuucaacacaucuaccaugcauuuuacagaugaacgcaucgaguggaaggaccccgauggcaugcugcgggaccacaucaauauucucgugacgaaggauaucgacuucgacaaccugggagaaaauccuuguaaaauuggccugcaaaccuccagcaucgagggggcuuggggaucuggcguuggguuuacacuuaccugccucauuucccugacagagugccccaccuuccugacgagcaucaaggccugugauaaagccauuugcuauggagcugaaucugugacccucacaagaggccagaacaccgucaagguguccgggaaaggcggacacagcggcuccacauuuaaguguugccauggggaggaauguagccagaucggacugcacgcggccgcuccgcaucuugacaagguuaauggcaucucugagauugaaaacaauaaaguguacgaugacggggccccucaaugcggagucaaguguugguucgugaaaagcggcgaguggaucuccggcaucuuuucugggaacuggauugugcugauuguccucugcguuuuccugcuguuuagccuugugcuccuguccgugcugugucccguccgcaagcacaaaaagucuuga

SEQ ID NO: 13357 - RNA, 3408 nt, Artificial Sequence
  derived and/or modified CDS sequence (opt5) from HTNV(LongquanAa-11-473)__KC344263.1__GP
augggcaucuggaaguggcuggugauggccagccucgucuggcccgcuuucacccugagaaacguuuacgacaugaaaauugagugcccucacacaguguccuuuggggaaaauucugugaucggauaugucgagcuuccgcccaugccucuggccgauacggcgcagauggugcccgaaagcuccuguaacauggacaaucaucaaucuaugaacaccauuacaaaguacacccagguuagcuggcggggcaaagcugaucaggcccaggccucccaaaauucuuucgaggcugugagcgccgaagucgaccucaaggggaucugcgugcugaaacacaagaugcuugaggaguccuaucgcagcagaaagucuauuacauguuacgaucuguccugcaacagcaccuauuguaaaccuacacucuacaugaucguucccauccaugcuugcaauaugaugaagucuugucugauugcccugggaccuuaucgggugcaggucguguacgaacgcaccuacugcaugacgggcgugcuccuggaggggaaauguuuugucccggaccaguccguugugagcaucauuaagcacggaaucuucgauauugcgucugugcauaucgucugcuuuuucguggccguuaaaggcaacaccuauaaacuuuuugaacaggugaagaaguccuuccaaagcacauguaaugacaccgagaacaagguccagggcuacuauauuugcaucguugggggaaauuccgcucccaucuacgugccuacacuggaugacuuuagaucuauggaggccuucagcggcauuuuucggagcccccacggggaagaucacgaccucgcuggagaggaaaucgccuccuauucuauugugggcccugcgaacgccaaagucccccauuccgcuagcucugauacccugagccuuaucgccuacuccgggauuccgucuuauagcucccugagcauccucgcuaauucuacggaggccaagcacguguucuccccuggauuuuucccccagcugaaccauacaaaaugcgacaagaccgccaucccucugauuuggacaggcaugaucgaccuccccggcuacuacgaagcuauucaccccuguaccgucuucugcgugcugagcgggccuggagcgucuugugaggccuuuuccgagggcgggaucuucaauauuaccagcccgaugugccuuguuuccaaacagaaccgcuuuagacugacagaacaacagaucaacuucgugugucagcgggucgauguggacaucauuguuuauugcaauggacaacgcaaggugauccucacgaagacccuggucauuggccaguguaucuacacaauuaccucucuuuuuagccugcuccccgggguggcucacuccaucgccguggagcugugcguuccuggauuccauggcugggccacagcugcccugcucgucaccuuuuguuucggcugggugcugauucccgcgcuuacgcugaucauccucacaauucugaaauuuaucgcuaacauuuuccacaccucuaaucaggaaaacagacuuaagagcgugcugcggaaaaucaaggaggaauuugagaaaaccaagggguccauggucugcgauguguguaaguaugagugcgaaacauacaaagagcucaaggcccauggaguuagcugcccucagucucaaugucccuauugcuucacccacugugaaccgacagaggccgcuuuucaggcccauuaccgcgugugccaggucacgcacagauuccgggacgaucugaaaaagaccgugacaccucagaauuucacccccggcuguuaucgcacacugaaccucuuuagauacaaaucccggugcuacauuuucaccauguggguuugucugcuugugcuggaaagcauccucugggcugccucugcguccgaggucccucugaaucccguguggaacgacaaugcccacgggguuggaagcgugccuaugcauacggaucuggagcuugacuuuucucucaccagcuccagcaaguauacauacagacgccggcugaccaacccccuggaagagacacaaucuaucaaucuccacauugaaaucgaggagcagaccauuggcgucgaugugcaugcucuggggcacugguucgacggcagacuuaaccugaagacguccuuucacugcuauggagccuguacaaaauacgaauauccguggcauaccgcuaagugccacuacgagcgcgauuaucaguacgaaacaagcuggggcuguaauccugccgacugccccggggugggaaccggcugcaccgcgugugggcucuaccuggaccagcugaaacccgucggauccgccuauaagaucauuacaauccgguacucuagaaaaguuugcgugcaauucggcgaggaaaaccuuuguaaggugaucgauaugaaugacugcuuugucacgcgccaugugaagguuuguauuaucgggaccgugagcaaauucucccagggcgauacacuccuguuuuucggaccucuggagggcgggggacucauuuuuaagcacuggugcaccucuacaugucaguucggcgacccgggggauaucaugagcccccgggacaaaggauuucugugcccugaguuccccggcuccuucagaaagaaauguaacuuugcuaccacgccucuuugcgaauaugaugggaacauggucucuggcuacaagaaagugauggccacaauugacagcuuccaguccuuuaauaccagcaccaugcauuucacagaugagcgcaucgaauggaaggaccccgauggaaugcugcgggaccacaucaacauucucguuaccaaggauaucgacuuugacaaucugggcgagaacccuuguaaaauugggcugcaaacaucuuccaucgaaggagcuuggggcagcggggugggauucacgcuuaccugccucauuucucugacagagugccccaccuuucugacauccaucaaggccugugauaaagccauuugcuauggcgcugagagcgucacccucacgagagggcagaauaccgugaagguuucuggcaaaggaggccacuccgggagcacauucaaguguugccauggagaagaguguucccagaucggccugcacgcggccgcuccgcaucuugacaaggugaacgggaucagcgaaauugagaauaacaaagucuacgaugacggagccccucaaugcggcgugaaguguugguuugugaaaucuggcgaauggaucagcgggauuuucuccggaaauuggaucguccugauuguucucugcguguuucugcuguucucucuugugcuccugagcguccugugucccgugcgcaagcacaaaaaguccuga

SEQ ID NO: 13358 - RNA, 3408 nt, Artificial Sequence
  derived and/or modified CDS sequence (opt5) from HTNV(LongquanAa-11-642)__KC344262.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcuccuggaaggcaaauguuuugucccggaccaguccguugugagcauuaucaagcacgggauuuucgauaucgcgucugugcauauugucugcuuuuucguggccguuaaaggaaacacauauaaacuuuuugaacaggugaagaaguccuuccaaagcaccuguaaugacacagagaacaagguccagggcuacuauaucugcauugugggcggaaauuccgcucccaucuacguuccuacccuggaugacuuuagaucuauggaggccuucagcgggaucuuucggagcccccacggcgaggaucacgaccucgcuggggaagagauugccagcuauucuaucgugggaccugcgaacgccaaagucccccauuccgcuagcucugauacgcugagccuuauugccuacuccggcaucccgucuuauagcucccugagcauucucgcuucuuccacagaagccaagcacguguucagcccuggguuuuucccccagcugaaucauaccaaaugcgacaagacagccaucccucugaucuggaccggaaugauugaccuccccggcuacuacgaggcuauccaccccuguaccgucuucugcgugcugucuggcccuggggcguccugugaggccuuuagcgaaggaggcauuuucaacaucacauccccgaugugccuuguuucuaaacagaaucgcuuuagacugacggagcaacaggugaacuucgucugucagcggguggauguugacauuaucguguauugcaacgggcaacgcaaggucauccucaccaagacacuggugauuggacaguguaucuacaccauuacaagccuguuuucccuucuccccggcguggcucacucuaucgccguugaacugugcgucccuggguuccauggaugggccaccgcugcccugcucgugacguuuuguuucggcugggugcugauucccgcgcuuacacugaucauucucaccauccugaaauuuaucgcuaauauuuuccacaccagcaaccaggagaauagacuuaaguccguccugcggaaaaucaaggaagaguuugagaaaacaaagggcagcauggugugcgauguuuguaaguaugaaugcgagaccuacaaagaacucaaggcccauggggugucuugcccucagucccaaugucccuauugcuucacacacugugagccgacggaagccgcuuuucaggcccauuaccgcgucugccaggugacccacagauuccgggacgaucugaaaaagacaguuaccccucagaacuucacacccggauguuaucgcacccugaaucucuuuagauacaaaagccggugcuacauuuucacgaugugggugugucugcuuguccuggagucuauccucugggcugccuccgcgagcgaggugccucugaaccccguuuggaaugacaacgcccacggcguggggucugucccuaugcauaccgaucuggaacuugacuuuagccucacauccagcucuaaguauaccuacagacgccggcugacaaauccccuggaggaaacccaauccauuaaccuccacaucgagaucgaggaacagacgauuggaguggaugugcaugcucugggccacugguucgacgggagacuuaaucugaagacauccuuucacugcuauggcgccuguaccaaauacgaguauccguggcauacagcuaagugccacuacgaacgcgauuaucaguacgagaccuccuggggauguaacccugccgacugccccggcgucgggaccggaugcacagcguguggccucuaccuggaccagcugaaacccguugggucugccuauaagaucauuacgauccgguacagcagaaaagugugcgugcaauucggagaagagaaucuuuguaaggucauugauaugaacgacugcuuugugacccgccauguuaagguguguaucaucggcacagucuccaaauucucucagggggauacccuccuguuuuucggcccucuggagggaggcgggcucauuuuuaagcacuggugcacaagcaccugucaguucggagacccgggcgauaucaugucuccccgggacaaaggguuucugugcccugaguuccccggauccuucagaaagaaauguaauuuugcuacgacaccucuuugcgaguaugauggcaacauggugagcggguacaagaaaguuauggccaccauugacuccuuccagagcuuuaacaccucuacaaugcauuucaccgaugaacgcaucgaguggaaggaccccgauggcaugcugcgggaccacauuaauauccucgugacaaaggauaucgacuuugacaaccugggagaaaauccuuguaaaauuggccugcaaacguccagcaucgagggggcuuggggaucuggcgucggguucacccuuacaugccucauuucccugaccgagugccccacauuucugaccagcaucaaggccugugauaaagccauuugcuauggagcugaaucugugacgcucaccagaggccagaacacaguuaagguguccgggaaaggcggacacagcggcuccaccuucaaguguugccauggggaggaauguagccagaucggacugcacgcggccgcuccgcaucuugacaaggucaauggcauuucugagaucgaaaacaauaaaguguacgaugacggggccccucaaugcggagugaaguguugguuugucaaaagcggcgaguggaucuccggcauuuucucugggaacuggaucguucugauugugcucugcguguuucugcuguucagccuuguccuccuguccgugcugugucccguucgcaagcacaaaaagucuuga

SEQ ID NO: 13359 - RNA, 3408 nt, Artificial Sequence
  derived and/or modified CDS sequence (opt5) from HTNV(LongquanAa-11-774)__KC344257.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccagcuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaagcaaccaggagaauagacugaaguccgugcuucggaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuaccgcgugugccaggucacacacagauuccgggaugaccucaaaaagaccgugacaccucagaacuucacccccggcuguuaucgcacgcugaaucuguuuagauacaaaagccggugcuacauuuucaccauguggguuugucuccuggugcuugagucuauccugugggcugccuccgcgagcgaggucccucucaaccccguguggaaugauaacgcccacgggguuggaucugugccuaugcauacagaccuggaacuggauuuuagccuuaccuccagcucuaaguauacauacagacgccggcucaccaauccccuggaggaaacgcaauccauuaaccugcacaucgagaucgaggaacagacaauuggcgucgacgugcaugcucucgggcacugguucgauggcagacugaaucuuaagaccagcuuucacugcuauggagccuguacaaaauacgaguauccguggcauaccgcuaagugccacuacgaacgcgacuaucaguacgagaccuccuggggcuguaacccugccgauugccccggggugggaacaggcugcacggcgugugggcuguaccucgaccagcugaaacccgucggaucugccuauaagaucauuaccauccgguacagcagaaaaguuugcgugcaauucggcgaagagaaucuguguaaggugauugacaugaacgauugcuuugucacacgccaugugaagguuuguaucaucgggaccguguccaaauucucucagggcgacacacuucucuuuuucggaccucuggagggcgggggacugauuuuuaagcacuggugcaccagcacgugucaguucggcgauccgggggacaucaugucuccccgggauaaaggauuucucugcccugaguuccccggcuccuucagaaagaaauguaauuuugcuacaaccccucugugcgaguaugacgggaacauggucagcggcuacaagaaagugauggccaccauugauuccuuccagagcuuuaacacaucuaccaugcauuucacagacgaacgcaucgaguggaaggaucccgacggaaugcuucgggaucacauuaauauccugguuacgaaggacaucgauuuugacaaccucggcgaaaauccuuguaaaauugggcugcaaaccuccagcaucgagggagcuuggggcucuggggugggauucacacugaccugccuuauuucccucacagagugccccaccuuucugacgagcaucaaggccugugacaaagccauuugcuauggcgcugaaucugucacccugacaagagggcagaacaccgugaagguuuccggcaaaggaggccacagcggguccacauucaaguguugccauggagagaaguguagccagaucggccuccacgcggccgcuccgcaucuggauaaagugaaugggauuucugaaaucgagaacaauaaggucuacgacgauggagccccucaaugcggcgugaaauguugguuugugaaguccggcgaauggaucuccgggauuuucucuggaaacuggaucguccuuauuguucugugcguguuucuccuguucagccuggugcuucucuccguccugugucccgugcgcaaacacaagaagucuuga

SEQ ID NO: 13360 - RNA, 3408 nt, Artificial Sequence
  derived and/or modified CDS sequence (opt5) from HTNV(LongquanMf-09-8)__JQ912875.1__GP
auggagaucuggaaguggcuggugauggccagccucgucuggcccgcuuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccuccuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaagcaaccaggagaauagacugaaguccgugcuucggaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuaccgcgugugccaggucacacacagauuccgggaugaccucaaaaagaccgugacaccucagaacuucacccccggcuguuaucgcacgcugaaucuguuuagauacaaaagccggugcuacauuuucaccauguggguuugucuccuggugcuugagucuauccugugggcugccuccgcgagcgaggucccucucaaccccguguggaaugauaacgcccacgggguuggaucugugccuaugcauacagaccuggaacuggauuuuagccuuaccuccagcucuaaguauacauacagacgccggcucaccaauccccuggaggaaacgcaauccauuaaccugcacaucgagaucgaggaacagacaauuggcgucgacgugcaugcucucgggcacugguucgauggcagacugaaucuuaagaccagcuuucacugcuauggagccuguacaaaauacgaguauccguggcauaccgcuaagugccacuacgaacgcgacuaucaguacgagaccuccuggggcuguaacccugccgauugccccggggugggaacaggcugcacggcgugugggcuguaccucgaccagcugaaacccgucggaucugccuauaagaucauuaccauccgguacagcagaaaaguuugcgugcaauucggcgaagagaaucuguguaaggugauugacaugaacgauugcuuugucacacgccaugugaagguuuguaucaucgggaccguguccaaauucucucagggcgacacacuucucuuuuucggaccucuggagggcgggggacugauuuuuaagcacuggugcaccagcacgugucaguucggcgauccgggggacaucaugucuccccgggauaaaggauuucucugcccugaguuccccggcuccuucagaaagaaauguaauuuugcuacaaccccucugugcgaguaugacgggaacauggucagcggcuacaagaaagugauggccaccauugauuccuuccagagcuuuaacacaucuaccaugcauuucacagacgaacgcaucgaguggaaggaucccgacggaaugcuucgggaucacauuaauauccugguuaacaaggacaucgauuuugacaaucucggcgaaaacccuuguaaaauugggcugcaaacguccagcaucgagggagcuuggggcucuggggugggauucacccugacaugccuuauuucccucaccgagugccccacauuucugaccagcaucaaggccugugacaaagccauuugcuauggcgcugaaucugucacgcugaccagagggcagaauacagugaagguuuccggcaaaggaggccacagcggguccaccuucaaguguugccauggagaggaauguagccagaucggccuccacgcggccgcuccgcaucuggauaaggugaacgggauuucugagaucgaaaauaacaaagucuacgacgauggagccccucaaugcggcgugaaguguugguuugugaaaagcggcgaguggaucuccgggauuuucucuggaaauuggaucguccuuauuguucugugcguguuucuccuguucagccuggugcuucucuccguccugugucccgugcgcaagcacaaaaagucuuga

SEQ ID NO: 13361 - RNA, 3408 nt, Artificial Sequence
  derived and/or modified CDS sequence (opt5) from HTNV(ROKA14-11)__KU207203.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccgagcaacaggugaacuuuguuugucaacggguggaugucgacauugugguguacugcaacggccagcgcaagguuauccugacgaagacacuugucaucgggcaguguauuuauaccaucaccucccuguucucucuccugcccggaguggcucacagcauugccguggaacugugcgucccuggcuuucauggcugggccacagcugcgcuccuggugaccuucuguuuuggguggguucuuauccccgccauuacauucaucauucugacgauccucaaauuuaucgcuaauauuuuccacaccuccaaccaagagaauagacuuaagagcgugcugcggaaaaucaaggaagaguuugagaaaacaaagggaucuauggucugcgauguguguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaacuucacccccggguguuaccggacacugaaucuguuucgcuauaagucuagaugcuacauuuucaccauguggaucuuucuccugguucuugaguccauucugugggcggcuagcgccucugagacgccucucacacccguguggaacgacaaugcccacggagucggcagcgugccuaugcauaccgaucuggaacuggacuucucccuuacauccucuuccaaguacaccuaucggagaaaacucaccaacccccuggaggaagcucagagcaucgaucugcacaucgagauugaggaacagacaaucgggguggacguccaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggaguuggcacagggugcaccgcgugcggacuguaccucgauagacugaaacccgugggcuccgccuacaagauuaucacgauucgcuauucucggagaguguguguccaguuuggggaagagaaucugugcaagaucaucgacaugaacgauuguuucgugagccgccauguuaaagugugcauuaucggcacagucuccaaguuuucucagggagacacccuucucuucuuuggcccucuggaagggggaggccugauuuucaaacacugguguaccagcacaugccaguuuggggauccgggagacaucaugucccccagagauaagggcuuccucuguccugaguuccccgggagcuuucggaaaaagugcaauuucgcuaccacaccuauuugugaauacgacggcaacauggugucuggauauaaaaagguuauggccacgaucgauuccuuucagagcuucaauaccucuacaaugcauuuuaccgacgaacgcaucgaguggaaggaucccgacggcaugcugcgggaucacauuaacauccuugugacaaaagacauugacuucgauaaccugggggaaaauccuugcaagaucggacuccagaccuccagcauugagggcgcuugggggucuggagucggcuuuacguccaccugucuggugagccugacagagugccccaccuuccuuacauccaucaaagccugcgacaaggcgauuuguuacggggccgaaagcguuacccucacaagaggccagaacaccgugaaagucucuggaaagggcgggcacagcggauccacguuuaagugcugucauggcgaggauugcucucagaucgggcugcacgcugccgcuccgcaucuggacaaagugaauggaaucagcgaaauggagaacuccaagguguaugaugacggcgccccucaauguggcauuaaaugcugguucgucaagucuggggaauggaucagcggaauuuuuagcggcaauuggaucguucucauugugcuguguguguuccuucuguucucucucguccugcugagcauccuuugccccgugcgcaaacacaagaaguccuga

SEQ ID NO: 13362 - RNA, 3408 nt, Artificial Sequence
  derived and/or modified CDS sequence (opt5) from HTNV(US8A15-1)__KU207205.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccgagcaacaggugaacuuuguuugucaacggguggaugucgacauugugguguacugcaacggccagcgcaagguuauccugacgaagacacuugucaucgggcaguguauuuauaccaucaccucccuguucucucuccugcccggaguggcucacagcauugccguggaacugugcgucccuggcuuucauggcugggccacagcugcgcuccuggugaccuucuguuuuggguggguucuuauccccgccauuacauucaucauucugacgauccucaaauuuaucgcuaauauuuuccacaccuccaaccaagagaauagacuuaagagcgugcugcggaaaaucaaggaagaguuugagaaaacaaagggaucuauggucugcgauguguguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaacuucacccccggguguuaccggacacugaaucuguuucgcuauaagucuagaugcuacauuuucaccauguggaucuuucuccugguucuugaguccauucugugggcggcuagcgccucugagacgccucucacacccguguggaacgacaaugcccacggagucggcagcgugccuaugcauaccgaucuggaacuggacuucucccuuacauccucuuccaaguacaccuaucggagaaaacucaccaacccccuggaggaagcucagagcaucgaucugcacaucgagauugaggaacagacaaucgggguggacguccaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggaguuggcacagggugcaccgcgugcggacuguaccucgauagacugaaacccgugggcuccgccuacaagauuaucacgauucgcuauucucggagaguguguguccaguuuggggaagagaaucugugcaagaucaucgacaugaacgauuguuucgugagccgccauguuaaagugugcauuaucggcacagucuccaaguuuucucagggagacacccuucucuucuuuggcccucuggaagggggaggccugauuuucaaacacugguguaccagcacaugccaguuuggggauccgggagacaucaugagcccccgggauaagggcuuccucuguccugaguuccccgggagcuuuagaaaacauugcaauuucgcuaccacaccuauuugugaauacgacggcaacauggugucuggauauaagaaaguuauggccacgaucgauuccuuucagagcuucaauaccucuacaaugcacuuuaccgacgaacgcaucgaguggaaggaucccgacggcaugcugcgggaucacauuaacauccuugugacaaaggacauugacuucgauaaccugggggaaaauccuugcaaaaucggacuccagaccuccagcauugagggcgcuugggggucuggagucggcuuuacgcugaccugucuggugucccuuacagagugccccaccuuccucacaagcaucaaggccugcgacaaagcgauuuguuacggggccgaauccguuacccugacaagaggccagaacaccgugaaggucagcggaaaaggcgggcauucuggaagcacguuuaagugcugucacggcgaggauugcucccagaucgggcugcaugcugccgcuccgcaccucgacaaggugaauggaaucucugaaauggagaacagcaaaguguaugaugacggcgccccucaauguggcauuaagugcugguucgucaaauccggggaauggaucucuggaauuuuuagcggcaauuggaucguucugacagugcuuuguguguuccuccuguucucccugguccugcuuucuauucucugccccgugcgcaagcauaaaaagagcuga

SEQ ID NO: 13363 - RNA, 3408 nt, Artificial Sequence
  derived and/or modified CDS sequence (opt5) from HTNV(Lee)__D00377.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaacaucuuuugagaccgucucuacagaaguggaccugaaggggaccugcguucucaaacacaagaugguggaggaguccuaucgcagcagaaagucuaucacguguuacgaucuguccugcaacagcaccuauuguaaaccuacacuguacaugauuguccccauccaugcuugcaauaugaugaagucuugucucaucgcccugggaccuuaucggguccaggugguguacgaacgcaccuacugcaugacaggcguucuuauugaggggaaauguuucgugccggaccaguccguggucagcaucauuaagcacggaaucuuugauauugccuccgugcauaucguuugcuucuuuguggcugucaaaggcaacaccuauaagauuuucgaacaggugaagaaaucuuuugagagcacguguaaugacacagagaacaagguucaaggcuacuauaucugcaucgucgggggaaauuccgcccccauuuacgugccuacccuggaugacuucagaagcauggaggcuuuuacaggcaucuuccggucuccccacggggaggaucacgaccucgccggagaagagaccgcgaccuauuccauugugggcccugccaacgcuaaagucccccauagcgccucuagcgauacacugucccuuaucgcuuuuucugggauuccgagcgacuccagccugucuauccucacguccagcaccgaagccaagcacguguucucuccuggacuguuucccaaacugaaucauacaaacugcgacaagggcgcgaucccucucauguggaccggcaugauugaucugcccggguacuaugaggccauccaccccuguacaguuuucugcgugcuuuccggaccuggcgcuagcugugaggccuucuccgaagggggaauuuuuaauaucaccuacccgaugugccuggucucuaaacagaaccgcuucagacucacggagcaacaggugaauuuuguuugucagcggguggacgucgauauugugguguacugcaacggccagcgcaagguuauccugacaaagacccuugucaucgggcaguguauuuauaccaucacaagccuguucucccuccugcccggaguggcucacucuauugccguggaacugugcgucccuggcuuucauggcugggccaccgcugcgcuccuggugacauucuguuuuggguggguucuuauccccgccauuacguucaucauucugaccauccucaaauuuaucgcuaacauuuuccacacaagcaaucaagagaacagacugaaguccgugcuucggaaaaucaaggaagaguuugagaaaaccaagggaagcauggucugcgacguguguaaguacgaaugcgagacauauaaagaacugaaggcccauggcguuucuugcccucagucccagugucccuacugcuucacccacugugagccgacggaagccgcuuuucaggcccauuauaaagugugccaagucacccaccgcuucagagaugaccucaagaaaacagugaccccucagaauuucacacccggguguuaccggacccugaaccuguuucgcuauaagagcagaugcuacauuuucacgauguggaucuuucuccugguucuugagucuauucugugggcggcuuccgccagcgagacaccucucacccccguguggaaugauaacgcccacggagucggcucugugccuaugcauacagaccuggaacuggauuucagccuuaccuccagcucuaaguacaccuaucggagaaaacucacaaauccccuggaggaagcucaguccaucgaccugcacaucgagauugaggaacagacgaucgggguggauguccaugcccucggccacugguuugacggacgccugaaccuuaagaccagcuuccacuguuacggcgcuugcacaaaauaugaguacccguggcauaccgccaagugucacuaugaacgggacuaccaauaugagacauccugggggugcaauccuucugauugucccggaguuggcaccgggugcacggcgugcggacuguaccucgacagacugaaacccgugggcagcgccuacaagauuaucacaauucgcuauucccggagaguguguguccaguuuggggaagagaaccugugcaagaucaucgauaugaaugacuguuucgugucucgccauguuaaagugugcauuaucggcaccgucagcaaguuuucccagggagauacccuucucuucuuuggcccucuggaagggggaggccugauuuucaaacacugguguacaucuaccugccaguuuggggacccgggagauaucaugagcccccgggacaagggcuuccucuguccugaguuccccggguccuuucgcaaaaagugcaacuucgcuacaacgccuauuugugaguacgauggcaauauggugagcggauauaaaaagguuauggccaccaucgacucuuuucaauccuucaacacaagcaccaugcauuuuacagaugaaagaaucgaguggaaggaccccgauggcaugcugcgggaccacauuaauauccuugugaccaaagacauugauuucgacaaccugggggaaaacccuugcaagaucggacuccagacgucuuccauugagggcgcuugggggagcggagucggcuuuacccugacaugucuggugucucuuaccgagugccccacauuccucaccuccaucaaagccugcgauaaggcgauuuguuacggggccgaaagcguuacacugaccagaggccagaauacggugaaagucuccggaaagggcgggcacagcggaucuacauuuaagugcugucauggcgaggacugcagccagaucgggcugcacgcugccgcuccgcaucucgauaaagugaacggaaucuccgaaauggaaaauucuaaggaauaugacgauggcgccccucaauguggcauuaaaugcugguucgucaagagcggggaguggaucuccggaauuuuuagcggcaacuggaucgugcugauuguucuuuguguguuccuccuguucagccuggugcugcuuuccauccucugccccguccgcaaacacaagaagucuuga

SEQ ID NO: 13364 - RNA, 3384 nt, Artificial Sequence
  derived and/or modified CDS sequence (opt5) from HTNV(M)__U38177.1__GP
auggccagccugguguggcccguccucacccugagaaacguuuacgacaugaagaucgagugcccucacacaguguccuucggcgaaaauucugugauuggguaugucgagcuuccgcccgugccucuggcugauacggcccagaugguucccgaaagcuccuguaacauggacaaucaucaaucucucaacaccaucacaaaauacacccaggugagcuggcggggaaaggcggaucagucccagucuagccaaaauuccuuugagacagucagcaccgaaguggaccugaaaggcacaugcguucuuaagcacaaaaugguggaggagucuuaucgcuccagaaagagcgucaccuguuacgaucugucuugcaacuccacguauuguaagccuacccucuacaugauugugcccauccaugcuugcaauaugaugaaaagcugucugauugcccuggggccuuaucgggugcaggucguuuacgaacgcucuuacugcaugacaggagugcucaucgagggcaaguguuucgugccggaccaguccgucgugagcaucauuaaacacgggaucuuugauauugccuccguucauaucgugugcuucuuugucgcugugaagggaaacaccuauaaaauuuucgaacagguuaagaagucuuuugagagcacauguaaugacaccgagaacaaagugcaaggcuacuauaucugcauugucggcggaaauuccgcccccaucuacgugccuacgcuggaugacuucagaagcauggaagccuuuacagggaucuuccggucuccccacggcgaggaucacgaccuugccggggaagagauugcguccuauagcaucgucggagccgcuaacgccaaggugccucauucugcuagcuccgauacccugcgccucauugccuacucuggcauccccagcuauuccagccugucuauucuuacauccagcaccgaagcgaaacacguguuuucuccggggcuguucccuaagcucaaucauaccaacugcgacaaauccgccaucccccugaucuggacaggaaugauugaccugccuggcuacuacgaggcugugcaccccuguacggucuuuugcgugcucagcggccccggggccuccugugaggcuuucucugaaggaggcaucuucaauauuaccagcccuaugugccugguuuccaagcagaacagauuucggcuuacagagcagcagguuaacuucgucugucaacgcguggauauggacaucgugguuuauugcaaugggcagagaaaagucauucugaccaagacacucgugaucggacaguguaucuacaccauuacgucucuguuuagccuucugccgggcguggcccacuccaucgccgucgaacucugcgugcccggguuccauggaugggcuacagcggcccugcugguuaccuuuuguuucggcugggugcucauuccugcuaucaccuuuauuauccugacaguccuuaaguucauugccaacaucuuucacaccagcaaucaagagaaccggcugaaaucugugcuccgcaagaucaaagaagaguucgagaagacaaaaggcuccaugguuugcgauguguguaaguaugaaugcgagacguacaaggaacugaaagcccauggggucagcugcccccagucucaguguccuuauugcuuuacccacugugagcccacagaagcugccuuccaggcgcauuacaaggugugccaaguuacccacagauuucgggacgaucuuaaaaagacagugaccccgcagaauuucacgccuggauguuaucgcacccugaaccucuucagauacaaaucccggugcuacauuuuuacaauguggaucuuccugcugguccucgagagcauucugugggcugccucugccagcgagacaccccuuaccccuguguggaaugacaacgcucacggcgugggguccguccccaugcauaccgaucuggaacucgacuuuagccugacgucuuccagcaaguauacauacagacgcaagcugaccaauccucuugaggaagcccaguccaucgaucuccacauugagaucgaggaacagacaaucggaguugacgugcaugcucugggccacugguucgaugggcggcugaaccucaaaaccucuuuucacuguuauggcgccugcaccaaguacgaguaucccuggcauacagcgaaaugucacuacgaaagagacuaucaauacgagacgagcuggggaugcaauccguccgacuguccuggcguggggaccggaugcacagccugcggccuguaccuugaucagcugaagcccgucgggucugcuuauaaaauuaucaccauucgcuacagccggagaguguguguucaguucggagaagagaaccucugcaagaucauugacaugaaugauuguuuugugucccgccaugucaaggugugcaucaucggcacaguuucuaaauucagccagggggacacccugcuguuuuucggcccccuugagggaggcgggcucauuuuuaagcacugguguacguccacaugccaauucggagauccuggcgacaucaugagcccgcgggauaaaggguuucugugucccgaguucccuggaucuuucagaaagaaaugcaacuuugccaccacccccauuugugaguaugacggcaauaugguguccggguacaagaaagucauggcuacaaucgauagcuuccagucuuuuaacaccuccacaaugcauuucacggacgaacgcauugaguggaaggauccugacggcaugcugcgggaucacaucaacauccucgugaccaaggacauugacuuugauaaucugggagaaaaccccugcaaaaucggccuucagacaagcucuauugagggggccuggggauccggcguuggguucacccugacaugucucgugagccugaccgagugcccuacguuucugaccuccaucaaggcgugcgacaaagccauuuguuauggagcugaaagcgucacacuuaccagaggccagaauacagugaaggugucugggaaaggcggacacagcggcuccaccuucaagugcugucauggggaggauugcucucaaaucggacuccacgccgcugcuccccaucuggacaaggucaacggcauuagcgaaaucgaaaauuccaaaguuuacgaugacggggccccgcaguguggaaucaagugcugguuugugaaaucuggcgaauggauuagcggcaucuucuccgggaacuggauugugcugaucguccucuguguguuucugcuuuucucucugguucuccugagcauucugugcccugugcgcaagcacaaaaaguccuga

SEQ ID NO: 13365 - RNA, 3408 nt, Artificial Sequence
  derived and/or modified CDS sequence (opt5) from HTNV(N8)__EF077656.1__GP
augggcaucuggaaguggcuggugauggccagccucgucuggcccgcuuacacccugagaaacguuuaugacaugaaaauugagugcccucacacaguguccuucggggaaaauucugugaucggauacgucgagcuuccgcccaugccucuggccgauacggcgcagauggugcccgaaagcuccuguaacauggacaaucaucaaucuaugaacaccauuacaaaguauacccagguuagcuggcggggcaaagcugaucaggcccaggccucccaaaauucuuuugaggcugugagcgccgaagucgaccucaaggggacaugcgugcugaaacacaagaugcuugaggaguccuaccgcagcagaaagucuaucaccuguuaugaucuguccugcaacaauacauacuguaaaccuacccucuauaugauuguucccauccaugcuugcaacaugaugaaaagcugucugaucgcccugggaccuuaccgggugcaggucauuuacgaacgcacguauugcaugaccggcgugcucaucgaggggaaguguuucgugccggaccagucugucguuuccauuaucaagcacggaauuuuugauaucgcgagcgugcauauugugugcuucuuugucgccgugaaaggcaauacauacaagcuguucgaacagguuaagaaaucuuuucaauccaccuguaacgacacagagaauaaggugcagggcuauuacaucugcaucgucgggggaaacagcgcucccauuuaugugccuacccuugaugacuucagauccauggaggccuuuucuggcaucuuccggagcccccacggggaagaucacgaccuggcuggagaggaaauugccuccuacagcaucguuggcccugcgaaugccaaagugccccauucugcuuccagcgauacgcucucucugauugccuauagcgggaucccguccuacucuagccuuuccauccugacaggaagcaccgaggcuaagcacgucuuuucuccuggcuucuuuccccagcucaaccauacaaaaugcgacaagaccgccauuccucugaccuggacaggcaugaucgaccugcccggguacuaugaagccauucaccccuguacgguguucugcguccucuccggaccuggcgcuagcugugaggcguucucugaagggggaaucuuuaauauuaccuccccgaugugccuggugagcaaacagaaccgcuucagacuuacagagcaacagguuaacuuugugugucagcgggucgauauggacaucaucguguacugcaauggccaacgcaagguuauucugaccaagacacucgugaucgggcaguguauuuauaccaucacgucccuguucucucuucugcccggagucgcccacagcauugcuguggagcucugcgugccuggcuuucauggcugggccacagccgcucugcugguuaccuucuguuuuggguggguccucauccccgccauuaccuucaucauccugacagugcuuaaauuuauugcgaacaucuuccacaccuccaaucaggaaaacagacugcgggcugugcuccgcaagauuaaagaggaauuugagaagacaaaaggaucuauggucugcgauguguguaaguacgagugcgaaacguauaaggagcugaaagcccauggcguuagcugcccucagucccaaugucccuacugcuucacccacugugaaccgacagaggccgcuuuucaggcccauuauagagugugccaggucacccaccgguuccgcgacgaucuuaagaaaacagugaccccucagaauuucacgcccggguguuacagaacccugaaccucuuucgguacaagagcagaugcuauaucuucacaauguggguuugucugcuggugcucgaaucuauucugugggcugccuccgcgagcgaggucccucuuaaucccguguggaacgacaaugcccacggaguuggcucugugccuaugcauaccgaucuggagcucgacuuuucccugacaagcucuagcaaauacaccuaucgccggagacugacgaacccccuugaagagacacaagcuaucaaucuccacaucgaaauugaggagcagaccaucggggucgaugugcaugcccugggccacugguucgacggacgccugaaccucaagacauccuuucacugcuacggcgcuuguaccaaguaugaauacccguggcauaccgccaaaugccacuaugagcgggauuaccaguacgaaacaagcuggggguguaauccugcggacugccccggagugggcacggggugcaccgccuguggacuguauauugaccagcuuaagcccgucggcucugcuuacaaaaucauuacaaucagauauucccgcaagguuugcgugcaauucggggaggaaaaccuguguaaagugaucgauaugaaugacugcuuugucagccggcaugugaagguuuguauuaucggcaccguguccaaguucucucagggagauacacuccuguuuuucggcccucuggaagggggaggccuuauuuuuaaacacuggugcaccagcacgugucaguucggggacccgggagauaucaugucccccagagacaagggcuuucucugcccugaguuccccgggucuuuccgcaaaaaguguaacuuugccacaaccccucugugcgaguacgauggcaacauggucagcggauauaaaaaggugauggcuaccauugacuccuuccagucuuuuaauacaagcaccaugcauuucacagaugagcggaucgaauggaaagaccccgauggcaugcugagagaccacaucaacauucucguuacgaaggauaucgacuuugacaaucugggggagaacccuuguaagauuggacuucaaaccuccagcaucgaaggcgccugggggucuggagugggcuucacacugaccugccucgucucccugacagagugccccaccuuucugacgagcauuaaagccugugauaaggcuaucugcuacggggcggagucuguggcccuuacccgcggccagaauacaguuaaaguguccggaaagggcgggcacagcggaucuaccuucaaauguugccauggcgaagaguguucccagauugggcuccacgcugccgccccgcaucuggacaaggucaacggaaucagcgaaguggagaauaacaagguguaugaugacggcgcuccucaaugcggcgucaaauguugguuuguuaaguccggggaauggaucagcggaauuuucucuggcaauuggaucgugcugauugugcucugcgucuuucugcuuuucagccuggugcuccuguccguucugugucccgugcggaaacacaagaaaucuuga

SEQ ID NO: 13366 - RNA, 3408 nt, Artificial Sequence
  derived and/or modified CDS sequence (opt5) from HTNV(Q32)__DQ371905.1__GP
augggcaucuggaaguggcuggugauggccagccucgucuggcccgcuuucgcccugagaaacguuuacgacaugaaaauugagugcccucacaccguguccuuuggggaaaauucugugaucggauaugucgagcuuccgcccaugccucuggcggauacaacgcagauggugcccgaaagcuccuguucuauggacaaccaucaaagccucaauaccauuacaaaguacacccagaucauuuggcggggcaaagcugaucagucccagucuagccaaaacuccuucgagacaguuagcaccgaaguggaccugaaggggacaugcguccuuaaacacaagaugaucgaggagucuuaucgcuccagaaagagcaucaccuguuacgaucugucuugcaauuccacguauuguaaaccuacccucuacaugauugugcccauccaugccugcaacaugaugaaguccugucugauugcccugggaccuuaucggguucagguggucuacgaacgcacauacugcaugaccggcgugcucaucgaggggaaauguuuugugccggaccagucugucguuuccauuaucaagcacggaauuuucgauaucgcuagcgugcauaucgugugcuuuuucgucgccgugaaaggcaauacauauaagauuuuugaacagguuaagaaauccuucgagucuaacuguaaugacaccgagaacaaggugcaaggcuacuauaucugcauuaucgggggaaauagcucccccgucuacgugccuacgcuggaugacuuuagaagcauggaggcuuucucuggcauuuuucggagcccccacggggaggaucacgaccuugccggagaagagguugcgagcuauucuaucgugggcccugccaacgcuaaagucccccauagcgccuccucugauacacuggggcucaucgcuuacuucggcauuccgagcuauuccagccugucuauccuuaccuccagcacagaagccaagcacguguuuucuccuggacuguucccccagcucaaucauaccaaaugcgacaagaccgcgauuccucugacauggacgggcaugaucgaccugcccggguacuacgaggccauucaccccuguaccgucuucugcgugcucuccggaccuggcgcuagcugugaggccuuuuccgaagggggaaucuucaacaucacaucuccgaugugccugguuagcaaacagaaucgcuuuagacuuaccgagcagcaagugaacuucgucugucagcggguggauguugacauuaucguguauugcaacggccagcgcaaggucauucugacaaagacccucgugaucgggcaauguauuuacacgaucacaucccuguuuucucuucugcccggaguggcucacagcauugccguugaacucugcgucccuggcuuccauggcugggccaccgcugcgcugcuggugaccuuuuguuucgggugggugcucauccccgccaucacauuuauuauccugaccauucuuaaauucaucgcuaauauuuuucacacauccaaccaggagaauagacucaagagcguccugcggaaaaucaaggaagaguucgagcgcacgaaaggaucuauggugugcgauaucuguaaguaugaaugcgagaccuacaaggaacugaaagcccauggcguuuccugcccucagagccagugucccuauugcuuuacacacugugagccgaccgaagccgcuuuccaagcccauuacaaggugugccaggucacacacagauuccgggacgaucuuaaaaagaccgugacgccucagaacuuuacccccggguguuaucgcacacugaaucucuucagauacaaaucucggugcuacauuuuuaccauguggguuuuccugcuggugcucgaguccauccugugggcggcuagcgccucugagauuccucuuaaccccgucuggaaugacaacgcccacggagugggcagcaucccuaugcauacagaucuggaacucgacuuuucccugaccuccucuuccaaguauacguacagacgcaagcugacaaauccccuugaggaaagccaggcuauugaucuccacguugagaucgaggaacaaaccaucgggguggacguccaugcccugggccacugguucgauggacggcugaaccucaaaacauccuuucacuguuauggcgcuugcaccaaguacgaguauccguggcauaccgccaaaugucacuacgaaagagacuaucaguacgagacaucuugggggugcaauccuagcgacugucccggagugggcacggggugcaccgcgugcggacuguaccuugaucagcugaagcccgugggcuccgccuauaaaauuaucacaauucgcuacucucggagagucuguguucaguucggggaagagaaccucugcaagaucauugacaugaaugauuguuuugugagccgccaugugaaggucugcaucaucggcaccguguccaaauucucucaaggagacacacugcuguuuuucggcccucuugaagggggaggccucauuuuuaagcacugguguaccagcacgugccaguucggggauccgggagacaucaugagcccccgggauaaaggcuuccuguguccugaauuucccgggagcuucagaaagaaaugcaacuuugcuacaaccccuguuugugaguaugacggcaauauggugucuggauacaagaaagucauggccaccauugauuccuuccagagcuuuaacacaucuaccaugcauuucacagacgaacgcaucgaguggaaggaucccgacggcaugcugcgggaucacauuaacauccucgugacgaaggacauugacuuugauaaucugggggaaaacccuugcaaaaucggacuucagaccuccagcaucgagggcgcuugggggucuggaguuggcuucacacugaccugucucauuucccugacagagugcagcaccuuucugacguccaucaaggccugcgacaaagcgauuuguuauggggccgaaagcgugacccuuaucagaggccaaaauacagucaaggugucuggaaaaggcgggcacagcggauccucuuucaagugcugucauggcgaggaaugcagccagauugggcuccacgcugccgcuccccaucuggauaagguuaacggaaucuccgagauggaaaauucuaaaguguuugacgauggcgccccgcaguguggcaucaagugcugguucgucaaaagcggggaguggauuuccggaaucuucucuggcaacuggauugugcugaucgugcucugugucuuucugcuuuucagccugguucuccuguccauucugugcccugugcgcaagcacaaaaagagcuga

SEQ ID NO: 13367 - RNA, 3408 nt, Artificial Sequence
  derived and/or modified CDS sequence (opt5) from HTNV(Bao14)__AB127995.1__GP
augggcauguggaaguggcuggugaucgccagccucgucuggcccgcucuggcccuuagaaacguuuacgacaugaaaauugagugcccucacaccguguccuucggggaaaauucugugaucggauaugucgagcugccgcccaugccucucgcggauacagcucagauggugcccgaaagcuccuguucuauggacaaccaucaaagcauuaauacgaucaccaaguacacacagguuauuuggcggggcaaagccgauccugggcaguccucucagaacagcuuugagaccguguccacagaagucgaccugaagggaaccugcgugcuuaaacacaagaugguugaggagagcuaucgcucuagaaaguccaucacauguuacgaucugagcugcaauucuaccuauuguaaacccacgcucuacaugaucgugccuauucaugccugcaacaugaugaaguccugucugaucgcucugggcccguaucggguccaagugguguacgaacgcaccuacugcaugacagggguccucauugagggaaaauguuucguucccgaccagagcguggugucuaucauuaagcacggcaucuuugauauugccuccguccauaucgugugcuucuuuguugcugugaaaggcaauaccuauaagcuguucgaacaggucaagaaaucuuuugaguccacauguaacgacaccgagaauaaggugcagggguacuauaucugcauuguuggaggcaacucugccccuaucuacgugcccacgcuugaugacuucagaagcauggaagcguuuacagggauuuucaaauccccucacggagaggaucacgaccuggccggcgaagagaucgcuagcuauucuauugucgggcccgccaaugcuaaggugccgcauuccgccagcucugauacccucagccugaucgcguacuccggaaucccuucuuauagcucccuuagcauucugacaucuuccaccgacgccaaacacgucuuuagccccggccucuucccuaagcugaaccauaccaauugcgacaaaucugcuaucccccugacauggacgggcaugauugaucuccccggguacuacgaagccauccacccuuguaccguguuuugcguucuguccggaccgggcgcuagcugugaggccuucuccgaagggggaauuuucaacaucacaucucccaugugccuugugagcaagcaaaaucgguuucgccugaccgaacagcaggucaacuucgugugucagagaguugacauggauaucguggucuauugcaacggccaacggaaggugauucucacaaaaacccuggugaucgggcaguguauuuacacgaucacaucccuuuuuagccugcucccuggaguugcccacagcauugcugucgagcugugcgugcccggcuuccauggcugggcgaccgccgcucugcucgugaccuuuuguuucggguggguccugaucccugccgugacauuuauuauccuuaccguucugaaguucaucgccaauauuuuucacacauccaaccaggaaaaucgccucaaaagcgugcugagaaagaucaaagaggaguucgagaagacgaagggaucuauggucugcgacguguguaaauaugagugcgaaaccuacaaggagcuuaaagcucauggcguuuccugcccccaaagccaguguccguauugcuuuacacacugugaaccuaccgaggccgcguuccaggcucauuacaaggugugccaggucacacaccgguuucgcgaugaccugaaaaagaccgugacgccccaaaacuucaccccuggguguuauagaacacucaaucuguuccgguacaagucucgcugcuacauuuuuaccauguggguuuuccugcucauccuggaauccgugcuuugggccgccagcgcuucugagacaccccugaccccugucuggaacgauaaugcccacggagugggcagcgugcccaugcauacggaccucgagcuggauuuuucccugacaagcagcuccaaauauaccuacagacggaaacuuacaaacccgcucgaagaggcucagagcauugaccugcacaucgaaaucgaggagcagaccauuggggucgauguucaugcccugggccacugguucgacggaagacucaaucugaagaccuccuuucacuguuauggcgcgugcacaaaguacgaauauccuuggcauacggccaaaugucacuacgagcgcgacuaucaguacgaaaccucuugggggugcaaccccagcgauugucccggagugggcacagggugcaccgcuugcggacuuuaccuggaccaacucaagccugugggcuccgccuauaagaucauuacaauccgguacucuagacgcgucugugugcaguucggggaggaaaaucugugcaaaauuaucgauaugaacgacuguuuuguuagccggcaugugaaggucugcaucauuggcaccguguccaaauucucucagggagauacgcugcucuuuuucggcccgcuugaagggggaggccugaucuuuaagcacugguguacaucuaccugccaguucggggaccccggagauauuauguccccuagagacaaaggcuuucugugucccgaguucccugggagcuuccgcaagaaaugcaauuuugcuaccacacccaucugugaguaugauggcaacaugguuucuggauacaagaaggugauggccaccauugacuccuuccagagcuuuaauacaucuacgaugcauuucaccgaugagcggaucgaauggaaagacccugauggcaugcucagagaccacaucaacauucuggucacaaaggacaucgauuuugacaaccuuggggagaaucccugcaaaauuggacugcaaaccuccagcaucgaaggcgcgugggggucuggagugggcuucacacucaccugucugguuucccugacggagugcccgaccuuucuuacaagcauuaaggccugcgauaaagcuaucuguuauggggccgaguccgugacccucacacgcggccagaacaccguccgggugagcggaaagggcgggcacucuggaagcacauucaagugcugucauggcgaagacugcuccaaaauugggcugcacgcugccgccccucaucuggauaaggugaauggaaucucugagaucgaaaacagcaaagucuacgacgauggcgcuccccaguguggcauuaagugcugguuuguuaaauccggggaguggaucucuggaauuuucagcggcaauuggaucgugcucauugugcugugugucuuucuucuguucucccucgugcugcugucuauccuuugcccuguuagaaagcacaagaaaagcuga

SEQ ID NO: 13368 - RNA, 3408 nt, Artificial Sequence
  derived and/or modified CDS sequence (opt5) from HTNV(HubeiHu02)__JQ665881.1__GP
augggcaucuggaaguggcuggugauggccagccucgucuggcccgcuuucgcccugagaaacguuuacgacaugaagauugagugcccucacaccguguccuuuggggaaaauucugugaucggauaugucgagcuuccgcccaugccucuggcggauacagcucagauggugcccgaaagcuccuguucuauggacaaccaucaaagccucaauacgauuaccaaguacacacagaucguuuggcggggcaaagccgaucagucccagucuagccaaaacuccuucgagaccgugagcacagaagucgaccugaaggggaccugcgugcuuaaacacaagaugguugaggagucuuaucgcuccagaaagagcauuacauguuacgaucugucuugcaauuccaccuauuguaaaccuacgcucuacaugaucgugcccauccaugccugcaacaugaugaaguccugucugauugcucugggaccuuaucggguccaggugguguacgaacgcaccuacugcaugacaggcguccucaucgaggggaaauguuuuguuccggaccagucugugguguccauuaucaagcacggaauuuucgauaucgccagcguccauauugugugcuuuuucguugcugugaaaggcuccaccuauaagcuguuugaacaggucaagaaaucuuucgagagcaauuguaacgacacagagaauaaggugcaaggccacuacaucugcaucguugggggaaacuccgcccccauuuaugugccuacccuugaugacuuuagaagcauggaagcguucucuggcaucuuuaaaagcccccacggggaggaucaugaccuggccggagaagaggucgcuagcuacucuauugugggcccugccaaugcuaaggucccccacagcgccuccucugauacgcucagccugaucgcguauuccgggauuccgagcuacucuucccuuagcauccugacaucucucaccgaagccaaacauguguucuccccuggacuguuuccccagcugaaccacacaaagugcgacaaaaccgcuaucccucucaccuggacaggcaugauugaccugcccggcuauuacgaggccguucaccccuguacgguguucugcguccuuagcgggccuggagcuuccugugaggccuucucugaaggcgggauccugaauauuaccagcccgaugugccucguguccaagcagaaccgguuucgccugacagagcagcaaguuaauuucgugugucagagagucgauguggacaucgugguuuacugcaacggacagcggaaggucauucuuaccaaaacacuggugaucggccaauguaucuauaccauuacgucucucuuuagccugcugcccgggguggcccauuccaucgcugucgaacucugcgugccuggauuccacggcugggcgacagccgcucugcuuguuaccuuuuguuucggcugggugcugauucccgccaucaccuuuauuauccucacaauucugaaguucaucgccaacaucuuucauaccagcaaucaggagaaccgccuuaaaucuguccugagaaagauuaaagaagaguucgagcggacaaagggguccauggugugcgauguuuguaaguacgaaugcgagacguauaaagaacucaaggcucacggagugagcugcccucagucucagugucccuacugcuuuacccauugugagccgacagaagccgcguuccaagcucacuauaaagucugccaggugacccaccgcuuuagagacgaucugaagaaaacaguuaccccucagaauuucacgcccggcuguuaccggacccugaaccucuuccgcuauaaguccagaugcuacaucuuuacaauguggguguuccugcuuguccuggagagcauucucugggccgccucugcuagcgagaccccucugaaucccguguggaacgacaaugcccauggggugggauccgucccuaugcacacagaucuggaacuugacuuuagccucaccucuuccagcaaguacacguaucggagaaaacugacaaacccccuggaggaaucccaggcuaucaaucuccauauugagaucgaggaacaaaccaucggcguugaugugcacgcccuggggcacugguucgacggccgccuuaaccugaagacaucuuuucauuguuacggagcgugcaccaaauaugaguacccguggcacaccgccaagugucauuaugaacgggauuaccaguaugagacaagcuggggcugcaauccuuccgacugucccggggugggaacgggcugcaccgcuugcgggcucuaccuggaccagcugaaacccgucggaucugccuacaagauuaucacaauuagauauagccgccggguguguguucaguucggcgaagagaaccuuugcaagaucauugauaugaaugacuguuuuguguccagacacgucaaagugugcaucaucgggaccguuucuaaguucagccaaggcgauacacuccuguuuuucggaccucuggagggcgggggacucauuuuuaaacauugguguaccuccacgugccaguucggcgacccgggggauaucaugagcccccgcgacaagggauuucuguguccugaguuccccggcucuuuccggaaaaagugcaacuuugcuacaaccccuauuugugaauacgaugggaauaugguguccggcuauaaaaaggucauggccaccaucgacagcuuccagucuuuuaacacauccaccaugcacuucacagaugaaagaauugaguggaaggaccccgauggaaugcuucgcgaccacaucagcauccuggugacgaaagauauugacuuugacaaccucggcgaaaauccuugcaagaucgggcugcagaccucuuccauugagggagcguggggcagcgggguuggauacacacugaccugucuuaucucccucacagagugccccaccuuccugacgagcauuaaagccugcgauaaggcuaucuguuauggcgccgaaucugugacccugacacgggggcaaaacaccgucaaagugagcggcaagggaggccauuccgggucuagcuuuaagugcugucacggagaggacugcucccagauuggccuccaugcugccgccccgcaccuggauaaagugaaugggaucucugaaaucgagaacagcaaggucuucgacgauggagcuccucaguguggcauuaaaugcugguuuguuaaguccggcgaauggaucucugggauuuucaauggaaacuggaucgugcuuauugugcugugugucuuucuccuguucagccuggugcuucucuccauccugugccccguuagaaaacauaaaaagagcuga

SEQ ID NO: 13369 - RNA, 3408 nt, Artificial Sequence
  derived and/or modified CDS sequence (opt5) from HTNV(HV004)__JQ083394.1__GP
augggcaucuggaaguggcuggugauggccagccucgucuggcccgcuuucgcccugagaaacguuuacgacaugaaaauugagugcccucacaccguguccuuuggggaaaauucugugaucggauaugucgagcuuccgcccaugccucuggcggauacagcucagauggugcccgaaagcuccuguucuauggacaaccaucaaagccucaauacgauuaccaaguacacacagaucauuuggcggggcaaagccgaucagucccagucuagccaaaacuccuucgagaccguuagcacagaaguggaccugaaggggaccugcguccuuaaacacaagaugguggaggagucuuaucgcuccagaaagagcaucacauguuacgaucugucuugcaauuccaccuauuguaaaccuacgcucuacaugaucguucccauucaugccugcaacaugaugaaaagcugucugaucgcucugggaccuuaucgggugcaggucguguacgaacgcaccuacugcaugacaggcgugcucauugaggggaaguguuuugucccggaccagucuguuguguccaucauuaagcacggaaucuucgauauugccagcgugcauaucgucugcuuuuucguggcuguuaaaggcuccaccuauaagcuguuugaacaggugaagaaaucuuucgagagcaauuguaacgacacagagaauaagguccaaggcuacuauaucugcauuguugggggaaacuccgcccccaucuacgugccuacccuugaugacuuuagaagcauggaagcguucucuggcauuuuuaaaagcccccacggggaggaucacgaccuggccggagaagagguggcuagcuauucuaucgucggcccugccaaugcuaaggugccccauagcgccuccucugauacgcucagccugauugcguacuccgggaucccgagcuauucuucccuuagcauccugacaucuuccaccgaagccaaacacgucuucagcccuggacucuuuccccagcugaaccauacaaagugcgacaaaaccgcuauuccucugaccuggacaggcaugaucgaccuccccggcuacuacgaggccauucaccccuguacgguguucugcguucuguccgggccuggagcuucuugugaggccuucagcgaaggcgggaucuuuaauauuaccuccccgaugugccuugugucuaagcagaaccgguuccgccugacagagcagcaagucaauuuugugugucagagaguugauguggacaucgucguguauugcaacggacagcggaaggugauccucaccaaaacacugguuauuggccaauguaucuacaccauuacgagccuuuucucccugcuccccggggucgcccacagcaucgcuguggaacugugcgugccuggauuucauggcugggcgacagccgcucugcucgucaccuucuguuuuggcugggugcugauucccgccaucaccuucauuauccuuacaauccugaaguuuauugccaacaucuuccacaccucuaaucaggagaacaaacucaaguccguucugcgcaaaauuaaggaagaguuugagagaacaaaggggagcauggugugcgaugucuguaaauaugaaugcgagacguacaaggaacuuaaagcucauggagugucuugcccucagucccagugucccuauugcuucacccacugugagccgacagaagccgcguuucaagcucauuacaagguuugccaggugacccaccgguuccgcgacgaucugaaaaagacagucaccccucagaauuucacgcccggcuguuauagaacccucaaccuguuucgguacaagagccgcugcuacaucuucacaauguggguguuucugcucguucuggagucuauucuuugggccgccagcgcuuccgagaccccucugaaucccguguggaacgacaaugcccacggggucggaagcgugccuaugcauacagaucucgaacuggacuucucucugaccuccagcuccaaauauacguacagacggaaacuuacaaacccccucgaggaaucucaggcuaucaaucugcacaucgagauugaggaacaaaccaucggcguggauguccaugcccuggggcacugguuugacggcagacucaaccugaagacauccuuccacuguuauggagcgugcaccaaguacgaguauccguggcauaccgccaaaugucacuacgaacgcgauuaucaguacgagacauccuggggcugcaauccuucugacugucccgggguuggaacgggcugcaccgcuugcgggcuuuaccuggaccagcucaagcccgugggaagcgccuauaagauuaucacaauucgguacuccagacgcguguguguccaguuuggcgaagagaaccugugcaaaaucaucgauaugaaugacuguuucgugucucggcauguuaaggugugcauuaucgggaccgucagcaaauuuucccaaggcgauacacugcuuuucuuuggaccucucgagggcgggggacugauuuucaagcacugguguaccagcacgugccaguuuggcgacccgggggauaucaugucucccagagacaaaggauuccuguguccugaguuccccggcuccuuucgcaagaaaugcaacuucgcuacaaccccuauuugugaauaugaugggaauauggugagcggcuacaagaagguuauggccaccaucgacucuuuucaguccuucaacacaagcaccaugcauuuuacagaugaacggaucgaguggaaagaccccgauggaaugcucagagaccacauuaacauccuggugacgaaggauauugacuucgacaaucuuggcgaaaacccuugcaaaaucgggcugcagaccucuuccauugagggagcguggggcagcggggucggauuuacacucaccugucugaucucccugacagagugccccaccuuccuuacgagcauuaaggccugcgauaaagcuaucuguuauggcgccgaaucugugacccucacacgcgggcaaaauaccguuaaggugagcggcaagggaggccacuccgggucuagcuuuaaaugcugucauggagaggacugcucccagaucggccugcacgcugccgccccgcaucuggauaaggucaacgggauuucugaaaucgagaauagcaaaguguucgacgauggagcuccucaguguggcauuaagugcugguuugugaaauccggcgaauggaucucugggauuuucaacggaaauuggaucguccucaucguucuguguguguuccuucuguuuagccucgugcugcuguccauucuuugccccguccggaagcacaagaaaagcuga

SEQ ID NO: 13370 - RNA, 3405 nt, Artificial Sequence
  derived and/or modified CDS sequence (opt5) from HTNV(NC167)__AB027115.2__GP
auguggggccugcucguggucgccgggcugaucggacccugcauuagccuuagaaacguuuacgacaugaagaucgaguguccucacaccgugaauuucggcgaaaacuccgugauuggguaugucgagcugccgcccgugccuaucgcugauauuacacagaugguucccgaaucuagcugcaauauggacaaccaucaaucccucucuacguuuaccaaauacacacagcugaucuggcggaagaaagccgagcaggcgcaggcuagccaaaauuccuucgaaaccgugucucgcgaggucgauuuuaagggaacauguguguucaaacacaagaugguugaggaaagcuauaagaacagaaaauccaucauuugcuacgaccuuagcuguaauaucacccauugcaagccuacacuguauaugauuauccccgugcacgccuguaacaugaugaaaucuugccucauugcccugggcccuuuucggguccaggugguguacgagcgcaccuauuguauguccgggauccugacggaaggaagaugcuucgucccguaccagagcguugugucuauuaucaagcauggcaucuuugauauugcuuccauccacauuaucuguuucuuuauugccguggagggcaauaccuacaaacucuucgaggaagucaaaaagagcuuugcucugaacugcaaugacacagagaacaagauccagggguauuacaucugcauuaucggaggcaauucugcccccguguaugcgccuucccccgaugacuuccggagcauggaagccuuuuccgggauuuuccgcucuccucacggagagaaccaugaucuuaauggcgggagaaacgcucccuacagcaucguuggaccgaccgacggcaaggugccucacuccagcaaacauuauaacauugaguucgauucuaucuuucaaaaguuccccacauacuccagcuuuucuauccuggccggcagcgucgaaccuaaacacguguuccagcccgggcucuuucccaagcugaaucacaccaaauguacgaaguccgcuauuccucuuguuuggacaggacggaucgacauuccgggcuauuacgaggccgugcauccccugaccgucuacugcgaacucucugggccuggagcgagcugugaggccuucuccgaaggcgggaucuuuaacauuacaagccccaugugccuggugucuaagcagaaucgcuucagaucccugcggcagcaagucagcuuugugugucagcgcguugauauggacaucguggucuauugcaacggacagaaaaagaccauucucaccaaaacacuggugaucggccaauguaucuacacgauuaccucucuuuucucccugcucccuagcguugcucacuccaucgccguggagcugugcguccccggcuuucaugggugggcuacagccgcccuucugauuaccuucuguuuuggaugggugcucaucccggcucugacauucauuauccugaccauccucaaguucauugcgaauaucuuucacacgucuaaccaggaaaauaaacugaaggccgugcuuagaaagauuaaagaggaguucgaaaagacaaaaggcagcaugguuugcgacaucuguaaguaugagugcgauaccuacaaagaacugaaggcucaugggcucuccugcccucagucucagugucccuauugcuuuacccacugugagccuacagaaagcgccuuccaagcccacuacaaggucugccaggugacccaucgguuucgcgaggagcugaaaaagacagugacgccccagaacuucaccccuggauguuauagaacacuuaaucuguuucgguacaaauccagaugcuacauuuucaccauguggauccuccugcuggucuuugaaagcauccucugggcugccucugcguccgacgugccccugagcacagauuggaacgacaaugcucacggcguugggucugugccgaugcauaccgaucuugagcuggacuucucccucacgagcucuagcaaguauaccuaccgccggaaacugacaaacccugucgauaccucccaggccguggaccugcacauugaacuugaggagcaaacaaucggccucgauguucacgcccugggacauugguuugacggcagacugaaucucaagaccagcuuccacuguuauggggcuugcacgaaguacgaauaucccuggcauacagccaaaugucacuuugagcgcgauuuccaguacgaaaccucuuggggaugcaaucccccugacuguccgggcguggggacaggaugcaccgcuugcggccuguauauugaccagcuucggcccgucgggaacgccuacaagaucauuaccaucagauacucccgcaaaguguguguucaguucggcgaugagaaccugugcaagacaaucgacaugaacgauuguuuugugagcaaacaugucaaggugugcauuaucggaacgguguccaaauucucucaaggcgacacccuccuguuucuggggccuauggaaggaggcgggauuaucuucaagcacugguguacaucuaccugccaguuuggagaucccggcgacauuauguccccuaaggauaaaggguucucuugucccgaguuuagcggcuccuuccggaagaaaugcaauuuugcgacaaccccugccugugaguauggaggcaacauggucucuggguacagaaagguuauggcuacgaucgacagcuuccaggccuuuaauacauccaccauucacuucaccgaugaacgcaucgaguggaaagaccccgauggaaugcuucgggaccauaucaacauucucgugacaagagauaucgacuucgacaaucuggcugaaaacccgugcaagauuggccuccaggugagcgccaucgagggggcguggggaucuggcgucggguuuacccugacaugucaagugucccugacggaaugcagcaccuuccuuacaucuauuaaggccugcgauaaagcuaucuguuauggcgcccaguccguuacccuggugcgcggacagaauacagucaagaucagcggcaaagggggacacucuggcuccgcuuuuaagugcugucauggggaggacugcagccaaaccggacuccaggccgaugccccucaccuggacaaagugaacggcauuuccgagguugaaaaugauaagguguacgacgauggcgcucccgagugugggaucaagugcugguucgucaaaagcggagaauggguggcgggcauuuuuagcgggaacuggaucguucuggugguccuuuguauuuuccucaucaucagccugauucugcucuccauccugugcccugugcggaagcauaaaaagucuuga

SEQ ID NO: 13371 - RNA, 3408 nt, Artificial Sequence
  derived and/or modified CDS sequence (opt5) from HTNV(WuhanAaJ10)__JQ665882.1__GP
augggcaucuggaaguggcuggugauggccagccucgucuggcccgcuuucgcccugagaaacguuuacgacaugaaaauugagugcccucacaccguguccuuuggggaaaauucugugaucggauaugucgagcuuccgcccaugccucuggcggauacagcucagauggugcccgaaagcuccuguucuauggacaaccaucaaagccucaauacgauuaccaaguacacacagaucauuuggcggggcaaagccgaucagucccagucuagccaaaacuccuucgagaccguuagcacagaaguggaccugaaggggaccugcguccuuaaacacaagaugguggaggagucuuaucgcuccagaaagagcaucacauguuacgaucugucuugcaauuccaccuauuguaaaccugcccucuacaugaucguucccauucaugcuugcaacaugaugaaguccugucugaucgcccugggaccuuaucgggugcaggucguguacgaacgcacguacugcaugaccggcgugcucauugaggggaaauguuuugucccggaccagucuguuguguccaucauuaagcacggaaucuucgauauugcuagcgugcauacagucugcuuuuucguggccguuaaaggcuccaccuauaagcuguuugaacaggcgaagaaaucuuuccaaagcaauuguaacgacacagagaauaaggugcagggcuacuauaucugcaucgucgggggauccagcgcccccauuuacgugccuacccuugaugacuuuagaucuauggaggcuuucuccggccuguuuaaaagcccccacggggaagaucacgaccucgccggagaggaaguugcuucuuauagcaucgugggcccugccaacgcgaaggucccccauuccgccucuagcgauacgcugucccuuauugcuuacagcgggaucccgucuuauuccagccugucuauucucacauccagcaccgaggccaaacacguguucuccccuggacuguuuccccagcugaaucauacaaagugcgacaaaaccgcuaucccucucaccuggacaggcaugaucgaccugcccggcuacuacgaagccguccaccccuguacgguguucugcguucuuucugggccuggagccagcugugaggcuuucuccgagggcgggauuuuuaacaucaccucuccgaugugccuggugagcaagcagaaucgguuccgccucacagaacaacaggucaacuuugugugucagagaguugauguggacauuaucgucuauugcaauggacaacggaaggugauucugaccaaaacacuugugaucggccaguguaucuacaccauuacgucccugaucagccuccugcccgggguugcgcacucuauugccgucgagcugugcgugccuggaucccauggcugggcuacagccgcccuccuggugaccuucuguuuuggcuggguccuuauccccgcuauuaccuucaucauucugacaauccucaaguuuaucgccaacauuuuccacaccagcaaccaggaaaaucgccugaaaucugugcuuagaaagaucaaagaggaauuugagcggacaaagggguccaugguuugcgauguguguaaguaugagugcgaaacguacaaagagcugaaggcgcauggagucagcugcccucagucucaaugucccuauugcuucacccacugugaaccgacagaggcugccuuucaggcccauuacaaagugugccagguuacccaccgcuucagagacgaucucaagaaaacagugaccccucagaacuuuacgcccggcuguuaucggacccugaaucuguuccgcuacaagagcagaugcuacauuuucacaaugugggucuuucuccuggugcuugaauccauccugugggcugccagcgcuucugagaccccucucaaccccguuuggaaugacaacgcccacggggugggauccgucccuaugcauacagaucuggagcuggacuucagccuuaccuccucuagcaaguauacguaccggagaaaacucacaaauccccuggaagagucccaagcgauugaucugcacaucgaaaucgaggaccagaccauuggcguggaugugcaugcccucgggcacugguuugacggccgccugaaccuugagacaucuuuccacuguuauggagcuugcaccaaguacgaauauccguggcauaccgccaaaugucacuacgagcgggacuaucaguacgaaacaagcuggggcugcuccccuucugauugucccggggucggaacgggcugcaccgcuugcgggcuguaccucgaccagcugaagcccguuggaagcgccuauaaaaucauuacaaucagauacucccgccgggugugugugcaaagcggcgaggaaaaucugugcaagauuaucgauaugaacgacuguuuugucucuagacaugugaagguuugcaucauugggaccguguccaaauucagccagggcgauacacuucucuuuuucggaccucuggagggcgggggacugaucuuuaagcacugguguaccucuacgugccaguucggcgacccgggggauauuaugagcccccgcgacaaaggauuucucuguccugaguuccccggcagcuuucggaagaaaugcaauuucgcgacaaccccuaucugugaauaugaugggaacauggucucuggcuacaagaaagugauggccaccauugacuccuuccagagcuuuaauacauccaccaugcauuucacagaugagagaaucgaauggaaggaccgcgauggaaugcugcgggaccacaucaacauucuuguuacgaaggacaucgauuuugacaaucugggcgagaaccccugcaaaauugggcuccaaaccagcucuaucgaaggagcuuggggcagcggggugggauucacacugaccugucugauuucccuuacagagugcccuaccuuucucacgucuaucaaggccugcgauaaagcuauuuguuauggcgccgagagcgucacccugacaagagggcagaacaccgugaagguuuccggcaaaggaggccacucugggagcuccuucaagugcugucauggagaagacugcucucagaucggccugcacgccgcugcgccccaucucgauaaggugaaugggaucagcgagauugaaaacuccaaagucuuugacgauggagccccgcaauguggcaucaagugcuggagcgugaaaucuggcgaguggauuuccgggaucuucagcggaaauuggauugugcugaucguccuuuguguuuuucuccuguucucucuggugcugcuuuccauccucugcccugugcgcaagcacaaaaagagcuga

SEQ ID NO: 13372 - RNA, 3408 nt, Artificial Sequence
  derived and/or modified CDS sequence (opt5) from HTNV(Z5)__EU074224.1__GP
augggcaucuggaaguggcuggugauggccagccucgucuggcccgcuugcacccugagaaacguuuacgacaugaaaauugaguguccucacacaguguccuucggggaaaauucugugaucggauaugucgagcuuccgcccaugccucuggccgauacggcgcagcucgugcccgaaagcuccugcaacauggacaaucaucaaucuaugaacaccauuacaaaguacacccagguuagcuggcgguccaaaguggaucaggcucaggccucucaaaauagcuuugaggccgucuccgcugaaguggaccugaagggcacauguguucuuaaacacaagaugcuggaggagagcuaucgcucuagaaaguccauuaccugcuacgaucucagcuguaacucuacauauugcaaaccuacccuguacaugaucgugcccauccaugccuguaauaugaugaaggggugccugaucgcucucggaccuuaucggguccaggugguguacgaacgcacguacuguaugaccggcguccugauugaggggaaaugcuucguuccggaccaguccguggugagcaucauuaagcacggaaucuuugauauugccucuguccauaucguguguuucuuuguugcggugaaaggcaacacauauaaacuuuucgaacaggucaagaaguccuuucaaagcacaugcaaugacaccgagaacaaggugcagggcuacuauauuugcaucguugggggaaauuccgcccccaucugugugccuacccuggaugacuucagaucuauggaggcuuuuagcggcauuuuccggagcccccacggggaagaucacgaccucgccggagaggaaaucgcuuccuacucuauugucggcccugccaacgcgaaagugccccauuccgccagcucugauacgcugagccuuaucgcuuauuccgggauuccgucuuacagcucccugagcauccucgccggaucuacagaggcuaagcacgucuuuuccccuggcuucuuuccccagcugaaucauaccaaaugcgacaagacagccaucccucugaccuggaccggcaugauugaccuccccggguauuacgaagccauccaccccuguacaguguucugcguucugagcggaccuggcgcuucuugugaggcguucuccgaagggggaauuuuuaacaucacgagcccgaugugccuuguguccaaacagaaucgcuucagacugaccgaacaacaggucaacuuugugugucagcggguugauauggacauuaucguguacugcaacggccaacgcaaggucauccucacaaagacccuggugauugggcaguguaucuauacaauuaccucucuuuucagccugcuccccggaguggcccacuccaucgcuguugagcugugcgucccuggcuuucauggcugggccacggccgcucugcucgugacauucuguuuugggugggugcugauucccgccaucaccuucgucauucuuaccauccugaaauuuaucgcgaauauuuuccacacaucuaaccagggaaauagacucaagagcgugcugaaaaagaucaaagaagaguuugaaaagaccaagggcuccaugguuugcgaugugugcaaauacgagugugagacauauaaggaacuuaaagcucauggggucagcugcccucagucucaaugucccuacugcuucacgcacugugagccgaccgaagccgccuuucaggcucauuaucgggugugccagguuacacaccgcuucagagacgaucugaagaaaaccgugacaccucagaacuucacccccggauguuaccggacgcucaaucuguuucgcuauaaguccagaugcuacauuuucaccaugugggucugucugcucgugcuggagagcauccuuugggccgcuucugccuccgaaguuccucugaaccccauuuggaaugacaacgcgcacggcguggggagcgucccuaugcauacagaucucgagcuggacuuuucucugaccagcuccagcaaguacacauaucggagacgccuuaccaauccccucgaggaaacgcaagccaucaaccugcacaucgagauugaggagcagacaaucggcguggaugugcaugcucugggacacugguucgacggccggcucaaucugaaaaccucuuuucacugcuacggggccuguacaaaguaugaguacccguggcauaccgcuaaaugccacuaugaaagagauuaccaguaugagaccuccuggggaugcaacccugccgacugucccggcgucgggacaggaugcacggcguguggccuuuaccuggaccagcucaagcccguugggagcgccuacaaaauuaucaccauucgcuauucccggaaggugugcgugcaauucggcgaagagaaucuguguaaggucaucgauaugaacgacugcuuugugucuagacauguuaaaguguguaucauuggaacagucagcaaguucucccagggcgauacccugcuguuuuucgggccucucgaaggaggcgggcugaucuuuaaacacuggugcacaucuaccugucaguucggagacccgggcgauauuaugagcccccgcgacaagggguuucugugcccugaguuccccggcuccuuccggaaaaaguguaauuuugcuacgacaccucucugcgaguacgauggaaacauggugucuggcuauaaaaagguuauggccaccaucgacagcuuccaguccuuuaacaccagcacaaugcauuucaccgaugaaagaauugaguggaaggaccccgaugggaugcugcgcgaccacaucaauauccuugugacaaaagauauugacuuugacaaccugggagaaaauccuugcaaggucggccuccaaacgucuuccaucgagggggcuuggggaagcggcgugggguucacccugacaugucugguuucucuuaccgaaugccccacauuucucaccuccauuaaagccugugauaaggccaucugcuacggcgcugagagcgugacgcugacccggggacagaacacagucaaagugucuggcaaagggggacacuccggcagcaccuucaaguguugccauggggaggaauguucccagauuggacugcacgcggccgcuccgcaucucgacaaggugaauggcaucagcgagauugaaaacaauaaggucuaugaugacggcgccccucaaugcgggguuaaauguugguuugugaagucuggagaguggaucagcggcaucuucuccgggaacuggauugugcugaucguccuuugcguguuucuucucuucucucuggcccugcuuagcguucucugucccgugagacgccacaaaaaguccuga

SEQ ID NO: 13373 - RNA, 3408 nt, Artificial Sequence
  derived and/or modified CDS sequence (opt5) from HTNV(ZLS-12)__FJ753399.1__GP
augggcaucuggaaguggcugauuauggccagccucguguggcccgcuuacacccugagaaacgucuaugacaugcggaucgagugcccucacacaguuuccuucggggaaaauucugugauuggauacguggagcuuccgcccaugccucuggccgauacgagccagaugguccccgaauccucuuguagcauggacaaccaucaaucccucaauaccaucacaaaauauacccaggugucuuggcgcggcaaggcggaucagagccaggcuucccaaaacagcuuugaggccguuucugccgaaguggaccugaaagggacaugcguccuuaagcacaaaaugcuggaggaguccuacagaagccggaagucuauuaccuguuaugaucucuccugcaauagcacauacuguaagccuacccuguauaugaucgugcccauccaugcuugcaacaugaugaaaucuugucugauugcccucggaccuuaccgcguucagguggucuacgaaagaacguauugcaugaccggcauccugauugaggggaaguguuucgugccggaccaguccguggucagcaucauuaaacacggaaucuuugauauugcuuccguucauaucgugugcuucuuuguggccgucaagggcaauacauacaaacuuuucgaacaggugaagaagucuuuucaaagcaccuguaacgacacagaggauaaaguucagggcuauuacaucugcauugccgggggaaauuccgcgcccaucuaugugccuacccuggacgauuuccggagcauggaggcuuuuucuggcauuuucaagagcccccacggggaagaccacgaucucgccggagaggaaaucgcuagcuacucuauugucggcccugccaacgcgaaagugccccauagcgccuccucugacacgcugagccuuacagcuuauuccgggaucccgagcuacucuucccugagcauccucaccucuuccacagaggccaagcacguuuuuagcccuggauucuuuccccagcugaaucauaccaaaugcgacaagaccgcuauuccucugauguggacaggcaugaucgaucuccccggcuacuaugaagccauucaccccuguacgguguucugcguccuguccgggccuggagccucuugugaggcuuucagcgagggcgggaucuuuaacauuaccuccccgaugugccuugugucuaaacagaaucgcuucagacugacagaacaacaggucaacuuugugugucagcggguugacauggauaucguggucuacugcaauggacaacgcaaggugauccucaccaagacacugguuauuggccaguguaucuauaccauuacgagccuuuucucccugcuccccgggguggcgcacagcaucgccgucgagcugugcgugccuggauuucauggcugggcuacagccgcccugcucgugaccuucuguuuuggcuggguucugauucccgcuaucaccuucauuauccuuacaauccugaaauuuauugccaacaucuuccacaccucuaaccaggaaaauagacucaaguccguccugcggaaaauuaaggaggaauuugagaaaacaaaggggagcauggugugcgacguguguaaguacgagugcgaaacguauaaagagcuuaaggcgcauggagucucuugcccucagucccaaugucccuacugcuucacccacugugaaccgacagaggcugccuuucaggcccauuaucgcgugugccagguuacccacagauuccgggaugaccugaaaaagacagugaccccucagaacuucacgcccggcuguuaccgcacccucaaucuguuuagauacaaaagccggugcuauaucuucacaaugugggucuuucugcucgugcuggaaucuauucuuugggcugccagcgcuuccgagguuccucugagccccguguggaacgauaaugcccacggggucggaucuaucccuaugcauaccgaccucgagcuggauuucucccugacaagcuccucuaaguacaccuauagacgcaaacuuacgaacccccucgaagagacacaagcgaucaaucugcacauugaaaucgaggagcagaccauuggcguggacguucaugcccuggggcacugguuugauggccggcucaaccugaagacauccuuccacuguuacggagcuugcaccaaguaugaauacccguggcauaccgccaaaugucacuaugagagagacuaccaguacgaaacauccuggggcugcaauccugcugacugucccggggugggaacgggcugcaccgccugcgggcuuuaucuggaucagcucaagcccgucggaucugcguacaaaaucauuacaauccgcuauagccggagagugugugugcaacugggcgaggaaaaccugugcaagaucauugacaugaaugauuguuuugucucccgccauguuaaggugugcaucauugggaccgugucuaaauucagccagggcgacacacuucucuuuuucggaccucuggagggcgggggacugaucuuuaagcacugguguaccuccacgugccaguucggcgauccgggggacauuaugagcccccgggauaaaggauuucucuguccugaguuccccggcucuuucagaaagaaaugcaacuuugccacaaccccucugugugaauacgacgggaauauggucuccggcuauaagaaagugauggcuaccaucgauagcuuccagucuuuuaacacauccaccaugcauuucacagacgagcgcaucaaguggaaggaucccgacggaaugcuucgggaucacauuaauauccugguuacgaaagacauugacuuugauaaccucggcgaaaacccuugcaagaucgggcugcaaaccagcgccauugagggagcuuggggcucuggggugggauucacacugaccugucuugucucccucacagaaugccccaccuuucugacgagcaucaaagccugcgacaaggccauuuguuacggcgcugaguccgugacccugacaagagggcagaauaccguuaaagugagcggcaagggaggccacucugggagccucuucaagugcugucauggagaggaaugcucccagaucggccugcacgcggccgcuccgcaucuugauaaagucaacgggaucucugagauugaaaauaacaagguguaugacgauggagccccucaauguggcguuaaaugcugguuugucaagagcggcgaguggaucuccgggauuuucucuggaaauuggaucgugcugauugugcucuguguguuucugcuguucagccuuguccuccuguccguucugugccccgugcgcaaacacaagaagucuuga

SEQ ID NO: 13374 - RNA, 3408 nt, Artificial Sequence
  derived and/or modified CDS sequence (opt5) from HTNV(ZLS6-11)__FJ753397.1__GP
augggcaucuggaaguggcugauuauggccagccucguguggcccgcuuacacccugagaaacgucuaugacaugcggaucgagugcccucacacaguuuccuucggggaaaauucugugauuggauacguggagcuuccgcccaugccucuggccgauacgagccagaugguccccgaauccucuuguagcauggacaaccaucaaucccucaauaccaucacaaaauauacccaggugucuuggcgcggcaaggcggaucagagccaggcuucccaaaacagcuuugaggccguuucugccgaaguggaccugaaagggacaugcguccuuaagcacaaaaugcuggaggaguccuacagaagccggaagucuauuaccuguuaugaucucuccugcaauagcacauacuguaagccuacccuguauaugaucgugcccauccaugcuugcaacaugaugaaaucuugucugauugcccucggaccuuaccgcguucagguggucuacgaaagaacguauugcaugaccggcauccugauugaggggaaguguuucgugccggaccaguccguggucagcaucauuaaacacggaaucuuugauauugcuuccguucauaucgugugcuucuuuguggccgucaagggcaauacauacaaacuuuucgaacaggugaagaagucuuuucaaagcaccuguaacgacacagaggauaaaguucagggcuauuacaucugcauugccgggggaaauuccgcgcccaucuaugugccuacccuggacgauuuccggagcauggaggcuuuuucuggcauuuucaagagcccccacggggaagaccacgaucucgccggagaggaaaucgcuagcuacucuauugucggcccugccaacgcgaaagugccccauagcgccuccucugacacgcugagccuuacagcuuauuccgggaucccgagcuacucuucccugagcauccucaccucuuccacagaggccaagcacguuuuuagcccuggauucuuuccccagcugaaucauaccaaaugcgacaagaccgcuauuccucugauguggacaggcaugaucgaucuccccggcuacuaugaagccauucaccccuguacgguguucugcguccuguccgggccuggagccucuugugaggcuuucagcgagggcgggaucuuuaacauuaccuccccgaugugccuugugucuaaacagaaucgcuucagacugacagaacaacaggucaacuuugugugucagcggguugacauggauaucguggucuacugcaauggacaacgcaaggugauccucaccaagacacugguuauuggccaguguaucuauaccauuacgagccuuuucucccugcuccccgggguggcgcacagcaucgccgucgagcugugcgugccuggauuucauggcugggcuacagccgcccugcucgugaccuucuguuuuggcuggguucugauucccgcuaucaccuucauuauccuuacaauccugaaauuuauugccaacaucuuccacaccucuaaccaggaaaauagacucaaguccguccugcggaaaauuaaggaggaauuugagaaaacaaaggggagcauggugugcgacguguguaaguacgagugcgaaacguauaaagagcuuaaggcgcauggagucucuugcccucagucccaaugucccuacugcuucacccacugugaaccgacagaggcugccuuucaggcccauuaucgcgugugccagguuacccacagauuccgggaugaccugaaaaagacagugaccccucagaacuucacgcccggcuguuaccgcacccucaaucuguuuagauacaaaagccggugcuauaucuucacaaugugggucuuucugcucgugcuggaaucuauucuuugggcugccagcgcuuccgagguuccucugagccccguguggaacgauaaugcccacggggucggaucuaucccuaugcauaccgaccucgagcuggauuucucccugacaagcuccucuaaguacaccuauagacgcaaacuuacgaacccccucgaagagacacaagcgaucaaucugcacauugaaaucgaggagcagaccauuggcguggacguucaugcccuggggcacugguuugauggccggcucaaccugaagacauccuuccacuguuacggagcuugcaccaaguaugaauacccguggcauaccgccaaaugucacuaugagagagacuaccaguacgaaacauccuggggcugcaauccugcugacugucccggggugggaacgggcugcaccgccugcgggcuuuaucuggaucagcucaagcccgucggaucugcguacaaaaucauuacaauccgcuauagccggaaggugugugugcaauuuggcgaggaaaaccugugcaagaucauugacaugaaugauuguuucgucuccagacauguuaaagugugcaucauugggaccgugucuaaguuuagccagggcgacacacugcuuuucuuuggaccucucgagggcgggggacugaucuucaaacacugguguaccuccacgugccaguuuggcgauccgggggacauuaugagcccccgcgauaagggauuccuguguccugaguuccccggcucuuuucggaaaaagugcaacuucgccacaaccccucucugugaauacgacgggaauauggucuccggcuauaaaaaggugauggcuaccaucgauagcuuucagucuuucaacacauccaccaugcauuuuacagacgagagaaucgaauggaaggaucccgacggaaugcugcgcgaucacauuaauauccuuguuacgaaagacauugacuucgauaaccugggcgagaacccuugcaagaucgggcuccaaaccagcgccauugaaggagcuuggggcucuggggugggauuuacacugaccugucuggucucccuuacagagugccccaccuuccucacgagcaucaaagccugcgacaaggccauuuguuacggcgcugaguccgugacccugacacgggggcagaauaccguuaaagugagcggcaagggaggccacucugggagccuguuuaagugcugucauggagaagagugcucccagaucggccuccacgcggccgcuccgcaucuggauaaagucgacgggaucucugaaauugagaacaauaagguguaugaugacggagccccucaauguggcguuaaaugcugguucgugaagucuggcgaauggaucuccgggauuuuuagcggaaacuggaucguccuuauugugcuguguguguuccuccuguucagccugguccuucucuccguucugugccccgugagaaaacacaagaagucuuga

SEQ ID NO: 13375 - RNA, 3408 nt, Artificial Sequence
  derived and/or modified CDS sequence (opt5) from HTNV__AB030232.1__GP
augggccuguggaaguggcucaucauggccgugcuggucuggcccugcuucgcucuuagaaacguuuacgacaugaaaauugaguguccucacaccgugaauuuuggggaaaacagcguggucggauauguggagcugccgcccaugccuaucgccgauauuacacagaugaugcccgaauccucuugcagcauggacaaucaucaaucccucaacacgaucaccaaguacacacagguuucuuggcggaaaaaggcggaucgcgcucagagcucccagaccucuuucgagacagugagcuccgaagucgacuuuaaaggcaccugugugcugaagcacaagaugguugaggauagcuauagaucucggaaauccauuaucugcuacgaccuuagcuguaauucuacauucugcaagccuacccuguaucucaucgugcccguccaugccuguaacaugaugaaauccugccugauugcccuggggccuuaccgcgugcaagauguguaugagagaacguacuguaugagcggaguccuccuggaaggcaagugcuuuguuccggaccggucugugguguccaucauuaaacacgggaucuucgauauugcuagcguccauaucgugugcuuuuucguugccauuaagggauccaccuacaagauccuugaacaggugaaaaagucuuuugagcugacauguaaugacaccgauaacaaaauccagggcuauuacauuugccucgucggcgggaauagcgcucccaucuaugugccuacacuggacgauuuccgcuccauggaggccuuugcgggaauuuucaagagcccccacggcgaggaccacgaccuugccggggaagagguugcuucuuacuccaucgugggaccugccaacgcuaaagucccccauagcgccucugcggauacccugagccucguggccuuuuccggcauuccgucuuauagcuccuucagcguccugacggggucuacagacgcuagacacguguucuccccuggauuuuucccccagcugaaucaaacccggugugauaagacagccaucccucucaccuggaccggcaugaucgaccugcccggcuacuaugaagcuguucaucccugcacaguguuuuguguccuuagcgggccuggagccucuugcgaggccuucuccgaaggcgggauuuuuaacaucacgagcccgaugugucugguguccgagcagaaucgcuucagaucuagcgagcagcagguuaacuuugugugccaacgggucgauauggacauugugguguacuguaauggacagaaaaagguuauccucaccaagacacuggucauuggccagugcaucuacaccaucacaucccuuuucucucugcuccccgggguggcucacagcauugcgguggaacugugugucccuggauuucacggcugggccaccgcugcccugcucgugacguucugcuuuggcuggguucugauccccgccgugacacuugucauucugaccauccucaaauucauugcuaacaucuuucauaccuccaaccaagagaaucgccugaaguccgugcuuaaaaagauuaaagaagaguucgaaaagacaaaggggucuaugguuugugaugugugcaaauaugagugcgagaccuacaaggaacugaaagcccacggagucuccuguccucagagccagugccccuauuguuucacacauugcgagccgacggaagcggcuuuucaggcccacuacaaggugugucaaguuacccauagauuccgggacgaucucaaaaagacagugaccccucagaacuuuacacccggcugcuaucgcacccugaaucuguucagauacaagucucgguguuauaucuuuacgaugugggucuuccuccugauccuugaguccauucugugggccgcuagcgccucugaaaccccuagcacacccaucuggaacgacaaugcucacggggugggauccauuccuaugcacaccgaucucgagcuggacuuuagccugacaucuuccagcaaauacaccuacagacgcaaacuuacgaacccccucgagaaaacacaggccguggaccugcauaucgaacuggcgguccagaccauuggcguugaugugcacgcccucgggcauugguucgacggccggcugaaucuuaagacauccuuucacugcuauggagcuuguaccaaauacgaguauccguggcacaccgccaagugccauuacgaaagagauuaucaauacgagacaucuuggggcuguaacccugcugacugccccggggugggaacgggcugcaccgccugugggcuguaucucgaucagcugaagcccgucggaagcgcguacaaaaucaucacaauuaaguacucccgccgggugugcguucaguucggcgaggaaaaucuguguaaagugaucgacaugaacgauugcuuugucucuagacacgugaagauuuguaucauugggaccguuagcaaauucucccagggcgacacacuucucuuuuucggaccucuggagggcgggggacugaucuucaagcauuggugcaccucuacgugucaauuuggcgauccgggggacaucaugagcccccgcgauaaaggauuccucugcccugaauuucccggcuccuuccggaagaaguguaauuuugccacaaccccugugugcgaguaugacgggaacauggucagcggcuacaaaaaggugauggcuaccauugauucuuuccaguccuuuaauacaagcaugaugcacuucaccgacgaaagaaucgaguggaaagaccccgauggaaugcugcgcgaccauauuaacauccuuguuacaaaggauauugacuuugauaaucugggcgacaacccuuguaaaguggggcuccagacgucugccaucgagggagcuuggggcuccggggucggauucacccugacaugccaggugagccugaccgaaugccccacauuucuuaccucuaucaaggccugugauaaggccauuugcuauggcgcugaguccaucacgcucacccgggggcaaaacacagugaaagucagcggcaagggaggccacuccgggagcaccuucaaauguugccacggagaagaguguucucagauuggccugcaugcggccgcuccgcaccuggacaagguuaaugggaucagcgaaauggagaacuccaaaguguacgaugacggagccccugagugcggcauuaaguguugguucgugaagucuggcgaauggaucagcgggauuuuuaauggaaacuggaucguccucaucgugcugugcgccuuccuuauuuuuagccugguucuccugucucugcuuugucccgugagaaaacauaagaaggcuuga

SEQ ID NO: 13376 - RNA, 3408 nt, Artificial Sequence
  derived and/or modified CDS sequence (opt5) from HTNV__AB620032.1__GP
augggcauguggaaguggcuggugaucgccagccucgucuggcccguucuggcucuuagaaacguguacgacaugaaaauugagugcccucacaccguguccuucggggaaaauucugucaucggauuuguggagcugccgcccaugccucucgccgauacagcgcagaugguucccgaaagcuccuguucuauggacaaccaucaaagcauuaauacgaucaccaaguauacacaggugaccuggcggggcaaagcugauccugggcaguccucucagaacagcuucgagacagucuccaccgaaguggaccugaagggaacaugcguucuuaaacacaagaugguggaggagagcuaccgcucuagaaaguccauuaccuguuaugaucugagcugcaauucuacguacuguaaacccacccucuauaugaucgucccuauccaugccugcaacaugaugaaguccugucugauugcccugggcccguaccgggugcaaguggucuaugaacgcacauacugcaugaccgggguucucaucgagggaaaauguuuugugcccgaccagagcguggucucuauuaucaagcacggcauuuucgauaucgcuuccgugcauauuguuugcuuuuucguggccaucaaaggcaauacauacaagcuguuugaacaggucaagaaaucuuucgaguccaccuguaacgacacggagaauaaggugcagggguauuacaucugcauuguuggaggcaacucugcuccuaucuaugugcccacacuugaugacuuuagaagcauggaagccuucaccgggauuuuuaaauccccucacggagaggaucacgaccuggcgggcgaagagaucgccagcuacucuauugucgggcccgcuaaugccaaggugccgcauuccgcuagcucugauacacucagccugaucgccuauuccggaaucccuucuuacagcucccuuagcauucugaccucuuccaccgacgcgaaacacgucuucagccccggccucuuuccuaagcugaaccauacaaauugcgacaaaucugccaucccccugacguggaccggcaugauugaucuccccggguauuacgaagcuauccacccuuguacaguguucugcguucuguccggaccgggcgccagcugugaggcuuucuccgaagggggaauuuuuaacaucaccucucccaugugccuugugagcaagcaaaaucgguuccgccugacagagcagcaggucaacuuugugugucagagaguugacauggauaucguggucuacugcaacggccaacggaaggugauucucaccaaaacgcuggugaucgggcaguguauuuauacaaucaccucccuuuucucucugcucccuggaguugcccacagcauugccgucgagcugugcgugcccggcuuucauggcugggcuaccgcggcccugcucgugacauucuguuuuggguggguccugaucccugcugugaccuucguuauucuuacaauccugaaguuuguggccaauaucuuccacacguccaaccaggaaaaucgccucaaaagcguccugagaaagauuaaagaggaauuugagaagaccaagggaucuauggugugcgacguuuguaaauacgagugcgaaacauauaaggagcuuaaagcccauggcguguccugcccccaaagccaguguccguacugcuucacccacugugaaccuacagaggcugccuuucaggcgcauuauaaggucugccaggugacccaccgguuccgcgaugaccugaaaaagacgguuacaccccaaaacuucaccccuggguguuacagaacccucaaucuguuucgguauaagucucgcugcuacaucuucacaauguggguguuucugcucauucuggaauccguccuuugggcugccagcgccucugagacgccccuggcuccuguguggaacgauaaugcccacggagugggcagcguccccaugcauaccgaccucgagcuggauuucucccugacaagcagcuccaaauacaccuauagacggaaacuuacaaacccgcucgaagaggcucagagcaucgaccugcacauugaaaucgaggagcagaccaucgggguugaugugcaugcccugggccacugguuugacggaagacucaaucugaagaccuccuuccacuguuacggcgcgugcacaaaguaugaauacccuuggcauacggccaaaugucacuaugagcgcgacuaccaguaugaaaccucuugggggugcaaccccagcgauugucccggagugggcacagggugcaccgcuugcggacuuuaccuggaccaacucaagccugucggcuccgccuacaagauuaucacaauucgguauucuagacgcguguguguucaguuuggggaggaaaaucugugcaaaaucauugauaugaacgacuguuucgugagccggcaugucaaggugugcaucaucggcaccguuuccaaauuuucucagggagauacgcugcuuuucuuuggcccgcucgaagggggaggccugauuuucaagcacugguguacaagcacaugccaguuuggggaccccggagauaucauguccccuagagacaaaggcuuccugugucccgaguucccugggagcuuucgcaagaaaugcaauuucgcuaccacccccauuugugaguacgauggcaacaccgugucuggauauaagaaggucauggccacaaucgacuccuuucagagcuucaauacgucuaccaugcauuuuacagaugagcggauugaauggaaagacccugauggcaugcucagagaccacaucaacauccuggugaccaaggacauugauuucgacaaccuuggggagaaucccugcaaaaucggacugcaaacauccagcauugaaggcgcgugggggucuggaguuggcuuuacccucacgugucuggugucccugaccgagugcccgacauuccuuaccagcaucaaggccugcgauaaagcuauuuguuacggggccgaguccgucacacucacccgcggccagaacacagugaaggugagcggaaagggcgggcacucuggaagcaccuuuaaaugcugucauggcgaagacugcucccagaucgggcugcacgcugccgccccucaucuggauaaggucaauggaauuucugagaucgaaaacagcaaaguuuaugacgauggcgcuccccaauguggcaucaagugcugguucgugaaauccggggaguggauuucuggaaucuuuagcggcaauuggauugugcucaucguccuguguguguuccuucuguucucccucguucugcugucuauucuuugcccugugcggaagcacaagaaaagcuga

SEQ ID NO: 13377 - RNA, 3408 nt, Artificial Sequence
  derived and/or modified CDS sequence (opt5) from HTNV__D25532.1__GP
augggcaucuggaaguggcuggugauggccagccucgucuggcccguucugacccuuagaaacguguacgacaugaaaauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucacgaccuggccggcgaggaaaucgcguccuauagcauuguggggccugccaaugcuaaaguuccccauucugccagcuccgauacacuccgccugaucgcuuacucugggauuccgagcuauuccagccuuucuauccugaccuccagcaccgaggccaagcacguguuuucuccuggccucuuccccaaacugaaccauacaaauugcgacaaguccgcgaucccucugauuuggacgggcaugaucgaccuccccggguacuacgaagccguccaccccuguaccguguuuugcguucugagcggaccuggcgcuuccugugaggccuucucugagggaggaauuuucaacaucacaagcuccaugugccuugugucuaaacagaauagauuucggcugaccgaacagcaggucaacuucgugugucaacgcguggauauggacauuguugucuauugcaacggccagagaaaggugauccucacaaagacccuggugaucgggcaguguauuuacacgaucacaagccuguuuucccuucucccgggagucgcucacagcauugccguggagcugugcguucccggcuuccauggcugggccaccgcugcgcugcucgugaccuuuuguuucggguggguccugaucccugccauuacauuuaucauucuuaccgugcugaaauucaucgcuaauaucuuucacacaucuaaccaagaaaaucggcucaaguccguucugcgcaaaauuaaggaggaguucgagaaaacgaagggaagcauggugugcgaugucuguaaguaugagugcgaaaccuacaaagagcuuaaggcccauggcgugucuugcccccagucccaguguccuuauugcuuuacacacugugaacccaccgaggccgcuuuccaggcccauuacaaaguuugccaagugacacacagauuucgggacgaucugaagaaaaccgucacgccgcagaacuucaccccuggguguuaucgcacacucaaucuguucagauacaagagccggugcuacaucuuuaccauguggauuuuccugcucgugcuggaaucuauccuuugggcggcuagcgccuccgagacaccccugaccccuguguggaacgacaaugcccacggagucggcagcguucccaugcauacggaucucgagcuggacuuuucucugacauccagcuccaaguauaccuacagacgcaaacuuacaaacccucucgaagaggcucagucuauugaucugcacaucgaaaucgaggagcagaccauugggguggacgugcaugcccugggccacugguucgauggacggcucaaucugaagaccagcuuucacuguuauggcgcuugcacaaaauacgaauaucccuggcauacggccaagugucacuacgagagagacuaucaauacgaaaccuccugggggugcaacccgucugacuguccuggagucggcacagggugcaccgcgugcggacuuuaccuggaucagcucaaacccgugggcagcgccuauaagaucauuacaauccgcuacucccggagaguuugugugcaguucggggaggaaaaucugugcaagauuaucgacaugaacgauuguuuugucucucgccaugugaaaguuugcaucauuggcaccgugagcaaguucucccagggagacacgcugcucuuuuucggcccccuugaagggggaggccugaucuuuaaacacugguguacaucuaccugccaauucggggauccuggagacauuaugagcccgcgggauaagggcuuucugugucccgaguucccuggguccuucagaaagaagugcaauuuugcuaccacacccaucugugaguaugacggcaacauggucagcggauacaaaaaggugauggccaccauugauucuuuccaguccuuuaauacaagcacgaugcauuucaccgacgagcgcaucgaauggaaggauccugacggcaugcuccgggaucacaucaacauucugguuacaaaagacaucgacuuugauaaccuuggggagaaucccugcaagauuggacugcagaccucuuccaucgaaggcgcuugggggagcggagugggcuucacacucaccugucuggucucccugacggagugcccuaccuuucuuacaagcauuaaagccugcgacaaggcgaucuguuauggggccgagucugugacccucacaagaggccagaacaccgugaaagucagcggaaagggcgggcacuccggaucuacauucaagugcugucauggcgaagauugcagccaaauugggcugcacgcugccgcuccccaucuggacaaaguuaauggaaucuccgagaucgaaaacucuaagguguacgaugacggcgccccgcaguguggcauuaaaugcugguuugugaaaagcggggaguggaucuccggaauuuucucuggcaauuggaucguccucauugugcuguguguuuuucuucuguucagccucgugcugcuggggauccuuugcccuguccgcaaacacaagaaguccuga

SEQ ID NO: 13378 - RNA, 3408 nt, Artificial Sequence
  derived and/or modified CDS sequence (opt5) from HTNV__L08753.1__GP
augggcaucuggaaguggcuggugauggccagccucgucuggcccgcuuacacccugagaaacguuuaugacaugaaaauugagugcccucacacaguguccuucggggaaaauucugugaucggauacgucgagcuuccgcccauuccucuggccgauacgacccagauggugcccgaaagcuccuguucuauggacaaccaucaaagccucaauacaguuaccaaguauacacagguguccuggcggggcaaagcggaucaggcucaggccucucaaaacagcuuugaggccgucuccgcugaaguggaccugaaggggaccugcguucuuaaacacaagaugcuggaggagagcuaccgcucuagaaaguccaucgccuguuaugaucucagcugcaauucuacauacuguaaaccuacccuguauaugauugugcccauccaugcuugcaacaugaugaaguccugucugaucgcccucggaccucaccggguccaggugguguacgaacgcacguacugcaugaccggcguccugauugaggggaaauguuucguuccggaccagagcguggugucuaucauuaagcauggaaucuuugauauugcguccguccacaucgugugcuucuuuguugccgugaaaggcaauacauauaagauuuucgaacagaucaagaaauccuuugaguccaccuacaacgacacaaagaauaaagucgagggcuauuacaucuguauuguugggggaaacucugcucccaucuaugugccuacccuugaugacuucagaagcauggaagccuuuuccggcauuuuccggagcccccacggggaggaucaugaccuggcuggagaagagaucgccucuuacuccauugugggcccugcgaaugucaaggugccccacagcgccucuagcgauacgcucucccugacagcuuauucugggaucccgagcuacuccagccuuucuauccuggccggauccgcugaagccaaacaugucuuuagcccuggcuucuuuccccaacucaaccacaccaagugcgacaaaacagccauuccucugauguggaccggcaugaucgaccugcccggguacuaugaggcuauucaccccugcaccguguucuguguucucucuggaccuggcgcguccugcgaggccuucagcgaagggggaaucuuuaauauuacauccccgaugugucuggugucuaagcagaaccgcuucagacuuacggagcagcaggucaauuuugugugccaacggguugauauggacaucaucguguacuguaacggccagcgcaaggucauucugaccaaaacacucgugaucgggcagugcauuuauaccaucacaagccuguucucccuucugcccggaguggcucauucuauugccguugaacucugugucccuggcuuucacggcugggccaccgcugcccugcuggugacguucugcuuugggugggugcucauccccgcgaugacauucauuguccugaccauccuuaaguuuaucgcuaacauuuuccauaccagcaaucaagagaacaaacugaaguccgugcucagaaaaaucaaggaagaguuugagaagacaaaaggaagcaugguuugugaugugugcaaguacgaaugugagaccuauaaagaacugaaggcccacggcgucucuugcccucagucccagugccccuacuguuucacacauugcgagccgacggaagccgcuuuucaggcccacuaucgggugugucaaguuacccaccgcuucagagacgaucuuaaaaagacagugaccccucagaauuucacacccgggugcuaccggacccugaaccucuuucgcuacaagagcagauguuauauuuucacgaugugggucuuucugcuggugcucgagucuauccugugggcugccuccgcgagcgagauuccucuuuaccccguuuggaaugacaacgcccauggagugggcucugucccuaugcacaccgaucuggaacucgacuucagccugacauccagcucuaaauauaccuaccggagaaagcugacaaauccccuugaggaaucccaggcuaucaaccuccauaucgagauugaggaacagaccaucgggguggaugugcacgcccugggccacugguuugacggacgccugaaucucaaaacgagcuuccauugcuauggcgcuuguacaaaguacgaguauccguggcacaccgccaaaugccauuacgaucgggacuaccaauaugaaacauccuggggguguaacccuucugacugccccggagucggcaccggguguaccgcgugcggacuguaccuugaucagcugaagcccguuggcagcgccuauaagauuaucacaauuagauacucccgccgggugugcgugcaguuuggggaggaaaaucucuguaaaaucaucgacaugaacgauugcuucgucucuagacacgugaagguuuguauuaucggcacggugagcaaauuuucccagggagacacccugcuguucuuuggcccucuugaagggggaggccucauuuucaagcauuggugcacaucuaccugucaauuuggggauccgggagacaucaugagcccccgcgauaaaggcuuccugugcccugaguuccccggguccuuucggaagaaauguaauuucgcuacaaccccucugugcgaguaugacggcaacauggucagcggauacaagaaggugauggccacgauugauucuuuucaguccuucaauacaagcaccaugcacuuuaccgacgagagaaucgaauggaaagaucccgacggcaugcuccgcgaucacaucaacauucugguuacaaaggacaucgacuucgagaaccuuggggaaaauccuuguaaaauuggacugcagaccucuuccaucgagggcgcuugggggagcggagugggcuuuacacucacgugccuggucucucugaccgagugucccacauuccuuaccuccauuaaggccugcgauaaagccaucugcuauggggcugaaagcgugacacucacccggggccagaacacgguuaagguguccggaaagggcggguacagcggaucuaccuuuaaauguugccauggcgaggaauguagccaaauugggcugcacgcggccgcuccgcaucuggacaaggucaauggaaucuccgagaucgaaaacaauaaaguguacgaugacggcgccccucagugcggcauuaaguguugguucgugaaaucuggggaguggaucagcggaauuuuuagcggcaacuggaucguccucauuguucugugcguguuccuucuguucucucucauccugcugagcauccuuugucccgccagaaagcacaagaaauccuga

SEQ ID NO: 13379 - RNA, 3408 nt, Artificial Sequence
  derived and/or modified CDS sequence (opt5) from HTNV__M14627.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccguuccucucgcugauacggcccagauggugcccgaaagcuccuguaacauggacaaucaucaaucucugaacaccauuacaaaguacacccaggucagcuggcggggcaaagcggaucagucccagucuagccaaaauuccuuugagacagugagcaccgaaguugaccuuaaggggacaugcgugcugaaacacaagauggucgaggagucuuaucgcuccagaaagagcgugaccuguuacgaucucucuugcaacuccacguauuguaaaccuacccuguacaugaucgugcccauucaugcuugcaauaugaugaaguccugucugaucgcccucggaccuuaucggguccagguuguguacgaacgcucuuacugcaugacaggcgugcugaucgaggggaaauguuucgucccggaccaguccgugguuagcauuaucaagcacggaauuuuugauaucgccuccgugcauauugucugcuucuuuguggcuguuaaaggcaacaccuauaagaucuucgaacaggugaagaaaucuuuugagagcacauguaaugacaccgagaacaagguccaaggcuacuauauuugcaucgucgggggaaauuccgcccccaucuacgugccuacgcuugaugacuucagaagcauggaggcuuuuacaggcauuuuccggucuccccacggggaggaucacgaccuggccggagaagagaucgcguccuauagcauugugggcccugccaacgcuaaaguuccccauucugccagcuccgauacccucucucugaucgcuuacagcgggauuccguccuauagcucucuuuccauccugacaagcucuaccgaagccaagcacguguuuuccccuggacucuuccccaaacugaaucauaccaacugcgacaagagcgcgaucccucugauuuggacaggcaugaucgaccuccccggcuacuacgaggccguccaccccuguacgguguuuugcguucuguccgggccuggagcuucuugugaggccuucagcgaaggcgggauuuucaauaucaccuccccgaugugccuugugucuaaacagaaccgcuuuagacugacagagcagcaggucaacuucgugugucaacggguggauauggacauuguugucuauugcaauggacagcgcaaggugauccucaccaagacacuggugaucggccaguguauuuacaccaucacgagccuuuuuagccugcuccccggggucgcucacagcauugccguggaacugugcguuccuggauuccauggcugggccacagcugcgcugcucgugaccuuuuguuucggcuggguccugauccccgccauuaccuuuaucauucuuacagugcugaaauucaucgcuaacaucuuucacaccucuaaucaagagaacagacucaaguccguucugcggaaaauuaaggaagaguucgagaaaacaaaggggagcauggugugcgaugucuguaaguaugaaugcgagacguacaaagaacuuaaggcccauggagugucuugcccucagucccagugucccuauugcuuuacccacugugagccgacagaagccgcuuuccaggcccauuacaaaguuugccaagugacccaccgcuuuagagacgaucugaagaaaacagucaccccucagaauuucacgcccggcuguuaucggacccucaaccuguuccgcuacaagagcagaugcuacaucuuuacaauguggauuuuccugcucgugcuggagucuauccuuugggcggcuagcgccuccgagaccccucugacacccguguggaaugacaacgcccacggggucggaagcguuccuaugcauaccgaucucgaacuggacuuuucucugacguccagcuccaaguauacauaccggagaaaacuuaccaauccccucgaggaagcucagucuauugaucugcacaucgagaucgaggaacagacaauuggcguggacgugcaugcccuggggcacugguucgauggccgccucaaccugaagaccagcuuucacuguuauggagcuugcaccaaauacgaguauccguggcauacagccaagugucacuacgaacgggacuaucaauacgagacguccuggggcugcaauccuucugacugucccggggucggaaccggcugcacagcgugcgggcuuuaccuggaucagcucaaacccgugggaagcgccuauaagaucauuaccaucagauacucccgccggguuugugugcaguucggcgaagagaaccugugcaagauuaucgacaugaaugauuguuuugucucuagacaugugaaaguuugcaucauugggacagugagcaaguucucccagggcgacacccugcuuuucuucggaccucucgagggcgggggacugaucuuuaaacacugguguacgagcacaugccaauucggcgauccgggggacauuaugucuccccgcgauaagggauuucuguguccugaauuucccggcuccuuccggaaaaagugcaacuuugcuaccaccccuaucugugaguaugacgggaauauggucagcggcuacaaaaaggugauggccacaauugauucuuuccaguccuuuaacaccagcacaaugcauuucacggacgaaagaaucgaguggaaggaucccgacggaaugcuccgcgaucacaucaacauucugguuaccaaagacaucgacuuugauaaucuuggcgaaaacccuugcaagauugggcugcagacaucuuccaucgagggagcuuggggcagcggggugggauucacccucacaugucuggucucccugaccgagugccccacguuucuuaccagcauuaaagccugcgacaaggcgaucuguuauggcgccgaaucugugacacucacccgggggcagaauacagugaaagucagcggcaagggaggccacuccgggucuaccuucagaugcugucauggagaggauugcagccaaauuggccugcacgcugccgcuccgcaucuggacaagguuaacgggaucuccgaaaucgaaaauucuaaaguguacgaugacggagccccucaguguggcauuaagugcugguuugugaaaagcggcgaauggaucuccgggauuuucucuggaaacuggaucguccucauugugcuguguguuuuucuucuguucagccucgugcugcuguccauccuuugccccguccgcaagcacaaaaagagcuga

SEQ ID NO: 13380 - RNA, 3408 nt, Artificial Sequence
  derived and/or modified CDS sequence (opt5) from HTNV__EU074672.1__GP
augggcaucuggaaguggcuggugauggccagccucgucuggcccgcuuucgcccugagaaacguuuacgacaugaaaauugagugcccucacaccguguccuuuggggaaaauucugugaucggauaugucgagcuuccgcccaugccucuggcggauacaacgcagauggugcccgaaagcuccuguucuauggacaaccaucaaagccucaauaccauuacaaaguacacccagaucauuuggcggggcaaagcugaucagucccagucuagccaaaacuccuucgagacaguuagcaccgaaguggaccugaaggggacaugcguccuuaaacacaagaugaucgaggagucuuaucgcuccagaaagagcaucaccuguuacgaucugucuugcaauuccacguauuguaaaccuacccucuacaugauugugcccauccaugccugcaacaugaugaaguccugucugauugcccugggaccuuaucggguucagguggucuacgaacgcacauacugcaugaccggcgugcucaucgaggggaaauguuuugugccggaccagucugucguuuccauuaucaagcacggaauuuucgauaucgcuagcgugcauaucgugugcuuuuucgucgccgugaaaggcaauacauauaagauuuuugaacagguuaagaaauccuucgagucuaacuguaaugacaccgagaacaaggugcaaggcuacuauaucugcauuaucgggggaaauagcucccccgucuacgugccuacgcuggaugacuuuagaagcauggaggcuuucucuggcauuuuucggagcccccacggggaggaucacgaccuugccggagaagagguugcgagcuauucuaucgugggcccugccaacgcuaaagucccccauagcgccuccucugauacacuggggcucaucgcuuacagcggcauuccguccuauagcucucuguccauccuuaccagcucuacagaagccaagcacguguucuccccuggacuguuuccccagcucaaucauaccaaaugcgacaagaccgcgauuccucugacauggacgggcaugaucgaccugcccggguacuacgaggccauucaccccuguaccgucuucugcgugcucagcggaccuggcgcuuccugugaggccuucucugaagggggaaucuuuaacaucacaagcccgaugugccugguuuccaaacagaaucgcuucagacuuaccgagcagcaagugaacuuugucugucagcggguggauguugacauuaucguguauugcaacggccagcgcaaggucauucugacaaagacccucgugaucgggcaauguauuuacacgaucacaucucuguucagccuucugcccggaguggcucacuccauugccguugaacucugcgucccuggcuuucauggcugggccaccgcugcgcugcuggugaccuucuguuuugggugggugcucauccccgccaucacauucauuauccugaccauucuuaaauuuaucgcuaauauuuuccacacaagcaaccaggagaauagacugaagucuguccuccggaaaaucaaggaagaguuugagcgcacgaaaggauccauggugugcgauaucuguaaguaugaaugcgagaccuacagagaacugaaggcccauggcguuagcugcccucagucucagugucccuauugcuucacacacugugagccgaccgaagccgcuuuucaagcccauuacaaagugugccaggucacacaccgguuccgcgacgaucuuaagaaaaccgugacgccucagaacuucacccccggguguuauagaacacugaaucucuuucgguacaaguccagaugcuacauuuucaccauguggguuuuucugcuggugcucgagagcauccugugggcggcuucugccagcgagauuccucuuaaccccgucuggaaugacaacgcccacggagugggcuccaucccuaugcauacagaucuggaacucgacuucagccugaccucuuccagcaaauauacguaccgccggaagcugacaaauccccuugaggaaucccaggcuauugaucuccacguugagaucgaggaacaaaccaucgggguggacguccaugcccugggccacugguuugauggaagacugaaccucaagacaucuuuccacuguuauggcgcuugcaccaaauacgaguauccguggcauaccgccaagugucacuacgaacgcgacuaucaguacgagacaagcugggggugcaauccuuccgacugucccggagugggcacggggugcaccgcgugcggacuguaccuugaucagcugaaacccgugggcucugccuauaagauuaucacaauucgguacagcagacgcgucuguguucaguuuggggaagagaaccucugcaaaaucauugacaugaaugauuguuucgugucccggcaugugaaggucugcaucaucggcaccgugucuaaguuuagccaaggagacacacugcuguucuuuggcccucuugaagggggaggccucauuuucaaacacugguguaccuccacgugccaguuuggggauccgggagacaucaugagccccagagauaagggcuuccuguguccugaauuucccgggucuuuucgcaaaaagugcaacuucgcuacaaccccuguuugugaguaugacggcaauaugguguccggauacaaaaaggucauggccaccauugauagcuuucagucuuucaacacauccaccaugcauuuuacagacgaacggaucgaguggaaagaucccgacggcaugcugagagaucacauuaacauccucgugacgaaggacauugacuucgauaaucugggggaaaacccuugcaagaucggacuucagaccagcucuaucgagggcgcuuggggguccggaguuggcuuuacacugaccugucucauuagccugacagagugcuccaccuuccugacgagcaucaaagccugcgacaaggcgauuuguuauggggccgaaucugugacccuuacacgcggccaaaauaccgucaaagugagcggaaagggcgggcacuccggaucuagcuuuaaaugcugucauggcgaggaaugcucccagaucgggcuccacgcugccgcuccccaucuggauaagguuaacggaauuucugagauggaaaauagcaagguguucgacgauggcgccccgcaguguggcaucaaaugcugguuugucaaguccggggaguggaucucuggaauuuucagcggcaacuggaucgugcugauugugcucugugucuuccugcuuuucucccugguucuccugagcauccugugcccugugcggaaacacaagaaaucuuga

SEQ ID NO: 13381 - RNA, 3408 nt, Artificial Sequence
  derived and/or modified CDS sequence (opt5) from HTNV__GQ120966.1__GP
auggagaucuggaaguggcuggugauggccagccucgucuggcccgccuucacccugagaaacguuuacgacaugaaaauugaaugcccucacacaguguccuuuggcgaaaauucugugaucggguaugucgaacuuccgcccaugccucuggccgauacggcgcagauggugcccgagagcuccuguaacauggacaaucaucaaucuaugaacaccauuacaaaguacacccagguuagcuggcggggaaaagcugaucaggcccaggccucccaaaauucuuucgaagcugugagcgccgaggucgaccucaagggcacaugcgugcugaaacacaagaugcuugaggaauccuaucgcagcagaaagucuaucaccuguuacgaucuguccugcaacagcacauauuguaaaccuacccucuacaugauuguucccauccaugcuugcaauaugaugaagucuugucugaucgcccuggggccuuaucgggugcaggucguguacgagcgcacguacugcaugaccggagugcucauugaaggcaaauguuuugucccggaccaguccguugugagcaucauuaagcacgggaucuucgauauugcgucugugcauaucgucugcuuuuucguggccguuaaaggaaacacauauaagcuguuugaacaggugaagaaauccuuccaaagcaccuguaauggcacagagaacaagguccagggcuacuauauuugcaucguugggggaaauuccgcucccaucuacgugccuacccuugacgauuuuagaucuauggaggccuucagcggcauuuuucggagcccccacggggaggaccacgaucuggcuggagaagagaucgccuccuauucuauugugggcccugcgaacgccaaagucccccauuccgcuagcucugacacgcucagccugaucgccuacuccgggauuccgucuuauagcucccuuagcauccuggcuucuuccacagaagccaagcacguguucagcccuggauuuuucccccagcucaaucauaccaaaugcgauaagacagccaucccucugaccuggaccggcaugauugaccugcccggcuacuacgaggcuauccaccccuguacagucuucugcgugcucucugggccuggagcguccugugaggccuuuagcgaaggcgggauuuucaacaucacguccccgaugugccugguuucuaaacagaaucgcuuuagacuuaccgagcaacaggugaacuucgucugucagcggguggacauggauauuaucguuuauugcaacggacaacgcaaggugauccugacaaagacccucgucauuggccaguguaucuacacaauuaccagccuguuuucccuucugcccgggguggcucacucuaucgccguggaacucugcguuccuggauuccauggcugggccacggcugcccugcuggucacauuuuguuucggcugggugcucauucccgcgcugacccuuaucauucugaccauccucaaauuuaucgcuaauauuuuccacacaagcaaccaggagaauagacugaaguccgugcuucggaaaaucaaggaagaguuugagaaaaccaaggggagcauggucugcgacguguguaaguaugaaugcgagacauacaaagaacugaaggcccauggaguuucuugcccucagucccaaugucccuauugcuucacgcacugugagccgaccgaagccgcuuuucaggcccauuaccgcgugugccaggucacacacagauuccgggaugaccucaaaaagaccgugacaccucagaacuucacccccggcuguuaucgcacgcugaaucuguuuagauacaaaagccggugcuacauuuucaccauguggguuugucuccuggugcuugagucuauccugugggcugccuccgcgagcgaggucccucucaaccccguguggaaugauaacgcccacgggguuggaucugugccuaugcauacagaccuggaacuggauuuuccccuuaccagcuccagcaaguauacauacagacgccggcucaccaauccgcuggaggaaacgcaaucuauuaaccugcacaucgagaucgaggaacagacaauuggcgucgacgugcaugcucucgggcacugguucgauggcagacugaaucuuaagaccuccuuucacugcuauggagccuguacaaaauacgaguauccuuggcauaccgcuaagugccacuacgaacgcgacuaucaguacgagaccagcuggggcuguaaccccgccgauugccccggggugggaacaggcugcacggcgugugggcuguaccucgaccagcugaaaccugucggauccgccuauaagaucauuaccauccgguacucuagaaaaguuugcgugcaauucggcgaagagaaucuguguaaggugauugacaugaacgauugcuuugucacacgccaugugaagguuuguaucaucgggaccgugagcaaauucucccagggcgacacacuucucuuuuucggaccgcuggagggcgggggacugauuuuuaagcacuggugcaccucuacgugucaguucggcgaucccggggacaucaugagcccucgggauaaaggauuucucugccccgaguucccuggcuccuucagaaagaaauguaauuuugcuacaacaccccugugcgaguaugacgggaacauggucucuggcuacaagaaagugauggccaccauugauagcuuccaguccuuuaacaccagcaccaugcauuucacagacgaacgcaucgaguggaaggauccugacggaaugcuucgggaucacauuaauauccugguuacgaaggacaucgauuuugacaaccucggcgaaaaucccuguaaaauugggcugcaaaccucuuccaucgagggagcuuggggcagcggggugggauucacacugaccugccuuauuucucucacagagugcccgaccuuucugacguccaucaaggccugugacaaagccauuugcuauggcgcugaaagcgucacccugacaagagggcagaacaccgugaagguuucuggcaaaggaggccacuccgggagcacauucaaguguugccauggagaggaauguucccagaucggccuccacgcggccgcuccucaucuggauaaggugaaugggauuagcgagaucgaaaacaauaaagucuacgacgauggagcuccccaaugcggcgugaaguguugguuugugaaaucuggcgaguggaucagcgggauuuucuccggaaacuggaucguccuuauuguucugugcguguuucuccuguucucucuggugcuucucagcguccuguguccugugcgcaagcacaaaaaguccuga

SEQ ID NO: 13382 - RNA, 3408 nt, Artificial Sequence
  derived and/or modified CDS sequence (opt5) from HTNV(CGAa1011)__EF990927.1__GP
auggagaucuggaaguggcuggugauggccagccucgucuggcccgcucuggcccuuagaaacguucacgacaugaagauugaaugcccucauaccguguccuucggcaagaauagcgugaucggguacgucgagcugccgcccaugccucucgcggauacaauucagauggugcccgaaagcuccuguucuauggacaaccaccaaagccuguccacgguuaccaaauauacacaggugucuuggcggggaaaggcugaucaggcccagagcaaucaaaccuccuuugagacagucagcguggaaguugaccuuaaagggaccugcgugcugaagcauaagcucgucgaggagucuuaccgcuccagaaaaagccugacauguuaugaucugucuugcaacuccaccuacuguaagccuacgcucuauaugaucgugcccauucacgccugcaauaugaugaaaagcuguaucaucgcucuggggccucaucgggugcaggucguuuacgaacgcaccuauugcaugacaggagugcuucuggagggcaaguguuucgugccggaccagucugucguggggauuguuaaacacggaaucuuugauauugccuccgugcacaucgcuugcuucuuugucgccauuaccggcaacacauacaaacucuucgaacaggugaagaagucuuuuggcaccacguguaaugacacagagaacaagguucaaggguacuauaucugcauucugggaggcaauucucccccuaucuacgugcccacccuugaugacuucagaucuauggaggcguuuagcgggaucuucaaauccccucauggagaagaucacgaccuggccggcgaggaaauugcuagcuauucuaucgucgggcccgccaacgcuaaggugccgcauuccgccagcucugauacacucagccugauugcguuuuccggaaucccuucuuacagcucccugagcauucucaccucuuccaccgaggccaaacacgucuucagccccggccuguuuccucagcuuaaucacacaaagugcgacaaaacggcuaucccccugaccuggacaggcaucauugaccuccccggguauuacgaagccgugcauccuuguaccguuuucugcgugcugucuggaccgggcgcuuccugugaggccuucagcgagggcggaaucuuuaacauuacaucccccaugugccuugucucuaagcagaaucgguuccgccugaccgaacagcaagugaacuuuguuugucagagaguggauauggacaucgucguguauugcaauggccagcggaaggugauucucacgaaaacacugguuaucgggcaauguaucuacaccauuaccagccuguucucccuccugccuggagucgcccacucuaucgcuguggagcuuugcgugcccggcuuucauggcugggcgacagccgcucugcucauuaccuucuguuuuggguggguccugaucccugcccuuacauucauugugcugacgguucucaaguuuaucgccaacauuuuccacaccagcaaccaggaaaaucgccugaaaauggugcugaagaaaaucaaggaggaauuugagagaacaaagggauccauggucugcgauaucuguaaauacgagugcgaaaccuauaaggagcucaaagcucauggcgugagcugcccccagucucaguguccguacugcuucacacacugugaaccuaccgaguccgccuuucaagcgcacuaucggguuugccaggugacgcaucgcuucagagacgaucugaagaaaaccgucacaccccagaacuucaccccuggguguuaccggacacuuaaucuguuucgcuauaagagcagaugcuacauuuucaccauguggaucugucuccuggugcuggaaucuauucuuugggcugccuccgccagcgagaucccccucucuccuacguggaacgacaaugcucacggaguuggcagcauucccaugcauacagaucuggagcuggacuuuucccucaccagcuccuccaaguauacauaccggagaaaacugaccaacccgcuugaagagagccaggccgugaauuuccacgucgaaaucgaggagcaagcuaucgggguggaugugcacgcccugggccauugguuugacggacgccucaaccugaagaccuccuuccacugcuacggcgcguguacaaaauaugaauacccuuggcauacggccaagugccacuaugagcgggauuaccaguaugaaaccucuuggggguguaaucccagcgacugccccggagucggcacagggugcaccgcuuguggacuguaccuugaccagcucaaaccuguuggcuccgccuauaagauuaucacaauuagauacucucgccgggugugcgugcaguuuggggaggaaaaccuguguaaggucaucgauaugaaugacugcuucgugagcagacauguuaaaguguguauuaucggcaccgucuccaaguuuucucaaggagauacgcuccucuucuuuggcccgcuggaagggggaggccuuaucuucaaacacuggugcacaagcaccugucaguuuggggaccccggagauauuauguccccucgcgacaagggcuuccugugccccgaguucccugggagcuuucggaaaaaguguaacuucgcuaccacacccgugugcgaguacgauggcaauaugguuucuggauauaaaaaggugauggccaccaucgacuccuuucagagcucuaacacauccacgaugcacuucaccgaugagagaauugaauggaaggacccugauggcaugcuccgcgaccauaucaauauucuggucacaaaagauaucgacuuugacaaccugggggagaaccccuguaagaucggacuucagaccagcucuauugaaggcgcguggggguccggagugggcuucacacugaccugccugaucagccugacggagugcccgaccuuucucacauccauuaaagccugugauaaggcuaucugcuacggggccgagagcguuacccugacacggggccaaaauaccgugaaagucucuggaaagggcgggcacagcggauccacauucaaguguugccauggcgaagacuguucucagagcgggcuucacgcugccgccccucaucuggauaaagugaacggaauuuccgagaucgaaaauucuaagguguaugacgauggcgcuccccagugcggcgucaaauguugguuuguuaagagcggggaguggauuuccggaaucuucucuggcaacuggaucgugcucauugugcugugcgucuuucugcuuuucagccucgugcugcuguccauccucuguccuguuagaaaacacaaaaagagcuga

SEQ ID NO: 13383 - RNA, 3408 nt, Artificial Sequence
  derived and/or modified CDS sequence (opt5) from HTNV(CGAa2)__EU092223.1__GP
auggagaucuggaaguggcuggugauggccagccucgucuggcccgcucuggcccuuagaaacguucacgacaugaaaauugaaugcccucauaccguguccuucggcaaaaauucugugaucggguacgucgagcugccgcccaugccucucgcggauacaauucagauggugcccgaaagcuccuguucuauggacaaccaccaaagccuguccacgguuaccaaguauacacaggugucuuggcggggaaaggcugaucaggcccagccuagccaaaccuccuuugagacagucagcguggaaguugaccuuaaagggaccugcgugcugaagcauaagcucgucgaggagucuuaccgcuccagaaaaagccugacauguuaugaucugucuugcaauuccaccuacuguaagcccacgcucuauaugaucgugccuauucacgccugcaacaugaugaaaagcuguaucaucgcucugggcccgcaucgggugcaggucguuuacgaacgcaccuauugcaugacaggagugcuucuggagggcaaguguuucgugcccgaccagucugucguguccauuguuagacacgggaucuuugauauugccagcgugcacaucgcuugcuucuuugucgccauuaccggaaauacauacaaacucuucgaacaggugaagaaguccuuuggcaccacguguaacgacacagagaauaaaguucaaggcuacuauaucugcauucucgggggaaacucuccucccaucuacgugccuacccuugaugacuuccggagcauggaggcguuuuccggcaucuucaagagcccccauggggaagaucacgaccuggccggagaggaaauugcuucuuauuccaucgucggcccggccaaugcuaaagugccucauagcgccucuagcgauacacucucccugauugcguuuucugggauccccagcuacuccagccugucuauucucaccuccagcaccgaggccaagcacgucuucucuccuggacuguuuccccagcuuaaccacacaaaaugcgacaagacggcuaucccccugaccuggacaggcaucauugaccucccuggcuauuacgaagccgugcauccguguaccguuuucugcgugcuguccgggcccggagcuagcugugaggccuucuccgagggcgggaucuuuaauauuacaucuccuaugugccuugucagcaaacagaaccgcuucagacugaccgaacagcaagugaauuuuguuugucagcggguggauauggacaucgucguguauugcaacggacagcgcaaggugauucucacgaagacacugguuaucggccaauguaucuacaccauuaccucccuguucucucuccugcccggggucgcccacagcaucgcuguggagcuuugcgugccuggauuucauggcugggcgacagccgcucugcucauuaccuucuguuuuggcuggguccugauccccgcccuuacauucauugugcugacgguucucaaauuuaucgccaauauuuuccacaccuccaaccaggaaaacagacugaagauggugcugaaaaagaucaaagaggaauuugagcggacaaaggggagcauggucugcgauaucuguaaguacgagugcgaaaccuauaaagagcucaaggcucauggagugucuugcccgcagucccaguguccuuacugcuucacacacugugaacccaccgagagcgccuuucaagcgcacuaucgcguuugccaggugacgcauagauuccgggacgaucugaaaaagaccgucacaccucagaauuucacccccggcuguuaccgcacacuuaaccuguuuagauauaaaucucggugcuacauuuucaccauguggaucugucuccuggugcuggaauccauucuuugggcugccagcgccucugagaucccucucagccccacguggaaugacaacgcucacgggguuggauccauuccgaugcauacagaucuggagcuggacuuuagccucaccucuuccagcaaguauacauacagacgcaagcugaccaauccucuugaagagucccaggccgugaacuuccacgucgaaaucgaggagcaagcuaucggcguggaugugcacgcccuggggcauuggucugacggccggcucaaucugaaaaccagcuuucacugcuacggagcguguacaaaguaugaauaccccuggcauacggccaaaugccacuaugagagagauuaccaguaugaaaccuccuggggcuguaaccccucugacugcccuggggucggaacaggcugcaccgcuugugggcuguaccuugaccagcucaagccgguuggaagcgccuauaaaauuaucacaauucgcuacucccggagagugugcgugcaguucggcgaggaaaaucuguguaaggucaucgauaugaacgacugcuuugugucucgccauguuaagguguguauuaucgggaccgucagcaaauucucccaaggcgauacgcugcucuuuuucggaccccuggagggcgggggacuuaucuuuaagcacuggugcacaagcaccugucaguucggcgacccuggggauauuaugucuccccgggacaaaggauuucugugcccugaguuccccggcuccuucagaaagaaauguaauuuugcuaccacaccugugugcgaauacgaugggaacaugguuagcggcuauaagaaagugauggccaccaucgacucuuuccaguccagcaauacaucuacgaugcacuuuaccgaugagcgcauugaauggaaggaccccgauggaaugcuccgggaccauaucaacauucuggucacaaaggauaucgacuucgacaaucugggcgagaacccguguaaaaucgggcuucagaccuccagcauugaaggagcguggggcuccggggugggauuuacacugaccugccugaucagccugacggagugcccuaccuuccucacaucuauuaaggccugugauaaagcuaucugcuacggcgccgagagcguuacccugacaagagggcaaaacaccgugaaggucuccggcaaaggaggccacucugggagcacauuuaaguguugccauggagaagacuguucccagucuggccuucacgcugccgcuccccaucuggauaaggugaaugggauuagcgagaucgaaaacuccaaaguguaugacgauggagccccucagugcggcgucaaguguugguucguuaaaucuggcgaguggauuagcgggaucuuuuccggaaauuggaucgugcucauugugcugugcgucuuccugcuuuuuagccucgugcugcugucuauccucugucccguucgcaagcacaaaaaguccuga

SEQ ID NO: 13384 - RNA, 3408 nt, Artificial Sequence
  derived and/or modified CDS sequence (opt5) from HTNV(CGAa31MP7)__EF990925.1__GP
augggcaucuggaaguggcuggugauggccagccucgucuggcccgcuuucgcccugagaaacguuuacgacaugaaaauugagugcccucacaccguguccuuuggggaaaauucugugaucggauaugucgagcuuccgcccaugccucuggcggauacaacgcagauggugcccgaaagcuccuguucuauggacaaccaucaaagccucaauaccauuacaaaguacacccagaucauuuggcggggcaaagcugaucagucccagucuagccaaaacuccuucgagacaguuagcaccgggguggaccugaagggaacaugcguccuuaaacacaagaugaucgaagagucuuaucgcuccagaaagagcaucaccuguuacgaucugucuugcaauuccacguauuguaaaccuacccucuacaugauugugcccauccaugccugcaacaugaugaaguccugucugauugcccugggcccuuaucggguucagguggucuacgagcgcacauacugcaugaccggggugcucaucgaaggaaaauguuuugugccggaccagucugucguuuccauuaucaagcacggcauuuucgauaucgcuagcgugcauaucgugugcuuuuucgucgccgugaaaggcaauacauauaagauuuuugagcagguuaagaaauccuucgaaucuaacuguaaugacaccgagaacaaggugcaaggguacuauaucugcauuaucggaggcaauagcucccccgucuacgugccuacgcuggaugacuuuagaagcauggaggcuuucucugggauuuuucggagcccccacggagaagaucacgaccuugccggcgaggaaguugcgagcuauucuaucguggggccugccaacgcuaaagucccccauagcgccuccucugauacacugggacucaucgcuuacagcggcauuccguccuauagcucucuguccauccuuaccagcucuacagaggccaagcacguguucuccccuggccuguuuccccagcucaaucauaccaaaugcgacaagaccgcgauuccucugacauggacggggaugaucgaccugcccggauacuacgaagccauucaccccuguaccgucuucugcgugcucagcggcccuggggcuuccugugaggccuucucugagggaggcaucuuuaacaucacaagcccgaugugccugguuuccaaacagaaucgcuucagacuuaccgaacagcaagugaacuuugucugucagcggguggauguugacauuaucguguauugcaacgggcagcgcaaggucauucugacaaagacccucgugaucggacaauguauuuacacgaucacaucucuguucagccuucugcccggcguggcucacuccauugccguugagcucugcgucccuggcuuucaugggugggccaccgcugcgcugcuggugaccuucuguuuuggaugggugcucauccccgccaucacauucauuauccugaccauucuuaaauuuaucgcuaauauuuuccacacaagcaaccaggaaaauagacugaagucuguccuccggaaaaucaaggaggaauuugagcgcacgaaaggcuccauggugugcgauaucuguaaguaugagugcgaaaccuacaaggagcugaaagcccaugggguuagcugcccucagucucagugucccuauugcuucacacacugugaaccgaccgaggccgcuuuucaagcccauuacagagugugccaggucacacaccgguuccgcgacgaucuuaagaaaaccgugacgccucagaacuucacccccggauguuauagaacacugaaucucuuucgguacaaguccagaugcuacauuuucaccauguggaucugucugcugguucucgaaagcauucugugggcggcuucugccagcgagaucccucuuaaccccguguggaaugacaacgcccacggcgucggguccauuccuaugcauacagaucuggagcucgacuuuagccugaccucuuccagcaaacacacguaucgccggaagcugacaaauccccuugaagagucccaggcuaucgaucuccauguggaaaucgaggagcaaaccauuggcguugacgugcacgcccugggacacugguucgauggcagacugaaccucaagacaucuuuucauugcuacggggcuuguaccaaauaugaauacccguggcacaccgccaagugccauuaugagcgcgacuaccaguaugaaacaagcuggggauguaauccuuccgacugccccggcgucgggacgggaugcaccgcguguggccuguaccuugaucagcugaaacccguggggucugccuacaagaucauuacaauccgguauagcagacgcgugugcguccaguucggcgaggaaaaccucuguaaaguuauugacaugaaugauugcuuugugucccggcacgugaaggucuguaucaucggaaccgugucuaaguucagccaaggcgacacacugcuguuuuucgggccucuugagggaggcgggcucauuuuuaaacauuggugcaccuccacgugucaguucggagauccgggcgacaucaugagccccagagauaagggguuucugugcccugaguuccccggcucuuuccgcaaaaaguguaacuuugcuacaaccccuguuugcggauacgacggcaauaugguguccggguauaaaaaggucauggccaccauugauagcuuccagucuuuuaacacauccaccaugcacuucacagacgaacggaucgaguggaaagaucccgacggaaugcugagagaucacauuaacauccucgugacgaaggacauugacuuugauaaucugggcgaaaacccuuguaagaucgggcuucagaccagcucuaucgagggagcuuggggcuccgggguuggcuucacacugaccugccucauuagccugacagaaugccccaccuuucugacguccaucaaagccugugacaaggcgauuugcuacggagccgagagcgugacccuuacacgcggccaaaauaccgucaaagugucugggaagggaggccauagcggguccacauucaaauguugccacggagaggauuguucucagagcggccuccaugcugccgcuccgcaccuggacaagguuaacggcaucuccgaaauugaaaauucuaagguguaugaugacggggccccucagugcggaaucaaauguugguuugucaagagcggcgaguggaucuccgggauuuucucuggaaacuggaucgugcugauugugcucugcgucuuucugcuuuucagccugguucuccuguccauccugugucccgugcggaaacauaagaaaagcuga

SEQ ID NO: 13385 - RNA, 3408 nt, Artificial Sequence
  derived and/or modified CDS sequence (opt5) from HTNV(CGAa4MP9)__EF990929.1__GP
auggagaucuggaaguggcuggugauggccagccucgucuggcccgcucuggcccuuagaaacguuuacgacaugaaaauugaaugcccucacaccguguccuucggcgaaaauucugugcugggguaugucgaacucccgcccaugccucuggcggauacaauccagauggugcccgagagcuccuguucuauggacaaccaucaaagcauguccacggcuaccaaguacacacagguuucuuggcggggaaaagccgaucaggcccagagcucccaaaccagcuuugaaacagugucugucgagguggaccuuaaggggaccugcguucugaaacacaagaugguggagaaguccuaucgcagcagaaaaucucucacauguuacgaucuguccugcaauagcaccuauuguaagccuacgcuguacaugauuguccccauccaugcuugcaacaugaugaaaucuuguauuaucgcccucgggccuuaucggguccaggugguguacgaacgcaccuacugcaugacaggaguucugcuugagggcaaguguuucgugccggaccaguccguggucagcaucgugaaacacuccauuuuugauaucgcuucuguucauauugccugcuucuuuguggcgaucaccgggaauacauauaagcugauugaacaggucaagaccagcuucggaacgacauguaacgacaccgaggauaaagugcaaggcuacuauaucugcauucucggcgggaauagcccucccaucuacguucccacacuggacgauuuuagaagcauggaggccuucucuggaaucuuucgguccccucacggcgaagaccacgaucuugcuggggaggaaauugccagcuauucuaucgugggacccgcuaacgccaagauuccgcauagcgcguccucugacacccugagccucaucgccuucuccggcauuccuagcuacucuucccugagcauccugaccucuuccacagaggcuaaacacgucuuuagccccggccucuucccucagcugaaucauacgaagugcgacaaaaccgccaucccccuuacauggaccggaauuaucgaucugcccggcuauuacgaagcugugcacccuuguacagucuuuugcgugcucuccggcccgggggccucuugugaggccuucagcgagggaggcauuuucaacaucaccucccccaugugccugguuucuaagcagaaucgcuuuagacuuacggaacagcaagugaacuucgucugucagcggguggacauggauauuguuguguacugcaaugggcagcgcaaagucauccugacaaagacccucgugaucggacaauguauuuauaccaucacaagccuguuuucccugcucccuggcguggcucacagcauugcgguugagcugugcguccccggguuccauggaugggccaccgcugcccuucuggugacauuuuguuucggcugggugcucaucccugccauuacguuugucgugcugaccguucuuaaguucaucgcuaacauuuuucacacaucuaaucaggaaaacagacugaaaauggugcucaagaaaaucaaggaggaguucgagaaaaccaagggcuccauggucugcgacaucuguaaguacgagugcgaaacauauaaagagcugaaggcccauggggugagcugcccccagucucaguguccguacugcuuuacccacugugaaccuacggaguccgcguuccaagcucauuaucggguuugccaggugacccaccgcuuuagagaagaucugaaaaagacagucacaccccagaacuucaccccuggauguuaccggacccucaaucuguuccgcuauaaaagcagaugcuacauuuuuacgauguggaucuuccuucuggugcucgagucuauucugugggccgccagcgcuuccgagacaccccugagcccuaccuggaacgacaaugcccacggcguugggucuauccccaugcauacagaucuugaacucgacuuuucccugaccagcuccucuaaguacaccuaucggagaaagcugacaaacccgcucgaggaagcucaggccgugagcuuccacgucgagauugaggaacaaacgaucggaguggaugugcaugcgcugggccacugguuugacgggcgccuuaaucugaaaaccuccuuccacuguuacggcgccugcacaaaguaugaguacccuuggcauaccgcuaaaugucacuaugaacgggauuaccaguaugagacaucuuggggaugcaaccccagcgacugucccggcgucgggaccggaugcacggccugcggccucuaccuggaccagcugaagccuguuggguccgcuuacaaaaucauuacaaucagauauucucgccgggugugugugcaguuuggagaagagaaucuuugcaaggucauugauauggacgauuguuucgugagcagacauguuaaggugugcaucauuggcaccgucuccaaauuuagccaaggggacacccuccuguucuuuggcccgcuggagggaggcgggcucaucuacaagcacugguguacaucuaccugccaguucggagaucccggcgacaucauguccccucgcgauaaagggcugcuuugucccgaauuuccuggauccuuccggaagaaaugcaacuucgccacaacgcccgugugugaguaugacggcaauaugguuucuggguacaagaaagugauggcgaccauugauuccuuucagagcaucaacacaucuaccaugcauuucacagacgaaagaauugaguggaaggauccugacggcaugcugcgcgaucacaucaauauucucgucaccaaggacaucgacuuugauaaccugggagaaaaucccugcaaaaucggccugcagacguccagcauugagggggccuggggauccggcgugggguucacccuuacaugucucaucagccugaccgagugcccgacauuucugaccucuauuaaggcuugcgacaaagccaucuguuauggagcugaaagcguuacacucacccggggccaaaacacggugaaggucuccgggaaaggcggacacucuggcagcacauucaagugcugucauggggaggauugcucccagucuggacugcacgccgccgcuccucaucuugacaaggugaauggcauuagcgaaauggagaacuccaaaguguacgaugacggggcgccccaguguggaaucaagugcugguuugucaaaucuggcgaauggauuagcggcaucuucuccgggaacuggaucguucugauugugcucuguguguuucugcuguucagccuuguccuccugucuauccugugcccugugagaaagcacaaaaaguccuga

SEQ ID NO: 13386 - RNA, 3408 nt, Artificial Sequence
  derived and/or modified CDS sequence (opt5) from HTNV(CGAa4P15)__EF990928.1__GP
auggagaucuggaaguggcuggugauggccagccucgucuggcccgcucuggcccuuagaaacguuuacgacaugaaaauugaaugcccucacaccguguccuucggcgaaaauucugugcugggguaugucgagcucccgcccaugccucuggcggauacaauccagauggugcccgagagcuccuguucuauggacaaccaucaaagcauguccacggcuaccaaguacacacagguuucuuggcggggaaaagccgaucaggcccagagcucccaaaccagcuuugaaacagugucugucgagguggaccuuaaggggaccugcguucugaaacacaagaugguggagaaguccuaucgcagcagaaaaucucucacauguuacgaucuguccugcaauagcaccuauuguaagccuacgcuguacaugauuguccccauccaugcuugcaacaugaugaaaucuuguauuaucgcccucgggccuuaucggguccaggugguguacgaacgcaccuacugcaugacaggaguucugcuugagggcaaguguuucgugccggaccaguccguggucagcaucgugaaacacuccauuuuugauaucgcuucuguucauauugccugcuucuuuguggcgaucaccgggaauacauauaagcuguucgaacaggucaagaccagcuuuggaacgacauguaacgacaccgaggauaaagugcaaggcuacuauauuugcauccucggcggcaauuccccucccauuuacguucccacacuggacgauuucagaagcauggaggccuuuucuggaaucuuccgguccccucacggcgaagaccacgaucuugcuggggaggaaaucgccagcuauucuauugugggacccgcuaacgccaagaucccgcauagcgcguccucugacacccugagccucauugccuuuuccggcaucccuagcuacucuucccugagcauucugaccucuuccacagaggcuaaacacgucuucagccccgggcucuuuccucagcugaaucauacgaagugcgacaaaaccgccaucccccuuacauggaccggaaucauugaucugcccggcuauuacgaagcugugcacccuuguacagucuucugcgugcucuccggcccgggggccucuugugaggccuucagcgagggaggcaucuuuaacauuaccucccccaugugccugguuucuaagcagaaucgcuucagacuuacggaacagcaagugaacuuugucugucagcggguggacauggauaucguuguguacugcaaugggcagcgcaaagucauucugacaaagacccucgugaucggacaauguaucuauaccauuacaagccuguucucccugcucccuggcguggcucacagcaucgcgguugagcugugcguccccggguuucauggaugggccaccgcugcccuucuggugacauucuguuuuggcugggugcucauuccugccaucacguucgucgugcugaccguucuuaaguuuauugcuaacaucuuccacacaucuaaucaggaaaacagacugaaaauggugcucaagaaaauuaaggaggaauuugagaaaaccaagggcuccauggucugcgacaucuguaaguacgagugcgaaacauauaaagagcugaaggcccauggggugagcugcccccagucucaguguccguacugcuucacccacugugaaccuacggaguccgcguuucaagcucauuaucggguuugccaggugacccaccgcuucagagaagaucugaaaaagacagucacaccccagaacuucaccccuggauguuaccggacccucaaucuguuucgcuauaaaagcagaugcuacaucuucacgauguggauuuuucuucuggugcucgagucuauccugugggccgccagcgcuuccgagacaccccugagcccuaccuggaacgacaaugcccacggcguugggucuauucccaugcauacagaucuugaacucgacuucucccugaccagcuccucuaaguacaccuaucggagaaagcugacaaacccgcucgaggaagcucaggccgugagcuuucacgucgagaucgaggaacaaacgauuggaguggaugugcaugcgcugggccacugguucgacgggcgccuuaaucugaaaaccuccuuucacuguuacggcgccugcacaaaguaugaguacccuuggcauaccgcuaaaugucacuaugaacgggauuaccaguaugagacaucuuggggaugcaaccccagcgacugucccggcgucgggaccggaugcacggccugcggccucuaccuggaccagcugaagccuguuggguccgcuuacaaaaucaucacaauuagauauucucgccgggugugugugcaguucggagaagagaaucuuugcaaggucaucgauauggacgauuguuuugugagcagacauguuaaggugugcauuaucggcaccgucuccaaauucagccaaggggacacccuccuguuuuucggcccgcuggagggaggcgggcucauuuuuaagcacugguguacaucuaccugccaguucggagaucccggcgacaucauguccccucgcgauaaaggguuccugugucccgaauuuccuggauccuuccggaagaaaugcaacuuugccacaacgcccgugugugaguacgacggcaauaugguuucuggguauaagaaagugauggcgaccaucgauuccuuccagagcauuaacacaucuaccaugcauuuuacagacgaaagaaucgaguggaaggauccugacggcaugcuucgcgaucacauuaauauccuggucaccaaggacauugacuucgauaaccucggagaaaaucccugcaaaaucggccugcagacguccagcaucgagggggccuggggauccggcgugggguuuacccugacaugucuuauuagccucaccgagugcccgacauuccugaccucuaucaaggcuugcgacaaagccauuuguuacggagcugaaagcguuacacugacccggggccaaaacacggugaaggucuccgggaaaggcggacacucuggcagcacauuuaagugcugucauggggaggauugcucccagucuggacuccacgccgccgcuccucaucuggacaaggugaauggcaucagcgaaauggagaacuccaaaguguaugaugacggggcgccccaguguggaauuaagugcugguucgucaaaucuggcgaauggaucagcggcauuuuuagcgggaacuggaucguucuuaucgugcuguguguguuccuccuguucagccugguccuucucucuauucugugcccugugagaaagcacaaaaaguccuga

SEQ ID NO: 13387 - RNA, 3408 nt, Artificial Sequence
  derived and/or modified CDS sequence (opt5) from HTNV(CGAa75)__EU092224.1__GP
auggagaucuggaaguggcuggugauggccagccucgucuggcccgcucuggcccuuagaaacguucacgacaugaaaauugaaugcccucauaccguguccuucggcaaaaauucugugaucggguacgucgagcugccgcccaugccucucgcggauacaauucagauggugcccgaaagcuccuguucuauggacaaccaccaaagccuguccacgguuaccaaacauacacaggugucuuggcggggaaaggcugaucaggcccagagcucccaaaccagcuuugagacagucucuguggaaguugaccuuaaagggaccugcgugcugaagcacaagcucgucgaggaguccuaucgcagcagaaaaucucugacauguuacgaucuguccugcaauagcaccuauuguaagccuacgcucuacaugaucgugcccauucaugccugcaacaugaugaaaucuuguaucaucgcucuggggccucaccgggugcaggucguuuaugaacgcaccuacugcaugacaggagugcuucuggagggcaaguguuucgugccggaccaguccgucgugagcauuguuagacacgggaucuuugauauugccuccgugcauaucgcuugcuucuuugucgccauuaccggaaauacauauaaacucuucgaacaggugaagaagucuuuuggcaccacguguaacgacacagagaauaaaguucaaggcuacuacaucugcauucugggcggaaacagcccucccaucuaugugcccacccuugaugacuuccgguccauggaggcguuuagcggcaucuucaagucuccucacggggaagaucaugaccuggccggagaggaaauugcuuccuacagcaucgucggccccgccaaugcuaaagugccgcacucugccagcuccgauacacucucucugauugcguuuagcgggaucccuuccuauagcucucuguccauucucaccagcucuaccgaggccaagcacgucuucucccccggacuguuuccucagcuuaaccauacaaaaugcgacaagacggcuaucccccugaccuggacaggcaucauugaccuccccggcuacuaugaagccgugcacccuuguaccguuuucugcgugcugagcgggccgggagcuuccugugaggccuucucugagggcgggaucuuuaauauuacaagccccaugugccuugucuccaaacagaaccgcuucagacugaccgaacagcaagugaauuuuguuugucagcggguggauauggacaucgucguguacugcaacggacagcgcaaggugauucucacgaagacacugguuaucggccaauguaucuauaccauuaccucucuguucagccuccugccuggggucgcccauuccaucgcuguggagcuuugcgugcccggauuucacggcugggcgacagccgcucugcucauuaccuucuguuuuggcuggguccugaucccugcccuuacauucauugugcugacgguucucaaauuuaucgccaauauuuuccauaccagcaaccaggaaaacagacugaagauggugcugaaaaagaucaaagaggaauuugagcggacaaaggggucuauggucugcgauaucuguaaguacgagugcgaaaccaauaaagagcucaaggcucacggaguguccugcccccagagccaguguccguacugcuucacacacugugaaccuaccgagucugccucccaagcgcauuaucgcguuugccaggugacgcacagauuucgggacgaucugaaaaagaccgucacaccccagaacuucaccccuggcuguuaccgcacacuuaaucuguucagauauaaaagccggugcuacauuuuuaccauguggaucugucuccuggugcuggaaucuauucuuugggcugccagcgccuccgagaucccccucagcccuacguggaacgacaaugcucaugggguuggaucuauucccaugcacacagaucuggagcuggacuucucccucaccagcuccucuaaguauacauacagacgcaagcugaccaacccgcuugaagagagccaggccgugaauuuucacgucgaaaucgaggagcaagcuaucggcguggaugugcaugcccuggggcacugguucgacggccggcucaaccugaaaaccuccuuucauugcuauggagcguguacaaaguacgaauacccuuggcacacggccaaaugccauuaugagagagauuaccaguaugaaaccucuuggggcuguaaucccagcgacugccccggggucggaacaggcugcaccgcuugugggcuguaccuugaccagcucaagccuguuggauccgccuauaaaauuaucacaauucgcuacucucggagagugugcgugcaguucggcgaggaaaaccuguguaucgucauugauaugaaugacugcuuugugagccgccacguuaagguguguaucaucgggaccgucuccaaguucagccaaggcgauacgcugcucuuuuucggaccgcuggagggcgggggacuuauucugaaacacuggugcacaucuaccugucaguuuggcgaccccggggauaucauguccccucgggacaagggauuccucugccccgaguuuccuggcagcuucagaaagaaguguaacuucgcuaccacacccgugugcgaauaugggggcaauaugguuucuggauacaaaaaggugauggccaccauugauuccuuucagagcuucaacacaucuacgaugcauuuuaccgacgagcgcaucgaauggaaagauccugacggcaugcugcgggaucacauuaauauccuggucacaaaggacaucgauuucgacaaccuuggggagaaccccuguaagauuggacuccagaccuccagcaucgaaggcgcguggggguccggagugggcuuuacacugaccugccugauuagccucacggagugcccgaccuuccugacaucuaucaaagccugugacaaggcuauuugcuacggggccgagagcguuacccuuacaagaggccaaaauaccgugaaagucuccggaaagggcgggcauucuggaagcacauuuaaauguugccacggcgaagauuguucccagucugggcugcaugcugccgccccucaccucgacaaggugaacggaaucagcgagauugaaaauuccaagguguaugaugacggcgcuccccagugcggcaucaaauguugguucgucaagucuggggaguggaucagcggaaucuuuuccggcaacuggauuguucugauugugcugugcguguuccuucucuuuagccugguccugcucucuauccuguguccugugcgcaaacacaaggaauccuga

SEQ ID NO: 13388 - RNA, 3408 nt, Artificial Sequence
  derived and/or modified CDS sequence (opt5) from HTNV(CGHu2)__EU363819.1__GP
augggcaucuggaaguggcuggugauggccagccucgucuggcccgcuuucgcccugagaaacguuuacgacaugaaaauugagugcccucacaccguguccuuuggggaaaauucugugaucggauaugucgagcuuccgcccaugccucuggcggauacaacgcagauggugcccgaaagcuccuguucuauggacaaccaucaaagccucaauaccauuacaaaguacacccagaucauuuggcggggcaaagcugaucagucccagucuagccaaaacuccuucgagacaguuagcaccgggguggaccugaagggaacaugcguccuuaaacacaagaugaucgaagagucuuaucgcuccagaaagagcaucaccuguuacgaucugucuugcaauuccacguauuguaaaccuacccucuacaugauugugcccauccaugccugcaacaugaugaaguccugucugauugcccugggcccuuaucggguucagguggucuacgagcgcacauacugcaugaccggggugcucaucgaaggaaaauguuuugugccggaccagucugucguuuccauuaucaagcacggcauuuucgauaucgcuagcgugcauaucgugugcuuuuaugucgccgugaaaggcaauacauacaagauuuucgagcagguuaagaaauccuuugaaucuaacuguaaugacaccgagaacaaggugcaaggguauuacaucugcauuaucggaggcaauagcucccccgucuaugugccuacgcuggaugacuucagaagcauggaggcuuuuucugggauuauccggagcccccacggagaagaucacgaccuugccggcgaggaaguugcgagcuacucuaucguggggccugccaacgcuaaagucccccauagcgccuccucugauacacugggacucauugcuuauagcggcaucccguccuacagcucucuguccauucuuaccagcucuacagaggccaagcacguguucuccccuggccuguuuccccagcucaaucauaccaaaugcgacaagaccgcgaucccucugacauggacggggaugauugaccugcccggauacuaugaagccauccaccccuguaccgucaucugcgugcucagcggcccuggggcuuccugugaggcccugucugagggaggcauuuucaacaucacaagcccgaugugccuuguuuccaaacagaaucgcuuuagacugaccgaacagcaagugaacuucgucugucagcggguggauguugacauuaucguguacugcaacgggcagcgcaaggucauucucacaaagacccuggugaucggacaauguauuuauacgaucacaucucuuuucagccugcuccccggcguggcucacuccaucgccguugagcugugcgucccuggcuuucaugggugggccaccgcugcgcugcucgugaccuucuguuuuggaugggugcugauucccgccaucacauucauuauccuuaccauucugaaauuuaucgcuaauaucuuccacacaagcaaccaggaaaauagacucaagucuguccugcggaaaauuaaggaggaauuugagcgcacgaaaggcuccauggugugcgauaucuguaaguacgagugcgaaaccuauaaggagcuuaaagcccaugggguuagcugcccucagucucagugucccuacugcuucacacacugugaaccgaccgaggccgcuuuucaagcccauuauagagugugccaggucacacaccgguuccgcgacgaucugaagaaaaccgugacgccucagaacuuuacccccggauguuacagaacacucaaucuguuccgguacaaguccagaugcuauauuuuuaccauguggaucugucugcucguucuggaaagcauucuuugggcggcuucugccagcgagaucccucugaaccccguguggaaugacaacgcccacggcgucggguccaucccuaugcauacagaucucgagcuggacuucagccugaccucuuccagcaaacacacguaccgccggaaacuuacaaauccccucgaagagucccaggcuauugaucugcauguggaaaucgaggagcaaaccauuggcguugacgugcacgcccugggacacugguucgauggcagacucaaccugaagacaucuuuucauugcuauggggcuuguaccaaguacgaauauccguggcacaccgccaagugccauuacgagcgcgacuaucaguacgaaacaagcuggggauguaauccuuccgacugccccggcgucgggacgggaugcaccgcguguggccuuuaccuggaucagcucaaacccguggggucugccuauaagaucauuacaauccgguacagcagacgcgugugcguccaguucggcgaggaaaaccuguguaaaguuaucgacaugaaugauugcuuugugucccggcacgugaaggucuguauuaucggaaccgugucuaaguucagccaaggcgacacacugcucuuuuucgggccucucgagggaggcgggcugauuuuuaaacauuggugcaccuccacgugucaguucggagauccgggcgacaucaugagccccagagauaagggguuucugugcccugaguuccccggcucuuuucgcaaaaaguguaacuucgcuacaaccccuguuugcggauaugacggcaauaugguguccggguacaaaaaggucauggccaccauugauagcuuucagucuuucaacacauccaccaugcacuucacagacgaacggaucgaguggaaagaucccgacggaaugcucagagaucacauuaacauccuggugacgaaggacaucgacuuugauaaucuuggcgaaaacccuuguaagauugggcugcagaccagcucuaucgagggagcuuggggcuccgggguuggcuucacacuuaccugccugauuagccugacagaaugccccaccuuucuuacguccaucaaagccugugacaaggcgauuugcuauggagccgagagcgugacccucacacgcggccaaaauaccgucaaagugucugggaagggaggccauagcggguccacauucaaauguugccacggagaggauuguucucagagcggccugcaugcugccgcuccgcaccuggacaagguuaacggcaucuccgaaaucgaaaauucuaagguguacgaugacggggccccucagugcggaauuaaauguugguuugucaagagcggcgaguggaucuccgggauuuucucuggaaacuggaucgugcucauugugcugugcgucuuucuucuguucagccucguucugcuguccauccuuugucccgugcggaaacauaagaaaagcuga

SEQ ID NO: 13389 - RNA, 3408 nt, Artificial Sequence
  derived and/or modified CDS sequence (opt5) from HTNV(CGHu3)__EU363818.1__GP
auggagaucuggaaguggcuggugauggccagccucgucuggcccgcucuggcccuuagaaacguucacgacaugaaaauugaaugcccucauaccguguccuucggcaagaauagcgugaucggguacgucgagcugccgcccaugccucucgcggauacaauucagauggugcccgaaagcuccuguucuauggacaaccaccaaagccuguccacggcuaccaaauauacacagguuucuuggcggggaaaggccgaucaggcccagagcucccaaaccagcuuugagacagugucugucgaaguggaccuuaaagggaccugcguucugaagcauaagcucguggaggaguccuaccgcagcagaaaaucucugacauguuaugaucuguccugcaauagcaccuacuguaagccuacgcucuauaugaucguccccauucacgcuugcaacaugaugaaaucuuguaucaucgcccuggggccucaucggguccaggugguguacgaacgcaccuauugcaugacaggaguucuucuggagggcaaguguuucgugccggaccaguccguggucagcauugugagacacgggaucuuugauauugcuuccguucacaucgccugcuucuuuguggcgauuaccggaaauacauacaaacucuucgaacaggucaagaagucuuuuggcaccacguguaacgacacagagaauaaagugcaaggcuacuauaucugcauucugggcggaaacucucccccuaucuacguucccacccuugaugacuuccgguccauggaggccuuuagcggcaucuucaagucuccucauggggaagaucacgaccuggcuggagaggaaauugccuccuauagcaucgugggccccgcuaaugccaaagucccgcauucugcgagcuccgauacacucucucugauugccuuuagcgggaucccuuccuacagcucucuguccauucucaccagcucuaccgaggcuaagcacguguucucccccggacuguuuccucagcuuaaccacacaaaaugcgacaagacggccaucccccugaccuggacaggcaucauugaccuccccggcuauuacgaagcuguccauccuuguaccguguucugcguucugagcgggccgggagccuccugugaggccuucucugagggcgggaucuuuaauauuacaagccccaugugccuuguguccaaacagaaccgcuucagacugaccgaacagcaagucaauuuugugugucagcggguugauauggacaucguggucuauugcaacggacagcgcaaggugauucucacgaagacacuggugaucggccaauguaucuacacccugaccucucucuucagccugcuuccugggguugcucacuccauugcggucgagcugugcgugcccggauuucauggcugggccacagcugcccuccugaucaccuucuguuuuggcugggugcuuauuccugcccugacauucaucguccucacggugcugaaauuuauugcuaauaucuuccacaccagcaaccaggaaaacagacugaagaugguucucaaaaagauuaaagaggaauuugagcggacaaaggggucuauggugugcgauaucuguaaguacgagugcgaaaccuauaaagagcugaaggcccauggagucuccugcccccagagccaguguccguacugcuucacacacugugaaccuaccgagucugcguuucaagcucacuaucgcgugugccagguuacgcauagauuccgggacgaucuuaaaaagaccgugacaccccagaauuucaccccuggcuguuaccgcacacugaaccucuuuagauauaaaucccggugcuacaucuucaccauguggauuugucugcugguccuugaaagcauccucugggccgccucugcuagcgagauuccccuguccccuacguggaaugacaacgcccacggggugggaagcauccccaugcauacagaucuggagcucgacuuuucucugaccuccagcuccaaguauacauacagacgcaaacuuaccaauccgcuggaagagucucaggcuguuaacuuccacguggaaauugaggagcaagccaucggcgucgaugugcacgcgcucgggcauugguuugacggccggcugaaucugaagaccagcuuccacugcuacggagccuguacaaaguaugaauacccuuggcauacggcuaaaugccacuaugagagagauuaccaguaugaaaccuccuggggcuguaaccccucugacugccccggggugggaacaggcugcaccgccugugggcuuuaccucgaccagcugaagccugucggaagcgcuuauaaaaucauuacaauccgcuacucccggagaguuugcgugcaguuuggcgaggaaaaucuguguaaggugauugauaugaacgacugcuucgucucucgccaugugaagguuuguaucauugggaccgugagcaaauuuucccaaggcgauacgcuccuguucuuuggaccgcuugagggcgggggacugaucuucaagcacuggugcacaagcaccugucaguuuggcgaccccggggauaucaugucuccucgggacaaaggauuccucugccccgaguucccuggcuccuuuagaaagaaauguaauuucgccaccacacccgucugcgaauacgaugggaacauggugagcggcuauaagaaaguuauggcgaccauugacucuuuucaguccuucaauacaagcacgaugcacuuuaccgaugagcgcaucgaauggaaggacccugauggaaugcugcgggaccauauuaacauccuggugacaaaggauauugacuucgacaaucuuggcgagaaccccuguaaagucgggcucagaaccucuuccaucgaaggagccuggggcagcggggugggauuuacacugaccugccugaucucccucacggagugcccgaccuuccugacaagcauuaaggcuugugauaaagccaucugcuacggcgcugagucuguuacccuuacacgcgggcagaacaccgugaaggucagcggcaaaggaggccacuccgggucuacauuuaaguguugccauggagaagacuguagccaauccggccugcacgccgccgcuccucaucucgauaaggugaaugggauuucugagaucgaaaacagcaaaguguaugacgauggagcgccccagugcggcauuaaguguugguucgucaaauccggcgaguggaucucugggauuuuuagcggaaauuggaucguucugaucgugcugugcguguuccuucucuucucccugguccugcucagcauucuguguccugugcggaagcacaaaaagucuuga

SEQ ID NO: 13390 - RNA, 3408 nt, Artificial Sequence
  derived and/or modified CDS sequence (opt5) from HTNV(CGHu3612)__EF990923.1__GP
augggcaucuggaaguggcuggugauggccagccucgucuggcccgcuuucgcccugagaaaccuuuacgacaugaaaauugagugcccucacaccguuuccuuuggggaaaauucugugacaggauauguggagcugccgcccaugccucucgcggauacgacccagaugguccccgaaagcuccuguucuauggacaaccaucaaagccugaauacaaucaccaaguacacacagauuaucuggcggggcaaagcugaucagucccagucuagccaaaacuccuucgagaccgugagcacagaaguugaccuuaaggggaccugcgugcugaaacacaagaugauugaggagucuuaucgcuccagaaagagcaucacguguuacgaucucucuugcaauuccaccuauuguaaaccuacacuguacaugaucguccccauucaugccugcaacaugaugaaaagcugucugaucgcccucggaccuuaucgggugcagguuguguacgaacgcaccuacugcaugacaggcguccugauugaggggaaguguuuugugccggaccagucuguggucuccaucauuaagcacggaaucuucgauauugcuagcguucauaucgugugcuuuaucguggccgucaaaggcaauaccuauaagauuuucgaacaggugaagaaaacguuugaguccaacuguaaugacacagagaacaagguucaaggcuacuauaucugcauuaucgggggaaauucuagccccguguacgucccuacccuugaugacuucagauccauggaagccuuuagcggcauuauccggucuccccacggggaggaucacgaccuggccggagaagagguggcguccuauagcaucguuggcccugccaacgcuaaagugccccauucugccagcuccgauacacucgggcugauugcuuacucuagcaucccguccuauagcucucuuuccauucugaccagcucuaccgaagccaagcacgucuucuccccuggacucuuucgccagcugaaucauacaaaaugcgacaagacggcgaucccccugaccuggacaggcaugauugaccucccuggcuacuacgaggccauccaccccuguaccguguucugcguccugagcgggcccggagcuuccugugaggccuuuucugaaggcgggaucuucaacauugcuagcccuaugugccuuguguccaaacagaauagauuccggcugacagagcagcaaguuaacuuugugugucagcgcgucgauguggacaucauuguuuauugcaacggacagagaaaggugauccucaccaagacgcuggucauuggccaauguaucuacacaauuaccucucuuuucagccugcucccggggguggcccacuccaucgccguggaacugugcguucccggauuucauggcugggcuaccgcggcccugcucgucacauucuguuuuggcugggugcugaucccugcuauuaccuucaucauucuuacaauccugaaauuuauugccaauaucuuccacacgagcaaccaggagaaucggcucaagucugugcugcgcaaaaucaaggaagaguuugagagaaccaaaggguccauggucugcgauauuuguaaguaugaaugcgagacauacaaggaacuuaaagcccauggagugagcugcccccagucucaguguccuuauugcuucacccacugugagcccacagaagcugccuuucaagcgcauuacaagguuugccaggugacccaccgguuccgcgacgaucugaaaaagacggucaccccgcagaacuuuacaccuggcuguuauagaacccucaaucuguuccgguacaaauccagaugcuacaucuucacaauguggguguuucugcucguucuggagagcauucuuugggcugccucugccagcgagaucccccugaacccuguguggaaugacaacgcucacggggucggauccauucccaugcauaccgaucucgaacuggacuucagccugacgucuuccagcaaguauacauaccgccggaaacuuaccaauccucucgaggaaucccaggccaucgaucugcacguggagaucgaggaacaaacaauuggcguugacgugcaugcucuggggcacugguuugauggcagacucaaccugaagaccucuuuccacuguuauggagccugcaccaaguacgaguaucccuggcauacagcgaaaugucacuacgaacgcgacuaucaguacgagacgagcuggggcugcaauccguccgacuguccuggggucggaaccggcugcacagccugcgggcuuuaccuggaucagcucaagcccgugggaucugcuuauaaaaucauuaccauccgguacagcagacgcguguguguccaguuuggcgaagagaaccugugcaagauuaucgacaugaaugauuguuucguuucccggcaugugaaggugugcaucauugggacagucucuaaauuuagccaaggcgacacccugcuuuucuuuggaccccucgagggcgggggacugaucuucaagcacugguguacguccacaugccaguuuggcgauccuggggacauuaugagcccgagagauaaaggauuccugugucccgaauuuccuggcucuuuccgcaagaaaugcaacuucgccaccacccccgugugugaguaugacgggaauaugguuuccggcuacaagaaagugauggcuacaaucgauagcauucagucuuuuaacaccuccacaaugcauuucacggacgaacggaucgaguggaaggauccugacggaaugcucagagaucacauuaacauccuggucaccaaggacaucgacuuugauaaucuuggcgaaaaccccugcaaaauugggcugcagacaagcucuaucgagggagccuggggcuccggggugggauucacccucacaugucugauuagccugaccgagugcuccacguuucuuaccagcaucaaggcgugcgacaaagccauuuguuauggcgcugaaucuguuacacucacccgcgggcaaaauacagugaaggucagcggcaaaggaggccacuccgggucuagcuucaagugcugucauggagaggaaugcucccagaucggccugcacgccgcugccccucaucuggauaaggugaacgggaucucugagauggaaaauagcaaaguuuuugacgauggagcuccccaguguggcauuaagugcugguucgugaaauccggcgaguggaucucugggauuuuuagcggaaacuggaucguccucauugugcuguguguguuccuucuguuuucccucguccugcugagcauccuuugcccgguucggaagcacaaaaagucuuga

SEQ ID NO: 13391 - RNA, 3408 nt, Artificial Sequence
  derived and/or modified CDS sequence (opt5) from HTNV(CGHu3614)__EF990922.1__GP
augggcaucuggaaguggcuggugauggccagccucgucuggcccgcuuucgcccugagaaaccuuuacgacaugaaaauugagugcccucacaccguuuccuuuggggaaaauucugugacaggauauguggagcugccgcccaugccucucgcggauacgacccagaugguccccgaaagcuccuguucuauggacaaccaucaaagccugaauacaaucaccaaguacacacagauuaucuggcggggcaaagcugaucagucccagucuagccaaaacuccuucgagaccgugagcacagaaguugaccuuaaggggaccugcgugcugaaacacaagaugauugaggagucuuaucgcuccagaaagagcaucacguguuacgaucucucuugcaauuccaccuauuguaaaccuacacuguacaugaucguccccauucaugccugcaacaugaugaaaagcugucugaucgcccucggaccuuaucgggugcagguuguguacgaacgcaccuacugcaugacaggcguccugauugaggggaaguguuuugugccggaccagucuguggucuccaucauuaagcacggaaucuucgauauugcuagcguucauaucgugugcuuuuucguggccgucaaaggcaauaccuauaagaucuuugaacaggugaagaaaacguucgaguccaacuguaaugacacagagaacaagguucaaggcuacuauauuugcaucauugggggaaauucuagccccguguacgucccuacccuugaugacuuuagauccauggaagccuucagcggcaucuuucggucuccccacggggaggaucacgaccuggccggagaagagguggcguccuauagcauuguuggcccugccaacgcuaaagugccccauucugccagcuccgauacacucgggcugaucgcuuacucuagcaucccguccuauagcucucuuuccauucugaccagcucuaccgaagccaagcacgucuucuccccuggacucuuuccccagcugaaucauacaaaaugcgacaagacggcgaucccucugaccuggacaggcaugauugaccuccccggcuacuacgaggccauccaccccuguaccguguucugcguccugagcgggccuggagcuuccugugaggccuucucugaaggcgggauuuuuaacaucgcuagcccgaugugccuuguguccaaacagaaucgcuucagacugacagagcagcaaguuaacuuugugugucagcgggucgauguggacaucauuguuuauugcaacggacagcgcaaggugauccucaccaagacgcuggucauuggccaauguaucuacacaauuaccucucuuuucagccugcuccccgggguggcccacuccaucgccguggaacugugcguuccuggauuucauggcugggcuaccgcggcccugcucgucacauucuguuuuggcugggugcugauucccgcuaucaccuucaucauucuuacaauccugaaauuuauugccaauaucuuccacacgagcaaccaggagaauagacucaagucugugcugcggaaaauuaaggaagaguuugagcgcaccaaaggguccauggucugcgauaucuguaaguaugaaugcgagacauacaaggaacuuaaagcccauggagugagcugcccucagucucagugucccuauugcuucacccacugugagccgacagaagcugccuuucaagcgcauuacaagguuugccaggugacccacagauuccgggacgaucugaaaaagacggucaccccucagaacuucacacccggcuguuaucgcacccucaaucuguuuagauacaaaucccggugcuacaucuucacaauguggguguuucugcucguucuggagagcauucuuugggcugccucugccagcgagaucccucugaaccccguguggaaugacaacgcucacggggucggauccauuccuaugcauaccgaucucgaacuggacuucagccugacgucuuccagcaaguauacauacagacgcaaacuuaccaauccccucgaggaaucccaggccaucgaucugcacguggagauugaggaacaaacaaucggcguugacgugcaugcucuggggcacugguuugauggccggcucaaccugaagaccucuuuccacuguuauggagccugcaccaaguacgaguauccguggcauacagcgaaaugucacuacgaaagagacuaucaguacgagacgagcuggggcugcaauccuuccgacugucccggggucggaaccggcugcacagccugcgggcuuuaccuggaucagcucaagcccgugggaucugcuuauaaaaucauuaccauccgcuacagccggagaguguguguccaguuuggcgaagagaaccugugcaagauuaucgacaugaaugauuguuucguuucccgccaugugaaggugugcauuaucgggacagucucuaaauuuagccaaggcgacacccugcuuuucuuuggaccucucgagggcgggggacugaucuucaagcacugguguacguccacaugccaguuuggcgauccgggggacauuaugagcccccgggauaaaggauuccuguguccugaguuccccggcucuuuuagaaagaaaugcaacuucgccaccaccccugugugugaauaugacgggaauaugguuuccggcuacaagaaagugauggcuacaaucgauagcuuucagucuuucaacaccuccacaaugcauuuuacggacgaacgcauugaguggaaggaucccgacggaaugcuccgggaucacaucaacauucuggucaccaaggacaucgacuucgauaaucuuggcgaaaacccuugcaaaauugggcugcagacaagcucuaucgagggagccuggggcuccggggugggauuuacccucacaugucugaucagccugaccgagugcuccacguuccuuaccagcauuaaggcgugcgacaaagccaucuguuauggcgcugaaucuguuacacucaccagagggcaaaauacagugaaggucagcggcaaaggaggccacuccgggucuagcuuuaagugcugucauggagaggaaugcucccagauuggccugcacgccgcugcuccccaucuggauaaggugaacgggaucucugagauggaaaauagcaaaguuuucgacgauggagccccgcaguguggcauuaagugcugguuugugaaauccggcgaguggaucucugggaucuucagcggaaacuggauuguccucaucgugcuguguguguuccuucuguuuucccucguccugcugagcauucuuugcccuguucgcaagcacaaaaagucuuga

SEQ ID NO: 13392 - RNA, 3408 nt, Artificial Sequence
  derived and/or modified CDS sequence (opt5) from HTNV(CGRn15)__EU363814.1__GP
auggagaucuggaaguggcuggugauggccagccucgucuggcccgcucuggcccuuagaaacguucacgacaugaaaauugaaugcccucauaccguguccuucggcaaaaauucugugaucggguacgucgagcugccgcccaugccucucgcggauacaauucagauggugcccgaaagcuccuguucuauggacaaccaccaaagccuguccacgguuaccaaguauacacaggugucuuggcggggaaaggcugaucaggcccagagcucccaaaccagcucugagacagucuccguggaaguugaccuuaaagggaccugcgugcugaagcauaagcucgucgaggagagcuaccgcucuagaaaaucccugacauguuaugaucugagcugcaauucuaccuacuguaagccuacgcucuauaugaucgugcccauucacgccugcaacaugaugaaauccuguaucaucgcucugggcccucaucgggugcaggucguuuacgaacgcaccuauugcaugacaggagugcuucuggagggcaaguguuuugugccggaccagagcgucguguccauuguuagacacgggaucuucgauauugccucugugcacaucgcuugcuuuuucgucgccauuaccggaaauacauacaaacucuuugaacaggugaaaaagagcuucggcaccacguguaacgacacagagaauaagguucaaggcuacuauaucugcauucuugggggaaacuccccucccaucuacgugcccacccuugaugacuuucggagcauggaggcguucucuggcaucuuuaaguccccucauggggaagaucacgaccuggccggagaggaaauugcuagcuauucuaucgucggccccgccaaugcuaaagugccgcauagcgccuccucugauacacucagccugauugcguucuccgggaucccuagcuacucuucccugagcauucucaccucuuccaccgaggccaagcacgucuuuagccccggacuguucccucagcuuaaccacacaaaaugcgacaagacggcuaucccccugaccuggacaggcaucauugaccuccccggcuauuacgaagccgugcauccuuguaccguuuucugcgugcuguccgggccgggagcuucuugugaggccuucagcgagggcgggaucuucaauauuacaucccccaugugccuugucucuaaacagaaccgcuuuagacugaccgaacagcaagugaauuucguuugucagcggguggauauggacaucgucguguauugcaacggacagcgcaaggugauucucacgaagacacugguuaucggccaauguaucuacaccauuaccagccuguuuucccuccugccuggggucgcccacagcaucgcuguggagcuuugcgugcccggauuccauggcugggcgacagccgcucugcucauuaccuuuuguuucggcuggguccugaucccugcccuuacauuuauugugcugacgguucucaaauucaucgccaauauuuuucacaccucuaaccaggaaaacagacugaagauggugcugaaaaagaucaaagaggaauuugagcggacaaagggguccauggucugcgauaucuguaaguacgagugcgaaaccuauaaagagcucaaggcucauggagugagcugcccccagucucaguguccguacugcuuuacacacugugaaccuaccgaguccgccuuccaagcgcacuaucgcguuugccaggugacgcauagauuucgggacgaucugaaaaagaccgucacaccccagaauuucaccccuggcuguuaccgcacacuuaaccuguucagauauaaaagccggugcuacauuuuuaccauguggaucugucuccuggugcuggaaucuauucuuugggcugccagcgccuccgagaucccccucagcccuacguggaaugacaacgcucacgggguuggaucuauucccaugcauacagaucuggagcuggacuucucccucaccagcuccucuaaguauacauacagacgcaagcugaccaauccgcuugaagagagccaggccgugaacuuucacgucgaaaucgaggagcaagcuaucggcguggaugugcacgcccuggggcauugguucgacggccggcucaaucugaaaaccuccuuucacugcuacggagcguguacaaaguaugaauacccuuggcauacggccaaaugccacuaugagagagauuaccaguaugaaaccucuuggggcagcaaccccuccgacugucccggggucggaacaggcugcaccgcuugcgggcuguaccuugaccagcucaagccuguuggaucugccuauaaaauuaucacaauucgcuacagccggagagugugugugcaguucggcgaggaaaaucugugcaaggucaucgauaugaacgacuguuuugugucccgccauguuaaggugugcauuaucgggaccgucagcaaauucucucaaggcgauacgcugcucuuuuucggaccgcuggagggcgggggacuuaucuuuaagcacugguguacauccacaugccaguucggcgaccccggggauauuaugagcccucgggacaaaggauuucugugucccgaguucccuggcucuuucagaaagaaaugcaauuuugcuaccacccccgugugugaauacgaugggaacaugguuuccggcuauaagaaagugauggccaccaucgacagcuuccagucuuccaauacaagcacgaugcacuuuaccgaugagcgcauugaauggaaggacccugauggaaugcuccgggaccauaucaacauucuggucacaaaggauaucgacuucgacaaucugggcgagaaccccugcaaaaucgggcuucagaccuccagcauugaaggagcguggggcucuggggugggauuuacacucaccugucugaucagccugacggagugcccgaccuuccucacauccauuaaggccugcgauaaagcuaucuguuacggcgccgagucuguuacccugacaagagggcaaaacaccgugaaggucagcggcaaaggaggccacuccgggucuacauuuaagugcugucauggagaagacugcagccaguccggccuucacgcugccgccccucaucuggauaaggugaaugggauuucugagaucgaaaacagcaaaguguaugacgauggagcuccccaguguggcgucaagugcugguucguuaaauccggcgaguggauuagcgggaucuuuucuggaaauuggaucgugcucauugugcugugugucuuccugcuguuuucccucgugcugcugagcauccucugcccuguucgcaagcacaaaaagucuuga

SEQ ID NO: 13393 - RNA, 3408 nt, Artificial Sequence
  derived and/or modified CDS sequence (opt5) from HTNV(CGRn2616)__EU363816.1__GP
auggagaucuggaaguggcuggugauggccagccucgucuggcccgcucuggcccuuagaaacguucacgacaugaaaauugaaugcccucauaccguguccuucggcaaaaauucugugaucggguacgucgagcugccgcccaugccucucgcggauacaauucagauggugcccgaaagcuccuguucuauggacaaccaccaaagccuguccacgguuaccaaacauacacaggugucuuggcggggaaaggcugaucaggcccagagcucccaaaccagcuuugagacagucucuguggaaguugaccuuaaagggaccugcgugcugaagcacaagcucgucgaggaguccuaucgcagcagaaaaucucugacauguuacgaucuguccugcaauagcaccuauuguaagccuacgcucuacaugaucgugcccauucaugccugcaacaugaugaaaucuuguaucaucgcucuggggccucaccgggugcaggucguuuaugaacgcaccuacugcaugacaggagugcuucuggagggcaaguguuucgugccggaccaguccgucgugagcauuguuagacacgggaucuuugauauugccuccgugcauaucgcuugcuucuuugucgccauuaccggaaauacauauaaacucuucgaacaggugaagaagucuuuuggcaccacguguaacgacacagagaauaaaguucaaggcuacuacaucugcauucugggcggaaacagcccucccaucuaugugcccacccuugaugacuuccgguccauggaggcguuuagcggcaucuucaagucuccucacggggaagaucaugaccuggccggagaggaaauugcuuccuacagcaucgucggccccgccaaugcuaaagugccgcacucugccagcuccgauacacucucucugauugcguuuagcgggaucccuuccuauagcucucuguccauucucaccagcucuaccgaggccaagcacgucuucucccccggacuguuuccucagcuuaaccauacaaaaugcgacaagacggcuaucccccugaccuggacaggcaucauugaccuccccggcuacuaugaagccgugcacccuuguaccguuuucugcgugcugagcgggccgggagcuuccugugaggccuucucugagggcgggaucuuuaauauuacaagccccaugugccuugucuccaaacagaaccgcuucagacugaccgaacagcaagugaauuuuguuugucagcggguggauauggacaucgucguguacugcaacggacagcgcaaggugauucucacgaagacacugguuaucggccaauguaucuauaccauuaccucucuguucagccuccugccuggggucgcccauuccaucgcuguggagcuuugcgugcccggauuucacggcugggcgacagccgcucugcucauuaccuucuguuuuggcuggguccugaucccugcccuuacauucauugugcugacgguucucaaauuuaucgccaauauuuuccauaccagcaaccaggaaaacagacugaagauggugcugaaaaagaucaaagaggaauuugagcggacaaaggggucuauggucugcgauaucuguaaguacgagugcgaaaccaauaaagagcucaaggcucacggaguguccugcccccagagccaguguccguacugcuucacacacugugaaccuaccgagucugccuuucaagcgcauuaucgcguuugccaggugacgcacagauuccgggacgaucugaaaaagaccgucacaccccagaacuucaccccuggcuguuaccgcacacuuaaucuguuuagauauaaaucccggugcuacauuuucaccauguggaucugucuccuggugcuggaaagcauucuuugggcugccucugccagcgagaucccccucuccccuacguggaacgacaaugcucaugggguuggaagcauucccaugcacacagaucuggagcuggacuuuucucucaccuccagcuccaaguauacauacagacgcaagcugaccaacccgcuugaagagucucaggccgugaauuuccacgucgaaaucgaggagcaagcuaucggcguggaugugcaugcccuggggcacugguuugacggccggcucaaccugaaaaccagcuuccauugcuauggagcguguacaaaguacgaauacccuuggcacacggccaaaugccauuaugagagagauuaccaguaugaaaccuccuggggcuguaaucccucugacugccccggggucggaacaggcugcaccgcuugugggcuguaccuugaccagcucaagccuguuggaagcgccuauaaaauuaucacaauucgcuacucccggagagugugcgugcaguuuggcgaggaaaaccuguguaucgucauugauaugaaugacugcuucgugucucgccacguuaagguguguaucaucgggaccgucagcaaguuuucccaaggcgauacgcuccucuucuuuggaccgcuggagggcgggggacuuauuuucaaacacuggugcacaagcaccugucaguuuggcgaccccggggauaucaugucuccucgggacaagggauuccugugccccgaguucccuggcuccuuuagaaagaaguguaacuucgcuaccacacccgugugcgaauaugggggcaauaugguuagcggauacaaaaaggugauggccaccauugauucuuuucaguccuucaacacaagcacgaugcauuuuaccgacgagcgcaucgaauggaaagauccugacggcaugcuccgggaucacauuaauauccuggucacaaaggacaucgauuucgacaaccugggggagaaccccuguaagauuggacuucagaccucuuccaucgaaggcgcgugggggagcggagugggcuuuacacugaccugccugauuucccugacggagugcccgaccuuccucacaagcaucaaagccugugacaaggcuauuugcuacggggccgagucuguuacccugacaagaggccaaaauaccgugaaagucagcggaaagggcgggcauuccggaucuacauuuaaauguugccacggcgaagauuguagccaguccgggcuucaugcugccgccccucaccuggacaaggugaacggaaucucugagauugaaaauagcaagguguaugaugacggcgcuccccagugcggcaucaaauguugguucgucaaguccggggaguggaucucuggaauuuuuagcggcaacuggaucguucucauugugcugugcguguuccugcuuuucucccucguccugcugagcauccucuguccugugcgcaaacacaagaaaucuuga

SEQ ID NO: 13394 - RNA, 3408 nt, Artificial Sequence
  derived and/or modified CDS sequence (opt5) from HTNV(CGRn2618)__EU363817.1__GP
auggagaucuggaaguggcuggugauggccagccucgucuggcccgcucuggcccuuagaaacguucacgacaugaaaauugaaugcccucauaccguguccuucggcaaaaauucugugaucggguacgucgagcugccgcccaugccucucgcggauacaauucagauggugcccgaaagcuccuguucuauggacaaccaccaaagccuguccacgguuaccaaguauacacaggugucuuggcggggaaaggcugaucaggcccagagcucccaaaccccuuuugagacagucagcguggaaguugaccuuaaaagaaccugcgugcugaagcauaagcucgucgaggagucuuaccgcucccggaaaagccugacauguuaugaucugucuugcaauuccaccuacuguaagcccacgcucuauaugaucgugccuauucacgccugcaacaugaugaaaagcuguaucaucgcucugggcccgcaucgcgugcaggucguuuacgaaagaaccuauugcaugacaggggugcuucuggagggaaaguguuucgugcccgaccagucugucguguccauuguucggcacggcaucuuugauauugccagcgugcacaucgcuugcuucuuugucgccauuaccgggaauacauacaaacucuucgaacaggugaagaaguccuuuggaaccacguguaacgacacagagaauaaaguucaaggcuacuauaucugcauucugggcgggaacucuccucccaucuacgugccuacccuugaugacuuccgcagcauggaggcguuuuccggaaucuucaagagcccccauggcgaagaucacgaccuggccggggaggaaauugcuucuuauuccaucgucggaccggccaaugcuaaagugccucauagcgccucuagcgauacacucucccugauugcguuuucuggcauccccagcuacuccagccugucuauucucaccuccagcaccgaggccaagcacgucuucucuccugggcuguuuccccagcuuaaccacacaaaaugcgacaagacggcuaucccccugaccuggacaggaaucauugaccucccuggcuauuacgaagccgugcauccguguaccguuuucugcgugcuguccggccccggggcuagcugugaggccuucuccgagggaggcaucuuuaauauuacaucuccuaugugccuugucagcaaacagaacagauuccggcugaccgaacagcaagugaauuuuguuugucagcgcguggauauggacaucgucguguauugcaacgggcagagaaaggugauucucacgaagacacugguuaucggacaauguaucuacaccauuaccucccuguucucucuccugcccggcgucgcccacagcaucgcuguggagcuuugcgugccuggguuucauggaugggcgacagccgcucugcucauuaccuucuguuuuggcuggguccugauccccgcccuuacauucauugugcugacgguucucaaauuuaucgccaauauuuuccacaccuccaaccaggaaaaccggcugaagauggugcugaaaaagaucaaagaggaauuugagcgcacaaagggcagcauggucugcgauaucuguaaguacgagugcgaaaccuauaaagagcucaaggcucauggggugucuugcccgcagucccaguguccuuacugcuucacacacugugaacccaccgagagcgccuuucaagcgcacuauagaguuugccaggugacgcaucgguuccgcgacgaucugaaaaagaccgucacaccucagaauuucacccccggauguuacagaacacuuaaccuguuucgguauaaaucuagaugcuacauucucaccauguggaaucugcugcuuaucccuggcuaucgccucugggcugccuccgccagcgaaauuccccugucuccgacguggaacgacaaugcucacggggugggaagcaucccuaugcauacagaucuggagcucgacuucucccugaccagcagcuccaaguacacauaccggagaaaacuuaccaacccccuggaggaaagccaggccguuaauuuucacguggagauugaggagcaagcuaucggcgucgaugugcacgcccucgggcauugguucgacggccgccugaaccugaagaccuccuuucacuguuauggagcgugcacaaaguacgaguaucccuggcauacggccaaaugucacuacgaacgggauuaucaguacgagaccucuuggggcugcaauccuagcgacuguccgggggugggaacaggcugcaccgcuugcgggcuuuaucucgaccagcugaagcccgucggauccgccuacaaaaucauuacaaucagauacucucgccggguuugugugcaguucggcgaagagaaccugugcauugugaucgauaugaaugacuguuuugucagcagacaugugaagguuugcauuaucgggaccguguccaaguucucucaaggcgauacgcuccuguuuuucggaccucuugaaggcgggggacugaucuuuaaacacugguguacaucuaccugccaguucggcgaccccggggauauuauguccccucgcgacaagggauuucucugucccgaguucccuggcagcuuccggaaaaagugcaacuuugcuaccacacccgucugugaguaugggggcaauauggugucuggauacaaaaagguuauggccaccaucgauuccuuccagagcuuuaacacaucuacgaugcacuucaccgacgaaagaauugaguggaaagauccggacggcaugcugcgcgaucauaucaauauucuggugacaaaggacaucgauuuugacaaccuuggggaaaacccuugcaagaucggacuccagaccuccagcauugagggcgcgugggggucuggagucggcuucacacugaccugucugaucucccucacggaaugccccaccuuucugacaagcauuaaagccugcgacaaggcuaucuguuauggggccgaguccgugacccuuacacggggccaaaauaccguuaaagugagcggaaagggcgggcacucuggaagcacauucaaaugcugucauggcgaggauugcucccagucugggcugcacgcugccgccccucaucucgacaaggucaacggaauuagcgaaaucgaaaauuccaagguguacgaugacggcgcuccccaguguggcauuaaaugcugguuugugaagucuggggaauggaucagcggaaucuucuccggcaacuggauuguccugaucguucuguguguguuucuucucuucucucuggugcugcucagcauucugugcccggucagaaaacacaagaaauccuga

SEQ ID NO: 13395 - RNA, 3408 nt, Artificial Sequence
  derived and/or modified CDS sequence (opt5) from HTNV(CGRn45)__EU092225.1__GP
auggagaucuggaaguggcuggugauggccagccucgucuggcccgcucuggcccuuagaaacguucacgacaugaaaauugaaugcccucauaccguguccuucggcaagaauagcgugaucggguacgucgagcugccgcccaugccucucgcggauacaauucagauggugcccgaaagcuccuguucuauggacaaccaccaaagccuguccacgguuaccaaauauacacaggugucuuggcggggaaaggcugaucaggcccagagcucccaaaccagcuuugaggccgucucuguggaaguugaccuuaaaggcacaugcgugcugaagcauaagcucgucgaggaguccuaccgcagcagaaaaucucugaccuguuaugaucuguccugcaauagcacauacuguaagccuacccucuauaugaucgugcccauucacgcuugcaacaugaugaaaucuuguaucaucgcccuggggccucaucgggugcaggucguuuacgaacgcacguauugcaugaccggagugcuucuggagggcaaguguuucgugccggaccaguccgucgugagcauuguuagacacgggaucuuugauauugcuuccgugcacaucgccugcuucuuugucgcgauuacaggaaauaccuacaaacucuucgaacaggugaagaagucuuuuggcacaaccuguaacgacacggagaauaaaguucaaggcuacuauaucugcauucucgggggaaacucucccccuaucuacgugcccacacuugaugacuuccgguccauggaggccuuuagcggcaucuucaagucuccucauggggaagaucacgaccuggcuggagaggaaauugccuccuauagcaucgucggccccgcuaaugccaaagugccgcauucugcgagcuccgauacccucucucugauugccuuuagcgggaucccuuccuacagcucucuguccauucucacaagcucuaccgaggcuaagcacgucuucucccccggacuguuuccucagcuuaaccacaccaaaugcgacaagacagccaucccccugacguggaccggcaucauugaccuccccggcuauuacgaagcugugcauccuuguacaguuuucugcgugcugagcgggccgggagccuccugugaggccuucucugagggcgggaucuuuaauauuaccagccccaugugccuugucuccaaacagaaccgcuucagacugacagaacagcaagugaauuuuguuugucagcggguggauauggacaucgucguguauugcaacggacagcgcaaggugauucucaccaagacgcugguuaucggccaauguaucuacacaauuaccucucuguucagccuccugccuggggucgcucacuccaucgcgguggagcuuugcgugcccggauuucauggcugggccaccgcugcccugcucauuacauucuguuuuggcuggguccugaucccugcccuuaccuucauugugcugacaguucucaaauuuaucgcuaauauuuuccacacgagcaaccaggaaaacagacugaagauggugcugaaaaagaucaaagaggaauuugagcggaccaaggggucuauggucugcgauaucuguaaguacgagugcgaaacauauaaagagcucaaggcccauggaguguccugcccccagagccaguguccguacugcuucacccacugugaaccuacagagucugcguuucaagcucacuaucgcguuugccaggugacccauagauuccgggacgaucugaaaaagacggucacaccccagaauuucaccccuggcuguuaccgcacccuuaaccuguuuagauauaaaucccggugcuacauuuucacaauguggaucugucuccuggugcuggaaagcauucuuugggccgccucugcuagcgagaucccccucuccccuaccuggaaugacaacgcccacgggguuggaagcauucccaugcauacggaucuggagcuggacuuuucucucacauccagcuccaaguauaccuacagacgcaagcugacaaauccgcuugaagagucucaggcugugaacuuccacgucgaaaucgaggagcaagccaucggcguggaugugcacgcgcuggggcauugguuugacggccggcucaaucugaaaaccagcuuccacugcuacggagccuguaccaaguaugaauacccuuggcauacagcuaaaugccacuaugagagagaucaucaguacgaaacguccuggggcuguaaccccucugacugccccggggucggaaccggcugcacagccugugggcuguaucuugaccagcucaagccuguuggaagcgcuuacaaaauuaucaccauucgcuauucccggagagugugcgugcaguuuggcgaggaaaaucuguguaaggucaucgaucgcaacgacugcuucgugucucggcacguuaagguguguauuaucgggacagucagcaaauuuucccaaggcgauacccugcuguucuuuggaccgcuggagggcgggggacuuaucuucaagcacuggugcacgagcacaugucaguuuggcgaccccggggauauuaugucuccuagagacaaaggauuccugugccccgaguucccuggcuccuuucgcaagaaauguaauuucgccaccacccccgugugcgaauacgaugggaacaugguuagcggcuacaagaaagugauggcgacaaucgacucuuuucaguccuucaauaccagcacaaugcauuuuacggaugagcggauugaauggaaggacccugauggaaugcucagagaccacaucaacauucuggucaccaaggauaucgacuucgacaaucugggcgagaaccccuguaaaaucgggcuucagacaucuuccauugaaggagccuggggcagcggggugggauuuacccucacaugccugaucucccugaccgagugcccgacguuccucaccagcauuaaggcuugugauaaagccaucugcuauggcgcugagucuguuacacugacccgcgggcaaaacacagugaaggucagcggcaaaggaggccauuccgggucuaccuuuaaguguugccacggagaagacuguagccaguccggccuucaugccgccgcuccucaccuggauaaggugaaugggauuucugagaucgaaaacagcaaaguguacgacgauggagcgccccagugcggcauuaaguguugguucgucaaauccggcgaguggaucucugggaucuuuagcggaaauuggauuguucucaucgugcugugcguguuccugcuuuucucccucguccugcugagcauucucuguccugugcggaagcacaaaaagucuuga

SEQ ID NO: 13396 - RNA, 3408 nt, Artificial Sequence
  derived and/or modified CDS sequence (opt5) from HTNV(CGRn53)__EF990921.1__GP
augggcaucuggaaguggcuggugauggccagccucgucuggcccgcuuacacccugagaaacguuuaugacaugaaaauugagugcccucacacaguguccuucggggaaaauucugugaucggauacgucgagcuuccgcccauuccucuggccgauacgacccagauggugcccgaaagcuccuguucuauggacaaccaucaaagccucaauacaaucaccaaguauacacagguuuccuggcggggcaaagcggggcaggcucaggccucucaaaacagcuuugaggccguguccgcugaagucgaucugaagggaaccugcgugcuuaaacacaagaugcuggaggagagcuaccgcucuagaaaguccauugccuguuaugaccucagcugcaauucuacauacuguaaaccuacccuguauaugaucguucccauccaugcuugcaacaugaugaaguccugucugauugcccucggcccucaccgggugcaggucguguacgaacgcacguacugcaugaccggggugcugaucgagggaaaauguuucgucccggaucagagcguugugucuauuaucaagcauggcauuuuugacaucgcguccgugcacauugucugcuucuuuguggccguuaaaggcaauacauauaagaucuucgaacagaucaagaaauccuuugagagcaccuguaacgauacaaagaauaaagugcaaggguacuauauuugcaucgucggaggcaacucugcucccauuuacgugccuacccuugacgauuucagaagcauggaggccuuuuccgggaucuuccggagcccccacggagaagaccaugaucuggcuggcgaggaaauugccucuuauuccaucguugggccugcgaaugccaaggugccccacagcgcuucuagcgacacgcucucccugacagccuacucuggaaucccgagcuauuccagccuuucuauucuggcuggcuccgccgaggccaaacaugucuuuagcccuggcuucuuuccccagcucaaccacaccaagugcgauaaaacagcuaucccucugauguggaccgggaugauugaccugcccggauacuacgaagcgauccaccccuguaccguguucugcguccucucuggcccuggggccuccugugaggcuuucagcgagggaggcauuuuuaauaucacauccccgaugugccuggugucuaagcagaaccgcuucagacuuacggaacagcaaguuaauuuugugugucagcgggucgacauggauaucauuguguauugcaacgggcagcgcaagguuauccugaccaaaacacucgugauuggacaauguaucuacaccauuacaagccuguucucccuucugcccggcgucgcccauucuaucgccguggagcucugcgugccuggcuuucacgggugggcuaccgccgcgcugcugguuacguucuguuuuggauggguccucauucccgcuaugacauucaucgugcugaccauccuuaaguuuauugccaacaucuuccauaccagcaaucaggaaaacaaacugaaguccgugcucagaaaaauuaaggaggaauuugagaagacaaaaggcagcauggucugcgacguguguaaguaugagugcgaaaccuacaaagagcugaaggcccacgggguuucuugcccucagucccagugucccuauugcuucacacauugugaaccgacggaggcugccuuucaagcucacuaccgggugugccaggucacccaccgcuucagagaugaccuuaaaaagacagugaccccucagaauuucacacccggauguuaucggacccugaaccucuuucgcuacaagagcagaugcuacauccugacgauguggaaucugcuccugguuccuggcuaucgggccugggcggccucugcuuccgaaauuccccuuaacccuguguggaaugauaacgcccauggggucggcagcgugcccaugcacaccgaccuggagcucgauuucucucugacaagcuccagcaaauacaccuauagacgcaagcugacaaauccgcuugaggaaucucaggcuaucaaccuccauaucgagauugaggaacaaaccaucggaguugacgugcacgcccugggccacugguuugucgggcggcugaaucucaaaacguccuuccauuguuacggagcgugcacaaaguaugaguacccuuggcacaccgccaaaugucauuaugaaagagauuaccaguacgagacaagcuggggcugcaaccccuccgacugucccggggugggaaccggcugcaccgcuugcgggcuguaucuugaucagcugaagccugugggcucugccuacaagauuaucacaauucgcuauagccggagagucuguguucaguuuggagaagagaaucucugcaaaaucaucgacaugaacgacuguuucgugucccgccacgugaaggucugcauuaucggcacggugucuaaauuuagccaaggggauacccugcuguucuuuggaccgcuugaaggcgggggacucauuuucaagcauugguguacauccacaugccaguuuggcgaccccggggauaucaugucuccucgggacaaaggcuuccugugucccgaguuuccuggcagcuucagaaagaaaugcaauuucgcuaccacgccccugugugaguacgauggaaacaugguuuccggguauaagaaggugauggccaccauugacagcuuucagucuuucaacacauccaccaugcacuuuaccgaugaacgcaucgaguggaaagacccugauggaaugcuccgggaccacaucaauauucuggucacaaaggauaucgacuucgaaaaccuuggcgagaaucccugcaaaauugggcugcagaccagcucuaucgaaggagccuggggcuccggggugggcuuuacacucacgugucugguuagccugaccgagugcccgacauuccuuaccucuauuaaggcuugcgauaaagcgaucuguuacggagccgaguccgugacacucaccagaggccaaaacacggucaaggugagcgggaagggaggccauuccgggagcaccuuuaaaugcugucacggagaagagugcucucagauuggccugcaugcugccgccccucaccuggacaagguuaauggcaucagcgaaaucgagaacaauaaaguguaugacgauggggcuccccaguguggaauuaagugcugguucgucaaauccggcgaauggaucucugggauuuuuagcggaaacuggaucgugcucauugugcugugugucuuccuucuguuuucccucauccugcugucuauccuuugcccuguucgcaagcauaagaaaagcuga

SEQ ID NO: 13397 - RNA, 3408 nt, Artificial Sequence
  derived and/or modified CDS sequence (opt5) from HTNV(CGRn93MP8)__EF990919.1__GP
augggcaucuggaaguggcuggugaaagccagccucgucuggcccgcuuacacccugagaaacguuuaugacaugaagauugagugcccucacacaguguccuucggggaaaauucugugaucggauacgucgagcuuccgcccauuccucuggccgauacgacccauauggugcccgaaagcuccuguucuauggacaaccaccagagccucaauacaaucaccaaauauacacaaguuuccuggcggggcaaggcggaucaggcucaggccucucagaacagcuuugaggccguguccgcugaagucgaccugaaagggaccugcgugcuuaagcauaagaugcuggaggagagcuaccgcucuagaaaauccauugccuguuaugaucucagcugcaauucuacauacuguaagccuacccuguauaugaucguucccauccacgcuugcaacaugaugaaauccugucugauugcccucggaccucaucgggugcaagucguguacgaacgcacguacugcaugaccggcuuccugaucgaggggaaguguuuugugccggacagaagcgucguuucuauuaucaaacacggaauuuucgauaucgcguccgugcacauugugugcuuuuucgucgccgugaagggcaauacauauaagaucuuugaacagaucaaaaagagcuucgaguccaccuguaacgacaccaaaaauaagguucagggcuacuauauuugcaucgucgggggaaacucugcucccauuuacgugccuacacuugaugacuuucggagcauggaggccuucuccggcaucuuucgcagcccccauggggaagaucacgaccuggcuggagaggaaauugccucuuauuccaucgugggcccugcgaaugccaaaguuccccauagcgcuucuagcgauacgcucucccugacagccuacucugggaucccgagcuauuccagccuuucuauucuggcuggauccgccgaggccaagcacguguucagcccuggcuuucucccccagcugaaccacaccaaaugcgacaagacagcuaucccucugauguggaccggcaugauugaccuccccggguacuacgaagcgauccaucccuguaccgucuucugcgugcugucuggaccuggcgccuccugugaggcuuucagcgaagggggaauuuuuaauaucacauccccgaugugccuugucucuaagcaaaacagauuccggcugacggagcaacaggugaauuuuguuugucagcgcguggauauggacaucauugucuauugcaacggccagagaaaagugauccucaccaagacacugguuauugggcaguguaucuacaccauuacaagccuuuucucccugcuccccggaguggcccacucuaucgccgucgagcugugcgugccuggcuuucauggcugggcuaccgccgcgcugcucgugacguucuguuuuggguggguucugauucccgcuaugacauucaucguccuuaccauccugaaauuuauugccaacaucuuccacaccagcaaucaggaaaacaagcucaaauccgugcugcggaagauuaaggaggaauuugagaaaacaaagggaagcauggugugcgaugucuguaaauaugagugcgaaaccuacaaggagcuuaaagcccauggcgugucuugcccucaaucccagugucccuauugcuucacacacugugaaccgacggaggcugccuuucaggcucacuaccgcguuugccaggugacccauagauuccgggacgaucugaagaagacagucaccccucaaaauuucacacccggguguuaucgcacccucaaccuguuuagauacaaaagccggugcuacaucuucacgauguggguguuucugcucguucuggaaucuauucuuugggccgcguccgccagcgagaucccucugaaucccguguggaacgacaaugcucacggagucggcucugugccuaugcauaccgaucucgagcuggacuucagccugacauccagcucuaaguauaccuacagacgcaaacuuacaaacccccucgaagagucccaggccaucaaucugcacauugaaaucgaggagcagaccauugggguugaugugcacgcucugggccauugguuugacggacggcucaaccugaagacgagcuuccacuguuauggcgccugcacaaaauacgaauauccguggcauaccgcgaagugucacuacgagagagauuaucaguacgaaacauccugggggugcaauccuucugacugucccggagucggcaccgggugcaccgccugcggacuuuaccuggaccaacucaagcccgugggcagcgcuuauaaaaucauuacaauccgcuacucccggagaguguguguccaguuuggggaggaaaaccugugcaagaucauugauaugaaugacuguuucguuucucgccaugugaaagugugcaucauuggcacggucagcaaguuuucccagggagauacccugcuuuucuuuggcccucucgaagggggaggccugaucuucaaacacugguguacaucuaccugccaguuuggggacccgggagauauuaugagcccccgggacaagggcuuccuguguccugaguuccccggguccuuucgcaaaaagugcaacuucgccacaaccccucucugugaguaugauggcaauauggugagcggauacaagaaaguuauggcuacgaucgacucuuuucaauccuucaacacaagcaccaugcacuuuaccgaugagagaaucgaauggaaggaccccgauggcaugcugcgggaccauauuaacauccuugugacaaaagauauugacuucgagaaucugggggaaaacccuugcaagaucggacuccagaccucuuccauugagggcgccugggggagcggagucggcuuuacacugacgugucuggugucucuuaccgagugccccacauuccucaccuccaucaaagccugcgacaaggcuauuuguuauggggcggaaagcguuacacugaccagaggccagaauacggugaaggucuccggaaaaggcgggcacagcggaucuaccuuuaagugcugucauggcgaggaaugcagccagaucgggcugcacgccgcugccccgcaucucgauaaagugaacggaaucuccgagauugaaaauaacaagguuuacgacgauggcgccccucaauguggcaucaaaugcugguucgugaagucuggggaguggauuagcggaaucuuuuccggcaauuggauuguccugaucgugcuuuguguguuccuccuguucucucugauccugcuuagcauucucugccccguccgcaagcacgagaaauccuga

SEQ ID NO: 13398 - RNA, 3408 nt, Artificial Sequence
  derived and/or modified CDS sequence (opt5) from HTNV(CGRn93P8)__EF990918.1__GP
augggcaucuggaaguggcuggugauggccagccucgucuggcccgcuuacacccugagaaacguuuaugacaugaaaauugagugcccucacacaguguccuucggggaaaauucugugaucggauacgucgagcuuccgcccauuccucuggccgauacgacccagauggugcccgaaagcuccuguucuauggacaaccaucaaagccucaauacaaucaccaaguauacacagguuuccuggcggggcaaagcggaucaggcucaggccucucaaaacagcuuugaggccguguccgcugaagucgaccugaaggggaccugcgugcuuaaacacaagaugcuggaggagagcuaccgcucuagaaaguccauugccuguuaugaucucagcugcaauucuacauacuguaaaccuacccuguauaugaucguucccauccaugcuugcaacaugaugaaguccugucugauugcccucggaccucaccgggugcaggucguguacgaacgcacguacugcaugaccggcgugcugaucgaggggaaauguuucgucccggacagaagcguugugucuauuaucaagcauggaauuuuugauaucgcguccgugcacauugucugcuucuuuguggccguuaaaggcaauaacuauaagaucuucgaacagaucaagaaauccuuugagagcacauguaaugacaccaagaacaaagugcagggcuacuauauuugcaucgucgggggaaauucugcucccauuuacgugccuacacuugaugacuuccggagcauggaggccuuuuccggcaucuuccgcagcccccacggggaagaucaugaccuggcuggagaggaaauugccucuuauuccaucguuggcccugcgaacgccaaggugccccacagcgcuucuagcgauacccucucccugacggccuacucugggaucccgagcuauuccagccuuucuauucuggcuggauccgccgaggccaaacaugucuuuagcccuggcuucuuuccccaacucaaucacacaaagugcgacaaaaccgcuaucccucugauguggacaggcaugauugaccugcccggguacuacgaagcgauccaccccuguaccguguucugcguccucucuggaccuggcgccuccugugaggcuuucagcgaagggggaauuuuuaacaucaccuccccgaugugccuggugucuaagcagaauagauuccggcuuacagagcagcagguuaacuuugugugucaacgcgucgauauggacaucauuguguauugcaacggccagagaaagguuauccugacgaaaacccucgugauugggcaguguaucuacacaauuaccagccuguucucccuucugcccggagucgcccauucuaucgccguggagcucugcgugccuggcuuucacggcugggcuacagccgcgcugcugguuaccuucuguuuuggguggguccucauucccgcuaugacguucaucgugcugacaauccuuaaguuuauugccaauaucuuccauaccagcaaccaagaaaauaaacugaaguccgugcuccggaaaauuaaggaggaauuugagaagaccaaaggaagcauggucugcgauguguguaaguaugagugcgaaacauacaaagagcugaaggcccacggcguuucuugcccucagucccagugucccuauugcuucacccauugugaaccgacagaggcugccuuucaggcucacuaccgcgugugccaagucacgcacagauuccgggacgaucuuaaaaagaccgugacaccucagaacuucacccccguuuguuaucgcacacugaaucucuuuagauacaagagccggugcuacaucuucaccauguggguguuucugcugguccucgaaucuauucugugggccgcguccgccagcgagaucccucuuaaccccguguggaaugacaacgcucaugggguuggaucugugccuaugcacacggaucuggagcucgacuucagccugaccuccagcucuaaauauacauacagacgcaagcugaccaauccccuugaagagucccaggccaucaaccuccauauugaaaucgaggagcagacaauuggcgucgaugugcacgcucuggggcacugguuugacggccggcugaaucucaaaaccagcuuccauuguuauggagccugcacgaaguacgaauauccguggcacacagcgaaaugucauuacgagagagauuaucaauacgaaaccuccuggggcugcaacccuucugacugucccggggugggaacaggcugcaccaucugcgggcuguaccuugaccagcugaagcccgucggaagcgccuauaagauuaucaccauccgcuacucccggagaguuugugugcaguuuggcgaggaaaaucucugcaaagugauugauaugaacgacuguuucgucucucgccacgugaagguuugcaucauugggacagugagcaaauuuucccagggcgauacgcugcuguucuuuggaccucuugagggcgggggacucaucuucaagcauugguguaccucuacaugccaauuuggcgacccgggggauauuaugagcccccgggacaaaggauuccuguguccugaguuccccggcuccuuuagaaagaaaugcaauuucgcuaccacaccugucugugaauaugaugggaacauggugagcggcuacaagaagguuauggccaccaucgacucuuuucaguccuucaacacgagcacaaugcacuuuaccgaugagcgcaucgaauggaaagaccccgauggaaugcugcgggaccacauuaauauccucgugaccaaggauauugacuucgacaaccugggcgagaauccuugcaaaaucgggcuucagacaucuuccauugaaggagcuuggggcagcggggucggauuuacccugacaugucucaucucucugacggagugccccaccuuccugacauccauuaaggccugcgauaaagccaucuguuauggcgcugagagcgugacccuuacaagagggcagaacaccguuaagguguccggcaagggaggccauagcgggucuacguuuaaaugcugucacggagaagacugcagccaauccggccuccaugcggccgcuccgcaccuggauaaggucaaugggaucucugagauugaaaacagcaaaguguacgacgauggagccccucaguguggcaucaagugcugguucgugaaauccggcgaguggauuucugggaucuuuagcggaaauuggauuguccugaucguucucuguguguuccugcuuuucucccuggugcuccugucuauccugugccccguccgcaagcauaagaaaagcuga

SEQ ID NO: 13399 - RNA, 3408 nt, Artificial Sequence
  derived and/or modified CDS sequence (opt5) from HTNV(CGRni1)__EU363815.1__GP
augggcaucuggaaguggcuggugauggccagccucgucuggcccgcuuucgcccugagaaaccuuuacgacaugaaaauugagugcccucacaccguuuccuuuggggaaaauucugugacaggauauguggagcugccgcccaugccucucgcggauacgacccagaugguccccgaaagcuccuguucuauggacaaccaucaaagccugaauacaaucaccaaguacacacagauuaucuggcggggcaaagcugaucagucccagucuagccaaaacuccuucgagaccgugagcacagaaguugaccuuaaggggaccugcgugcugaaacacaagaugauugaggagucuuaucgcuccagaaagagcaucacguguuacgaucucucuugcaauuccaccuauuguaaaccuacacuguacaugaucguccccauucaugccugcaacaugaugaaaagcugucugaucgcccucggaccuuaucgggugcagguuguguacgaacgcaccuacugcaugacaggcguccugauugaggggaaguguuuugugccggaccagucuguggucuccaucauuaagcacggaaucuucgauauugcuagcguucauaucgugugcuuuuauguggccgucaaaggcaauaccuacaagaucuucgaacaggugaagaaaacguuugaguccaacuguaaugacacagagaacaagguucaaggcuauuacauuugcaucauugggggaaauucuagccccguguaugucccuacccuugaugacuucagauccauggaagccuuuagcggcaucauucggucuccccacggggaggaucacgaccuggccggagaagagguggcguccuacagcaucguuggcccugccaacgcuaaagugccccauucugccagcuccgauacacucgggcugaucgcuuauucuagcauuccguccuacagcucucuuuccauccugaccagcucuaccgaagccaagcacgucuucuccccuggacucuuuccccagcugaaucauacaaaaugcgacaagacggcgauuccucugaccuggacaggcaugaucgaccuccccggcuacuaugaggccauucaccccuguaccguguucugcguccugagcgggccuggagcuuccugugaggccuuuucugaaggcgggaucuucaacaucgcuagcccgaugugccuuguguccaaacagaaucgcuucagacugacagagcagcaaguuaacuuugugugucagcgggucgauguggacauuaucguuuacugcaacggacagcgcaaggugauucucaccaagacgcuggucaucggccaauguauuuauacaaucaccucucuuuucagccugcuccccgggguggcccacuccauugccguggaacugugcguuccuggauuucauggcugggcuaccgcggcccugcucgucacauucuguuuuggcugggugcugauccccgcuaucaccuucauuauccuuacaauucugaaauuuaucgccaauauuuuccacacgagcaaccaggagaauagacucaagucugugcugcggaaaaucaaggaagaguuugagcgcaccaugggguccauggucugcgauaucuguaaauacgaaugcgagacauauaaggaacuuaaggcccauggagugagcugcccucagucucagugucccuacugcuucacccacugugagccgacagaagcugccuuucaagcgcauuauaaaguuugccaggugacccacagauuccgggacgaucugaagaaaacggucacccgccagaacuuuacaccuggcuguuacagaacccucaaucuguuccgguacaaguccagaugcuauauuuucacaauguggguguuucugaucguucucgagagcauucugugggcugccucugccagcgagaucccccuuaacccuguguggaaugacaacgcucacggggucggauccauucccaugcauaccgaucuggaacucgacuucagccugacgucuuccagcaaauacacauaucgccggaagcugaccaauccucuugaggaaucccaggccaucgaucuccacguggagaucgaggaacaaacaauuggcguugacgugcaugcucuggggcacugguuugauggcagacugaaccucaagaccucuuuccacuguuacggagccugcaccaaauaugaguaccccuggcauacagcgaagugucacuaugaacgcgacuaccaguacgagacgagcuggggcugcaauccguccgacuguccuggggucggaaccggcugcacagccugcgggcuguaucuugaucagcugaaacccgugggaucugcuuacaagaucauuaccauccgguauagcagacgcguguguguccaguuuggcgaagagaaccucugcaaaauuaucgacaugaaugauuguuucguuucccggcaugugaaggugugcaucauugggacagucucuaaguuuagccaaggcgacacccugcuguucuuuggaccccuugagggcgggggacucaucuucaaacacugguguacguccacaugccaguuuggcgauccuggggacauuaugagcccgagagauaagggauuccugugucccgaauuuccuggcucuuuccgcaaaaagugcaacuucgccaccacccccgugugugaguacgacgggaauaugguuuccggcuauaaaaaggugauggcuacaaucgauagcuuucagucuuucaacaccuccacaaugcauuuuacggacgaacggauugaguggaaagauccugacggaaugcugagagaucacaucaacauucucgucaccaaggacaucgacuucgauaaucugggcgaaaaccccugcaagaucgggcuucagacaagcucuauugagggagccuggggcuccggggugggauuuacccugacaugucucaucagccugaccgagugcuccacguuccugaccagcauuaaagcgugcgacaaggccaucuguuacggcgcugaaucuguuacacuuacccgcgggcaaaauacagugaaagucagcggcaagggaggccacuccgggucuagcuuuaaaugcugucauggagaggaaugcucccagauuggccuccacgccgcugccccucaucuggauaaggugaacgggaucucugagauggaaaauagcaagguuuucgacgauggagcuccccaguguggcaucaaaugcugguuugugaaguccggcgaguggauuucugggaucuucagcggaaacuggauuguccugaucgugcucuguguguuucugcuuuucucccugguccuccugagcauucugugcccgguucggaaacacaagaaaucuuga

SEQ ID NO: 13400 - RNA, 3408 nt, Artificial Sequence
  derived and/or modified CDS sequence (opt5) from HTNV(Aa10-434)__KU207160.1__GP
augggcaucuggaaguggcuggugauggccagccucgucuggcccguucugacccuuagaaacguguacgacaugaagauugagugcccucacacaguguccuucgggggaaauucugucaucggcuauguggaacugccgcccaugccucucgcugauacggcccagcugguucccgagagcuccuguucuauggacaaccaucaaagccuuaauaccauuacaaaguacacccagguguccuggcgggggaaagcggaucagucucagagcucccaaaucagcuuugaaacagucucuaccgagguggaccugaagggaacaugcguucucaaacacaagaugguggaagaguccuaucgcagcagaaagucuauuaccuguuacgaucuguccugcaacagcacguauuguaaaccuacccuguacaugaucguccccauccaugcuugcaauaugaugaagucuugucucauugcccugggcccuuaucggguccaggugguguacgagcgcacauacugcaugaccgggguucuuaucgaaggaaaauguuucgugccggaccaguccguggucagcauuaucaagcacggcauuuuugauaucgccuccgugcauauuguuugcuucuuuguggcugucaaaggcaacacauauaagaucuucgaacaggugaagaaaucuuuugagagcaccuguaaugacacggagaacaagguucaaggguacuauaucugcauugugggaggcaauuccgcccccaucuacgucccuacacuggaugacuucagaagcauggaggcuuuuaccgggauuuuccggucuccccacggagaagaucacgaccucgccggcgaggaaacagcgaccuauuccaucguggggccugccaacgcuaaagucccccauagcgccucuagcgauacccugucccuuauugcuuuuucuggaaucccgagcuacuccagccugucuauccucacauccagcacggaggccaagcacguguucucuccuggccuguuucccaaacugaaucauaccaacugcgacaagggcgcgauuccucucauguggacagggaugaucgaccugcccggauauuacgaagccauucaccccuguaccguuuucugcgugcuuuccggcccuggggcuagcugugaggccuucuccgagggaggcaucuuuaauauuacaucuccgaugugccuggucagcaaacagaaccgcuucagacucaccgaacaacaggugaauuuuguuugucaacggguggaugucgacaucgugguguacugcaacgggcagcgcaagguuauccugacgaagacacuugucauuggacaguguaucuauaccauuaccucccuguucucucuccugcccggcguggcucacagcaucgccguggagcugugcgucccuggcuuucaugggugggccacagcugcgcuccuggugaccuucuguuuuggauggguucuuauucccgccaucacauucauuauccugacgauccucaaauuuauugcuaacaucuuccacaccuccaaucaagaaaacagacucaagagcgugcuucggaaaauuaaggaggaauuugagaaaacaaagggcucuauggucugcgauaucuguaaguacgagugcgaaaccuauaaagagcugaaggcccaugggguguccugcccucagagccagugucccuacugcuucacacacugugaaccgaccgaggccgcuuuucaggcccauuauaaaguuugccaagugacgcaccgcuucagagacgaucucaagaaaaccgucacaccucagaauuucacccccggauguuaccggacacugaaccuguuucgcuauaagucuagaugcuacauuuucaccauguggaucuuucuccuggugcuugaauccauccugugggcggcuagcgccucugagacgccucucacacccguuuggaaugacaacgcccacggcguggggagcgucccuaugcauaccgaucuggagcuggacuucucccuuacauccucuuccaaguacaccuaucggagaaaacucaccaauccccuggaagaggcucagagcauugaucugcacaucgaaauugaggagcagacaaucggcguggacgugcaugcccucggacacugguuugauggccgccugaaccuuaagacguccuuccacuguuacggggcuugcaccaaauaugaauacccguggcauacagccaagugucacuaugagcgggacuaccaauaugaaaccucuuggggaugcaauccuagcgacugucccggcgucgggacaggaugcaccgcgugcggccuguaccucgauagacugaaacccguuggguccgccuacaagauuaucacgauccgcuauucucggagagugugugugcaguuuggcgaggaaaaccugugcaagauuaucgacaugaaugauuguuucgucagccgccaugugaaaguuugcauuaucggaacaauuuccaaguuuucucagggcgacacccuucucuucuuugggccucuggagggaggcgggcugaucuucaaacacugguguaccagcacaugccaguuuggagauccgggcgacaucaugagcccccgggauaagggguuccucuguccugaguuccccggcagcuuuagaaagaagugcaacuucgcuaccacaccuauuugugaauacgacggaaauauggugucuggcuauaaaaaggucauggccacgaucgauuccuuucagagcuucaacaccucuacaaugcauuuuaccgacgagcgcauugaauggaaggaucccgacgggaugcugcgggaucacaucaauauucuugugacaaaagacaucgacuucgauaaccugggagagaacccuugcaagauuggccuccaggcuuccagcaucgaaggggccuggggaucuggcguuggguuuacccugacgugucuggugucccuuaccgagugccccacauuccucaccagcaucaaagcgugcgacaaggccauuuguuacggcgcugaguccgucacacugaccagaggacagaauacagugaaaguuagcggcaaagggggacacucuggcagcaccuuuaagugcugucauggggaagauugcucccagaucggacugcacgccgcugccccgcaucucgacaaagugaacggcauuucugagauggaaaauagcaaggucuaugaugacggcgccccucaaugugggaucaaaugcugguucgugaaguccggagaguggauuucuggcaucuuuagcgggaacuggaucgugcugauuguccuuuguguuuuccugcuguucucccuggugcugcuuucuauccucugccccgugcgcaaacacaaaaagagcuga

SEQ ID NO: 13401 - RNA, 3408 nt, Artificial Sequence
  derived and/or modified CDS sequence (opt5) from HTNV(Aa10-518)__KU207161.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacgaagaauaaaguucaaggcuacuauaucugcaucgucgggggaaacuccgcccccauuuacgugccuacacuggaugacuucagaagcauggaggcuuuuaccggcaucuuccggucuccccacggggaagaucacgaccucgccggagaggaaacagcgaccuauuccauugugggcccugccaaugcuaaggucccccauagcgccucuagcgauacccugucccuuaucgcuuuuucugggauuccgagcuacuccagccugucuauccucacauccagcacggaggccaaacacguguucucuccuggacuguuucccaagcugaaccauaccaauugcgacaaaggcgcgaucccucucauguggacaggcaugauugaccugcccggguauuacgaagccauccaccccuguaccguuuucugcgugcuuuccggaccuggcgcuagcugugaggccuucuccgaagggggaauuuuuaacaucacaucuccgaugugccuggucagcaagcagaaucgcuucagacucaccgagcaacaggugaacuuuguuugucaacggguggaugucgacauugugguguacugcaacggccagcgcaagguuauccugacgaaaacacuugucaucgggcaguguauuuauaccaucaccucccuguucucucuccugcccggaguggcucacagcauugccguggagcugugcgucccuggcuuucauggcugggccacagcugcgcuccuggugaccuucuguuuuggguggguucuuauccccgccauuacauucaucauucugacgauccucaaguuuaucgcuaauauuuuccacaccuccaaccaagaaaauagacugaaaagcgugcuucggaagaucaaagaggaauuugagaagacaaagggaucuauggucugcgauauuuguaaauacgagugcgaaaccuauaaggagcugaaagcccauggcguguccugcccucagagccagugucccuacugcuucacacacugugaaccgaccgaggccgcuuuucaggcccauuauaagguuugccaagugacgcaccgcuucagagacgaucucaaaaagaccgucacaccucagaacuucacccccggguguuaccggacacugaaucuguuucgcuauaagucuagaugcuacaucuucaccauguggauuuuucuccuggugcuugaauccauccugugggcggcuagcgccucugagacgccucucacacccguuuggaacgacaaugcccacggagugggcagcgucccuaugcauaccgaucuggagcuggacuucucccuuacauccucuuccaaauacaccuaucggagaaagcucaccaacccccuggaagaggcucagagcaucgaucugcacauugaaaucgaggagcagacaauugggguggacgugcaugcccucggccacugguuugauggacgccugaaucuuaaaacguccuuccacuguuacggcgcuugcaccaaguaugaauacccguggcauacagccaaaugucacuaugagcgggacuaccaauaugaaaccucuugggggugcaacccuagcgacugucccggagucggcacagggugcaccgcgugcggacuguaccucgauagacugaagcccguuggcuccgccuacaagaucauuacgauccgcuauucucggagagugugugugcaguuuggggaggaaaaucugugcaaaaucgucgacaugaacgauuguuucgugagccgccauguuaaggugugcauuaucggcacagucuccaaauuuucucagggagacacccuucucuucuuuggcccucuggaagggggaggccugauuuucaagcacugguguaccagcacaugccaguuuggggauccgggagacaucaugagcccccgggauaaaggcuuccucuguccugaguuccccgggagcuuuagaaagaaaugcaauuucgcuaccacaccuauuugugaguacgacggcaacauggugucuggauauaagaagguuauggccacgaucgauuccuuucagagcuucaauaccucuacaaugcauuuuaccgacgagcgcaucgaauggaaagaucccgacggcaugcugcgggaucacauuaacauccuugugacaaaggacauugacuucgauaaccugggggagaauccuugcaaaaucggacuccagaccuccagcauugaaggcgcuugggggucuggagucggcuuuacgcugaccugucuggugucccuuacagagugccccaccuuccucacaagcaucaaggccugcgacaaagcgauuuguuacggggccgaguccguuacccugacaagaggccagaacaccgugaaggucagcggaaagggcgggcacucuggaagcacguuuaaaugcugucauggcgaagauugcucccagaucgggcugcacgcugccgcuccgcaucucgacaaggugaauggaaucucugagauggaaaacagcaaaguguaugaugacggcgccccucaauguggcauuaagugcugguucgucaaauccggggaguggaucucuggaauuuuuagcggcaauuggaucguucugauugugcuuuguguguuccuccuguucucccugguccugcuuucuauccucugccccgugcgcaagcacaagaaaagcuga

SEQ ID NO: 13402 - RNA, 3408 nt, Artificial Sequence
  derived and/or modified CDS sequence (opt5) from HTNV(Aa13_3)__KX687227.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucguugauacggugcagcugguccccgaaagcuccuguucuauggacaaccaucaaagccuuaauaccauuacaaaguacacccagguguccuggcggggcaaagcugaucagucucagagcucccaaaacagcuuugagacaguuucuaccgaaguggaccugaaggggacaugcguccucaaacacaagaugguggaggaguccuaucgcagcagaaagucuaucaccuguuacgaucuguccugcaauagcacguauuguaaaccuacccuguacaugauugugcccauccaugccugcaacaugaugaagucuugucucaucgcgcugggaccuuaucggguccagguuguguacgaacgcacauacugcaugaccggcgugcuuauugaggggaaauguuucgucccggaccaguccgugguuagcaucauuaagcacggaaucuuugauauugcuuccgugcauaucgucugcuucuuuguggccguuaaaggcaauacauauaagauuuucgaacaggugaagaaaucuuuugagagcaccuguaacgacacggagaauaagguccaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcuaccuauuccauugugggcccugccaaugcgaaaguuccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcuaucccucucauguggacaggcaugauugaccugcccggguauuacgaggccauccaccccuguaccgucuucugcgugcuuuccggaccuggcgcgagcugugaggccuucuccgaagggggaauuuuuaacaucacaucuccgaugugccugguuagcaaacagaaucgcuucagacucaccgagcaacaggugaacuuugucugucaacggguggauguggacauuguugucuacugcaacggccagcgcaaggugauccugacgaagacacuugugaucgggcaguguauuuauaccaucaccucccuguucucucuccugcccggagucgcucacagcauugccguggaacugugcguuccuggcuuucauggcugggcuacagccgcccuccuggugaccuucuguuuuggguggguccuuauccccgcuauuacauucaucauucugacgauccucaaauuuaucgcgaauauuuuccacaccuccaaccaagagaauagacuuaagagcgugcugcggaaaaucaaggaagaguuugagaaaacaaagggaucuaugguuugcgauauuuguaaguacgaaugcgagaccuauaaagaacugaaggcccauggcguguccugcccucagagccagugucccuacugcuucacacacugugagccgaccgaagcugccuuucaggcccauuauaaagucugccaagugacgcaccgcuucagagacgaucucaagaaaaccguuacaccucagaacuucacccccggguguuaccggacacugaaucuguuucgcuauaagucuagaugcuacaucuucaccauguggauuuuucuccuggugcuugaguccauccugugggcugccagcgcgucugagacgccucucacacccgucuggaacgacaaugcucacggagugggcagcgugccuaugcauaccgaucuggaacuggacuucucccuuacauccucuuccaaguacaccuaucggagaaaacucaccaacccccuggaggaagcccagagcaucgaucugcacauugagaucgaggaacagacaauuggggucgacguucaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggagugggcacagggugcaccgcuugcggacuguaccucgauagacugaaacccgugggcuccgccuacaagaucauuacgauccgcuauucucggagagucugugugcaguuuggggaagagaaucugugcaagaucauugacaugaacgauuguuucguuagccgccaugugaaagucugcaucauuggcacaguguccaaguuuucucagggagacacccuucucuucuuuggcccucuggaagggggaggccugaucuucaaacacugguguaccagcacaugccaguuuggggauccgggagacauuaugagcccccgggauaagggcuuccucuguccugaguuccccgggagcuuuagaaagaagugcaauuucgcgaccacaccuaucugugaauacgacggcaacaugguuucuggauauaaaaaggugauggccacgaucgauuccuuucagagcuucaauaccucuacaaugcauuuuaccgacgaacgcauugaguggaaggaucccgacggcaugcugcgggaucacaucaacauucuugucacaaaagacaucgacuucgauaaccugggggaaaauccuugcaagauuggacuccagaccuccagcaucgagggcgcuugggggucuggagugggcuuuacgcugaccugucugguuucccuuacagagugccccaccuuccucacaagcauuaaagccugcgacaaggcuaucuguuacggggccgaauccgugacccugacaagaggccagaacaccgucaaagugagcggaaagggcgggcacucuggaagcacguuuaagugcugucauggcgaggauugcucccagaucgggcugcacgcggccgcuccgcaucucgacaaagugaauggaauuucugaaauggagaacagcaaggucuaugaugacggcgccccucaauguggcaucaaaugcugguucguuaaguccggggaauggauuucuggaaucuuuagcggcaauuggauugugcugaucgugcuuugugucuuccuccuguucucccuggugcugcuuucuauccucugccccguucgcaaacacaaaaagagcuga

SEQ ID NO: 13403 - RNA, 3408 nt, Artificial Sequence
  derived and/or modified CDS sequence (opt5) from HTNV(Aa14_186)__KX687228.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugaucgaggaguccuaucgcagcagaaagucuauuaccuguuacgaucuguccugcaauaacacguauuguaaaccuacccuguacaugaucgugcccauccaugcuugcaauaugaugaaaagcugucucauugcccugggaccuuaucggguccaggugguguacgaacgcacauacugcaugaccggcguccuuaucgaggggaaauguuucguuccggaccagucugugguguccauuaucaagcacggaauuuuugauaucgccagcguccauauugugugcuucuuuguugcugugaaaggcaacacauauaagaucuucgaacaggucaagaaauccuuugagucuaccuguaaugacacggagaacaaggugcaaggcuacuauaucugcauuguugggggaaauagcgcccccaucuacgugccuacacuggaugacuucagauccauggaggcuuuuaccggcauuuuccggagcccccacggggaggaucacgaccucgccggagaagagacagcgaccuauucuaucgucggcccugccaacgcuaaagugccccauuccgccagcucugauacccugagccuuauugcuuuuuccgggaucccgucuuacagcucccugagcauccucacaucuuccacggaagccaagcacgucuucagcccuggacuguuucccaaacugaaucauaccaacugcgacaagggcgcgauuccucucauguggacaggcaugaucgaccugcccggguauuacgaggccauucaccccuguaccguguucugcguucuuucuggaccuggcgcuuccugugaggccuucagcgaagggggaaucuuuaauauuacauccccgaugugccuggugucuaaacagaaccgcuucagacucaccgagcagcaggucaacuuugugugucaacggguugauguggacaucgucguguacugcaauggccagcgcaaggugauccugacgaagacacuuguuauugggcaguguaucuauaccauuaccagccuguucucccuccugcccggagucgcucacucuaucgccguggaacugugcgugccuggcuuucauggcugggccacagcugcgcuccuggucaccuucuguuuugggugggugcuuauucccgccaucacauucauuauccugacgauccucaaauuuauugcuaacaucuuccacaccagcaaucaagagaacagacugaaguccguucuucggaaaauuaaggaagaguuugagaaaacaaagggaagcauggugugcgauaucuguaaguacgaaugcgagaccuauaaagaacugaaggcccauggcgucucuugcccucagucccagugucccuacugcuucacacacugugagccgaccgaagccgcuuuucaggcccauuauaaagugugccaaguuacgcaccgcuucagagacgaucucaagaaaaccgugacaccucagaauuucacccccggguguuaccggacacugaaccuguuucgcuauaagagcagaugcuacauuuucaccauguggaucuuucuccugguccuugagucuauccugugggcggcuuccgccagcgagacgccucucacacccguguggaaugacaacgcccacggaguuggcucugugccuaugcauaccgaucuggaacuggacuucagccuuacauccagcucuaaguacaccuaucggagaaaacucaccaauccccuggaggaagcucaguccauugaucugcacaucgagauugaggaacagacaaucggggucgacgugcaugcccucggccacugguuugauggacgccugaaccuuaagacgagcuuccacuguuacggcgcuugcaccaaauaugaguacccguggcauacagccaagugucacuaugaacgggacuaccaauaugagaccuccugggggugcaauccuucugacugucccggagugggcacagggugcaccgcgugcggacuguaccucgauagacugaaacccgucggcagcgccuacaagauuaucacgauccgcuauucccggagaguuugugugcaguuuggggaagagaaccugugcaagauuaucgacaugaaugauuguuucgugucucgccaugucaaagugugcauuaucggcacaguuagcaaguuuucccagggagacacccuucucuucuuuggcccucuggaagggggaggccugauuuucaaacacugguguaccucuacaugccaguuuggggauccgggagacaucaugagcccccgggauaagggcuuccucuguccugaguuccccggguccuuuagaaagaagugcaacuucgcuaccacaccuaucugugaguacgacggcaauauggugagcggauauaaaaaggucauggccacgauugauucuuuucaauccuucaacaccagcacaaugcauuuuaccgacgaacgcaucgaguggaaggaucccgacggcaugcugcgggaucacauuaacauccuugugacaaaagacauugacuucgauaaucugggggaaaacccuugcaagaucggacuccagaccucuuccauugagggcgcuugggggagcggaguuggcuuuacgcugaccugucuggugucucuuacagagugccccaccuuccucacauccaucaaagccugcgacaaggcgaucuguuacggggccgaaagcgucacccugacaagaggccagaauaccgugaaaguuuccggaaagggcgggcacagcggaucuacguuuaagugcugucauggcgaggauugcagccagauugggcugcacgcugccgcuccgcaucucgacaaagugaacggaaucuccgaagucgaaaauucuaagguguaugaugacggcgccccucaauguggcauuaaaugcugguucgucaagagcggggaauggaucuccggaaucuuuucuggcaacuggauugugcugaucguucuuuguguguuccuccuguucagccuggugcugcuuuccauucucugccccguccgcaaacacaagaagucuuga

SEQ ID NO: 13404 - RNA, 3408 nt, Artificial Sequence
  derived and/or modified CDS sequence (opt5) from HTNV(Aa14_234)__KX687230.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaccagcuuugagaccgucucuacagaaguggaccugaaggggaccugcguucucaaacacaagaugguggaggaguccuaucgcagcagaaagucuaucacguguuacgaucuguccugcaacagcaccuauuguaaaccuacacuguacaugauuguccccauccaugcuugcaauaugaugaagucuugucucaucgcccugggaccuuaucggguccaggugguguacgaacgcaccuacugcaugacaggcguucuuauugaggggaaauguuucgugccggaccaguccguggucagcaucauuaagcacggaaucuuugauauugccuccgugcauaucguuugcuucuuuguggcugucaaaggcaacaccuauaagauuuucgaacaggugaagaaaucuuuugagagcacguguaaugacacagagaacaagguucaaggcuacuauaucugcaucgucgggggaaauuccgcccccauuuacgugccuacccuggaugacuucagaagcauggaggcuuuuacaggcaucuuccggucuccccacggggaggaucacgaccucgccggagaagagaccgcgaccuauuccauugugggcccugccaacgcuaaagucccccauagcgccucuagcgauacacugucccuuaucgcuuuuucugggauuccgagcuacuccagccugucuauccucacguccagcaccgaagccaagcacguguucucuccuggacuguuucccaaacugaaucauacauccugcgacaagggcgcgaucccucucauguggaccggcaugauugaccugcccggguauuacgaggccauccaccccuguacaguuuucugcgugcuuagcggaccuggcgcuuccugugaggccuucucugaagggggaauuuuuaacaucaccagcccgaugugccuggucuccaaacagaaucgcuucagacucacggagcaacaggugaacuuuguuugucagcggguggaugucgacauugugguguacugcaauggccagcgcaagguuauccugacaaagacccuugucaucgggcaguguauuuauaccaucacaucucuguucagccuccugcccggaguggcucacuccauugccguggaacugugcgucccuggcuuucauggcugggccaccgcugcgcuccuggugacauucuguuuuggguggguucuuauccccgccauuacguucaucauucugaccgugcucaaauuuaucgcuaacaucuuccacacaagcaaccaagagaauagacugaagucuguccuucggaaaauuaaggaagaguuugagaaaaccaagggauccauggugugcgauaucuguaaguacgaaugcgagacauauaaagaacugaaggcccauggcguuagcugcccucagucucagugucccuacugcuucacccacugugagccgacggaagccgcuuuucaggcccauuauaaagugugccaagucacccaccgcuucagagacgaucucaagaaaacagugaccccucagaacuucacacccggguguuaccggacccugaaucuguuucgcuauaaguccagaugcuacauuuucacgauguggaucuuucuccugguucuugagagcauucugugggcggcuucugccagcgagacaccucucacccccguguggaacgacaaugcccacggagucggcuccgugccuaugcauacagaucuggaacuggacuucagccuuaccucuuccagcaaguacaccuaucggagaaaacucacaaacccccuggaggaagcucaguccaucgaucugcacaucgagauugacgagcagacgaucgggguggauguccaugcccucggccacugguuugacggacgccugaaucuuaagaccucuuuccacuguuacggcgcuugcacaaaauaugaauacccguggcauaccgccaagugucacuaugagcgggacuaccaauaugaaacaagcugggggugcaacccuuccgauugucccggaguuggcaccgggugcacggcgugcggacuguaccucgacagacugaaacccgugggcucugccuacaagauuaucacaauucgcuauagccggagaguguguguccaguuuggggaggaaaaucugugcaagaucaucgauaugaacgacuguuucgugucccgccauguuaaagugugcauuaucggcaccgucucuaaguuuagccagggagauacccuucucuucuuuggcccucuggaagggggaggccugauuuucaaacacugguguacauccacaugccaguuuggggacccgggagauaucaugagcccccgggacaagggcuuccucuguccugaguuccccgggucuuuucgcaaaaagugcaauuucgcuacaacgccuauuugugaauacgauggcaacaugguguccggauauaaaaagguuauggccaccaucgacagcuuucaaucuuucaauacauccaccaugcauuuuacagaugagagaaucgaauggaaggaccccgauggcaugcugcgggaccacauuaacauccuugugaccaaagacauugauuucgacaaucugggggagaacccuugcaagaucggacuccagacgagcucuauugaaggcgcuuggggguccggagucggcuuuacccugacaugucuggugagccuuaccgagugccccacauuccucaccuccaucaaagccugcgauaaggcgauuuguuacggggccgagagcguuacacugaccagaggccagaacacggugaaagucucuggaaagggcgggcacagcggauccacauuuaagugcugucauggcgaagacugcucucagaucgggcugcacgcugccgcuccgcaucucgauaaagugaauggaaucagcgagauggaaaacuccaagguguaugacgauggcgccccucaauguggcauuaaaugcugguucgucaagucuggggaguggaucagcggaauuuucuccggcaauuggaucguucugauugugcuuuguguguuccugcucuuuucucugguccugcuuagcauccucugccccgugcgcaaacacaagaaguccuga

SEQ ID NO: 13405 - RNA, 3408 nt, Artificial Sequence
  derived and/or modified CDS sequence (opt5) from HTNV(Aa14_239)__KX687231.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccgagcaacaggugaacuuuguuugucaacggguggaugucgacauugugguguacugcaacggccagcgcaagguuauccugacgaagacacuugucaucgggcaguguauuuauaccaucaccucccuguucucucuccugcccggaguggcucacagcauugccguggaacugugcgucccuggcuuucauggcugggccacagcugcgcuccuggugaccuucuguuuuggguggguucuuauccccgccauuacauucaucauucugacggugcucaaauuuaucgcuaauaucuuccacaccuccaaccaagagaauagacuuaagagcguccugcggaaaauuaaggaagaguuugagaaaacaaagggaucuauggugugcgauaucuguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaacuucacccccggguguuaccggacacugaaucuguuucgcuauaagucuagaugcuacauuuucaccauguggaucuuucuccugguucuugaguccauucugugggcggcuagcgccucugagacgccucucacacccguguggaacgacaaugcccacggagucggcagcgugccuaugcauaccgaucuggaacuggacuucucccuuacauccucuuccaaguacaccuaucggagaaaacucaccaacccccuggaggaagcucagagcaucgaucugcacaucgagauugacgagcagacaaucgggguggauguccaugcccucggccacugguuugacggacgccugaaucuuaagacguccuuccacuguuacggcgcuugcaccaaauaugaauacccguggcauacagccaagugucacuaugagcgggacuaccaauaugaaaccucuugggggugcaacccuagcgauugucccggaguuggcacagggugcaccgcgugcggacuguaccucgacagacugaaacccgugggcuccgccuacaagauuaucacgauucgcuauucucggagaguguguguccaguuuggggaggaaaaucugugcaagaucaucgauaugaacgacuguuucgugagccgccauguuaaagugugcauuaucggcacagucuccaaguuuucucagggagauacccuucucuucuuuggcccucuggaagggggaggccugauuuucaaacacugguguaccagcacaugccaguuuggggacccgggagauaucaugagcccccgggacaagggcuuccucuguccugaguuccccgggagcuuuagaaagaagugcaauuucgcuaccacaccuauuugugaauacgauggcaacauggugucuggauauaaaaagguuauggccacgaucgacuccuuucagagcuucaauaccucuacaaugcauuuuaccgaugagcgcaucgaauggaaggaccccgauggcaugcugcgggaccacauuaacauccuugugacaaaagacauugauuucgacaaccugggggagaauccuugcaagaucggacuccagaccuccagcauugaaggcgcuugggggucuggagucggcuuuacgcugaccugucuggugucccuuacagagugccccaccuuccucacaagcaucaaagccugcgauaaggcgauuuguuacggggccgaguccguuacccugacaagaggccagaacaccgugaaagucagcggaaagggcgggcacucuggaagcacguuuaagugcugucauggcgaagacugcucccagaucgggcugcacgcugccgcuccgcaucucgauaaagugaauggaaucucugagauggaaaacagcaagguguaugacgauggcgccccucaauguggcauuaaaugcugguucgucaaguccggggaguggaucucuggaauuuuuagcggcaauuggaucguucugauugugcuuuguguguuccuccuguucucccugguccugcuuucuauccucugccccgugcgcaaacacaaaaagagcuga

SEQ ID NO: 13406 - RNA, 3408 nt, Artificial Sequence
  derived and/or modified CDS sequence (opt5) from HTNV(Aa14-172)__KU207162.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucacggauaccgcucagcugguucccgaaagcuccuguucuauggacaaccaucaaagccuuaauacaauuaccaaguacacacagguguccuggcggggcaaagccgaucagucucagagcucccaaaacagcuuugagaccgucucuacagaaguggaccugaaggggaccugcguucucaaacacaagaugaucgaggaguccuaucgcagcagaaagucuauuacguguuacgaucuguccugcaauaacaccuauuguaaaccuacacuguacaugaucgugcccauccaugcgugcaauaugaugaaaagcugucucauugcucugggaccuuaucggguccaggugguguacgaacgcaccuacugcaugacaggcguccuuaucgaggggaaauguuucguuccggaccagucugugguguccauuaucaagcacggaauuuuugauaucgccagcguccauauugugugcuucuuuguugccgugaaaggcaacaccuauaagaucuucgaacaggucaagaaauccuuugagucuacguguaaugacacagagaacaaggugcaaggcuacuauaucugcauuguugggggaaauagcgcucccaucuacgugccuacccuggaugacuucagauccauggaagccuuuacaggcauuuuccggagcccccacggggaggaucacgaccucgcuggagaagagaccgccaccuauucuaucgucggcccugcgaacgccaaagugccccauuccgcuagcucugauacacugagccuuauugccuuuuccgggaucccgucuuacagcucccugagcauccucacgucuuccaccgaagcuaagcacgucuucagcccuggacuguuucccaaacugaaucauacaaacugcgacaagggcgccauuccucucauguggaccggcaugaucgaccugcccggguauuacgaggcgauucaccccuguacaguguucugcguucuuucuggaccuggcgccuccugugaggcuuucagcgaagggggaaucuuuaauauuaccuccccgaugugccuggugucuaaacagaaccgcuucagacucacggagcagcaggucaacuuugugugucaacggguugauguggacaucgucguguacugcaauggccagcgcaaggugauccugacaaagacccuuguuauugggcaguguaucuauaccauuacaagccuguucucccuccugcccggagucgcccacucuaucgcuguggaacugugcgugccuggcuuucauggcugggccaccgccgcucuccuggucacauucuguuuugggugggugcuuauucccgcgaucacguucauuauccugaccauccucaaauuuauugccaacaucuuccacacaagcaaucaagagaacagacugaaguccguucuucggaaaauuaaggaagaguuugagaaaaccaagggaagcauggugugcgauaucuguaaguacgaaugcgagacauauaaagaacugaaggcucauggcgucucuugcccucagucccagugucccuacugcuucacccacugugagccgacggaagccgccuuucaggcucauuauaaagugugccaaguuacccaccgcuucagagacgaucucaagaaaacagugaccccucagaauuucacacccggguguuaccggacccugaaccuguuucgcuauaagagcagaugcuacauuuucacgauguggaucuuucuccugguccuugagucuauccugugggccgcguccgcuagcgagacaccucucacccccguguggaaugacaacgcccacggaguuggcucugugccuaugcauacagaucuggaacuggacuucagccuuaccuccagcucuaaguacaccuaucggagaaaacucacaaauccccuggaggaagcccaguccauugaucugcacaucgagauugaggaacagacgaucggggucgacgugcaugcucucggccacugguuugauggacgccugaaccuuaagaccagcuuccacuguuacggcgccugcacaaaauaugaguacccguggcauaccgcuaagugucacuaugaacgggacuaccaauaugagacauccugggggugcaauccuucugacugucccggagugggcaccgggugcacggccugcggacuguaccucgauagacugaaacccgucggcagcgcguacaagauuaucacaauccgcuauucccggagaguuugugugcaguuuggggaagagaaccugugcaagauuaucgacaugaaugauuguuucgugucucgccaugucaaagugugcauuaucggcaccguuagcaaguuuucccagggagacacccuucucuucuuuggcccucuggaagggggaggccugauuuucaaacacugguguacaucuaccugccaguuuggggauccgggagacaucaugagcccccgggauaagggcuuccucuguccugaguuccccggguccuuucgcaaaaagugcaacuucgccacaacgccuaucugugaguacgacggcaauauggugagcggauauaaaaaggucauggcuaccauugauucuuuucaauccuucaacacaagcaccaugcauuuuacagacgaaagaaucgaguggaaggaucccgacggcaugcugcgggaucacauuaacauccuugugaccaaagacauugacuucgauaaucugggggaaaacccuugcaagaucggacuccagacgucuuccauugagggcgccugggggagcggaguuggcuuuacccugacaugucuggugucucuuaccgagugccccacauuccucaccuccaucaaggcuugcgacaaggccaucuguuacggggcggaaagcgucacacugaccagaggccagaauacggugaaaguuuccggaaagggcgggcacagcggaucuacauuuaagugcugucauggcgaggauugcagccagauugggcugcacgccgcugccccgcaucucgacaaagugaacggaaucuccgaagucgaaaauucuaagguguaugaugacggcgcuccucaauguggcauuaaaugcugguucgucaagagcggggaguggaucuccggaaucuuuucuggcaacuggauugugcugaucguucuuuguguguuccuccuguucagccuggugcugcuuuccauucucugccccguccgcaaacacaagaagucuuga

SEQ ID NO: 13407 - RNA, 3408 nt, Artificial Sequence
  derived and/or modified CDS sequence (opt5) from HTNV(Aa14-175)__KU207163.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccgagcaacaggugaacuuuguuugucaacggguggaugucgacauugugguguacugcaacggccagcgcaagguuauccugacgaagacacuugucaucgggcaguguauuuauaccaucaccucccuguucucucuccugcccggaguggcucacagcauugccguggaacugugcgucccuggcuuucauggcugggccacagcugcgcuccuggugaccuucuguuuuggguggguucuuauccccgccauuacauucaucauucugacgauccucaaauuuaucgcuaauauuuuccacaccuccaaccaagagaauagacuuaagagcgugcugcggaaaaucaaggaagaguuugagaaaacaaagggaucuauggucugcgauguguguaaguacgaaugcgagaccuauaaagaacugaaggcccauggcguuuccugcccucagagccagugucccuacugcuucacacacugugagccgaccgaagccgcuuuucaggcccauuauaaagugugccaagucacgcaccgcuucagagacgaucucaagaaaaccgugacaccucagaacuucacccccggguguuaccggacacugaaucuguuucgcuauaagucuagaugcuacauuuucaccauguggaucuuucuccugguucuugaguccauucugugggcggcuagcgccucugagacgccucucacacccguguggaacgacaaugcccacggagucggcagcgugccuaugcauaccgaucuggaacuggacuucucccuuacauccucuuccaaguacaccuaucggagaaaacucaccaacccccuggaggaagcucagagcaucgaucugcacaucgagauugaggaacagacaaucgggguggacguccaugcccucggccacugguuugauggacgccugaaucuuaagacguccuuccacuguuacggcgcuugcaccaaauaugaguacccguggcauacagccaagugucacuaugaacgggacuaccaauaugagaccucuugggggugcaacccuagcgacugucccggaguuggcacagggugcaccgcgugcggacuguaccucgauagacugaaacccgugggcuccgccuacaagauuaucacgauucgcuauucucggagaguguguguccaguuuggggaagagaaucugugcaagaucaucgacaugaacgauuguuucgugagccgccauguuaaagugugcauuaucggcacagucuccaaguuuucucagggagacacccuucucuucuuuggcccucuggaagggggaggccugauuuucaaacacugguguaccagcacaugccaguuuggggauccgggagacaucaugagcccccgggauaagggcuuccucuguccugaguuccccgggagcuuuagaaagaagugcaauuucgcuaccacaccuauuugugaauacgacggcaacauggugucuggauauaaaaagguuauggccacgaucgauuccuuucagagcuucaauaccucuacaaugcauuuuaccgacgaacgcaucgaguggaaggaucccgacggcaugcugcgggaucacauuaacauccuugugacaaaagacauugacuucgauaaccugggggaaaauccuugcaagaucggacuccagaccuccagcauugagggcgcuugggggucuggagucggcuuuacgcugaccugucuggugucccuuacagagugccccaccuuccucacaagcaucaaagccugcgacaaggcgauuuguuacggggccgaauccguuacccugacaagaggccagaacaccgugaaagucagcggaaagggcgggcacucuggaagcacguuuaagugcugucauggcgaggauugcucccagaucgggcugcacgcugccgcuccgcaucucgacaaagugaauggaaucucugaaguggagaacagcaaggucuaugaugacggcgccccucaauguggcauuaaaugcugguucguuaaguccggggaauggaucucuggaauuuuuagcggcaauuggaucgugcugauugugcuuugugucuuccuccuguucucccuggugcugcuuucuauccucugccccguucgcaaacacaaaaagagcuga

SEQ ID NO: 13408 - RNA, 3408 nt, Artificial Sequence
  derived and/or modified CDS sequence (opt5) from HTNV(Aa14-184)__KU207164.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugaucgaggaguccuaucgcagcagaaagucuauuaccuguuacgaucuguccugcaauaacacguauuguaaaccuacccuguacaugaucgugcccauccaugcuugcaauaugaugaaaagcugucucauugcccugggaccuuaucggguccaggugguguacgaacgcacauacugcaugaccggcguccuuaucgaggggaaauguuucguuccggaccagucugugguguccauuaucaagcacggaauuuuugauaucgccagcguccauauugugugcuucuuuguugcugugaaaggcaacacauauaagaucuucgaacaggucaagaaauccuuugagucuaccuguaaugacacggagaacaaggugcaaggcuacuauaucugcauuguugggggaaauagcgcccccaucuacgugccuacacuggaugacuucagauccauggaggcuuuuaccggcauuuuccggagcccccacggggaggaucacgaccucgccggagaagagacagcgaccuauucuaucgucggcccugccaacgcuaaagugccccauuccgccagcucugauacccugagccuuauugcuuuuuccgggaucccgucuuacagcucccugagcauccucacaucuuccacggaagccaagcacgucuucagcccuggacuguuucccaaacugaaucauaccaacugcgacaagggcgcgauuccucucauguggacaggcaugaucgaccugcccggguauuacgaggccauucaccccuguaccguguucugcguucuuucuggaccuggcgcuuccugugaggccuucagcgaagggggaaucuuuaauauuacauccccgaugugccuggugucuaaacagaaccgcuucagacucaccgagcagcaggucaacuuugugugucaacggguugauguggacaucgucguguacugcaauggccagcgcaaggugauccugacgaagacacuuguuauugggcaguguaucuauaccauuaccagccuguucucccuccugcccggagucgcucacucuaucgccguggaacugugcgugccuggcuuucauggcugggccacagcugcgcuccuggucaccuucuguuuugggugggugcuuauucccgccaucacauucauuauccugacgauccucaaauuuauugcuaacaucuuccacaccagcaaucaagagaacagacugaaguccguucuucggaaaauuaaggaagaguuugagaaaacaaagggaagcauggugugcgaugucuguaaguacgaaugcgagaccuauaaagaacugaaggcccauggcgugucuugcccucagucccagugucccuacugcuucacacacugugagccgaccgaagccgcuuuucaggcccauuauaaaguuugccaagugacgcaccgcuucagagacgaucucaagaaaaccgucacaccucagaauuucacccccggguguuaccggacacugaaccuguuucgcuauaagagcagaugcuacaucuucaccauguggauuuuucuccuggugcuugagucuauccugugggcggcuuccgccagcgagacgccucucacacccguuuggaaugacaacgcccacggagugggcucugucccuaugcauaccgaucuggaacuggacuucagccuuacauccagcucuaaguacaccuaucggagaaaacucaccaauccccuggaggaagcucaguccaucgaucugcacauugagaucgaggaacagacaauugggguggacgugcaugcccucggccacugguuugauggacgccugaaccuuaagacgagcuuccacuguuacggcgcuugcaccaaauaugaguacccguggcauacagccaagugucacuaugaacgggacuaccaauaugagaccuccugggggugcaauccuucugacugucccggagucggcacagggugcaccgcgugcggacuguaccucgauagacugaaacccguuggcagcgccuacaagaucauuacgauccgcuauucccggagagugugugugcaguuuggggaagagaaccugugcaagaucauugacaugaaugauuguuucgucucucgccaugugaaaguuugcaucauuggcacagugagcaaguuuucccagggagacacccuucucuucuuuggcccucuggaagggggaggccugaucuucaaacacugguguaccucuacaugccaguuuggggauccgggagacauuaugagcccccgggauaagggcuuccucuguccugaguuccccggguccuuuagaaagaagugcaacuucgcuaccacaccuaucugugaguacgacggcaauauggucagcggauauaaaaaggugauggccacgaucgauucuuuucaauccuucaacaccagcacaaugcauuuuaccgacgaacgcauugaguggaaggaucccgacggcaugcugcgggaucacaucaacauucuuguuacaaaagacaucgacuucgauaaucugggggaaaacccuugcaagauuggacuccagaccucuuccaucgagggcgcuugggggagcggagugggcuuuacgcugaccugucuggucucucuuacagagugccccaccuuccucacauccauuaaagccugcgacaaggcgaucuguuacggggccgaaagcgugacccugacaagaggccagaauaccguuaaaguguccggaaagggcgggcacagcggaucuacguuuaagugcugucauggcgaggauugcagccagaucgggcugcacgcugccgcuccgcaucucgacaaagucaacggaauuuccgaaguggaaaauucuaagguguaugaugacggcgccccucaauguggcaucaaaugcugguucgucaagagcggggaauggauuuccggaaucuuuucuggcaacuggauuguucugaucgugcuuuguguguuccuccuguucagccugguccugcuuuccauccucugccccgugcgcaaacacaagaagucuuga

SEQ ID NO: 13409 - RNA, 3408 nt, Artificial Sequence
  derived and/or modified CDS sequence (opt5) from HTNV(LR1)__AF288293.1__GP
augggcaucuggaaguggcuggugauggccagccucgucuggcccguucugacccuuagaaacguguacgacaugaagauugagugcccucacacaguguccuucgggggaaauucugucaucggcuauguggaacugccgcccguuccucucgcugauacggcccagauggugcccgagagcuccuguucuauggacaaccaucaaagccugaauaccauuacaaaguacacccaggucuccuggcgggggaaagcggaucagucucagagcucccaaaacagcuuugaaacagugucuaccgagguugaccuuaagggaacaugcgugcugaaacacaagauggucgaagaguccuaucgcagcagaaagucugugaccuguuacgaucucuccugcaauagcacguauuguaaaccuacccuguacaugaucgugcccauucaugcuugcaacaugaugaagucuugucugaucgcccucggcccuuaucggguccagguuguguacgagcgcacauacugcaugaccggggugcugaucgaaggaaaauguuucgucccggaccaguccgugguuagcauuaucaagcacggcauuuuugauaucgccuccgugcauauugucugcuucuuuguggcuguuaaaggcaauacauauaagaucuucgaacaggugaagaaaucuuuugaaagcaccuguaacgacacggagaauaagguccaaggguacuauauuugcaucgugggaggcaacuccgcccccaucuacgucccuacacuugaugacuucagaagcauggaggcuuuuaccgggauuuuccggucuccccacggagaagaucgcgaccuggccggcgaggaaaucgcguccuauagcauuguggggccugccaaugcuaaaguuccccacucugccagcuccgauacacucagacugaucgcuuacucugggauuccgagcuauuccagccuuucuauccugaccuccagcaccgaggccaagcauguguuuucuccuggccucuuccccaaacugaaccacacaaauugcgacaaguccgcgaucccucugauuuggacgggcaugaucgaccuccccggguacuacgaagccguccaucccuguaccguguuuugcguucugagcggaccuggcgcuuccugugaggccuucucugagggaggaauuuucaacaucacaagcuccaugugccuugugucuaaacagaaucgguuucgccugaccgaacagcaggucaacuucgugugucaaagaguggauauggacauuguugucuauugcaacggccagcggaaggugauccucacaaagacccuggugaucgggcaguguauuuacacgaucacaagccuuuuuagccugcucccgggagucgcucacagcauugccguggagcugugcguucccggcuuccacggcugggccaccgcugcgcugcucgugaccuuucgcuucggguggguccugaucccugccauuacauuuaucauucuuaccgugcugaaauucaucgcuaauaucuuucauacaucuaaccaagaaaauagacucaaguccguucugcggaaaauuaaggaggaguucgagaaaacgaagggaagcauggugugugaugucugcaaguaugagugugaaaccuacaaagagcuuaaggcccacggcgugucuugcccccagucccagugcccuuauuguuuuacacauugcgaacccaccgaggccgcuuuccaggcccacuacaaaguuugucaagugacacaucgcuuuagagacgggcugaagaaaaccgucacgccgcagaacuucaccccuggaugcuaucggacacucaaucuguucagauacaagagccgcuguuacaucuuuaccauguggauuuuccugcucgugcuggaaucuauccuuugggcggcuagcgccuccgagacaccccugaccccuguguggaacgauaaugcccacggcgucgggagcguucccaugcacacggaccucgagcuggauuuuucucugacauccagcuccaaguauaccuaccggagaaaacuuacaaacccucucgaagaggcucagucuauugaccugcauaucgaaaucgaggagcagaccauuggcguggaugugcacgcccugggacauugguucgacggccgccucaaucugaagaccagcuuucacugcuauggggcuuguacaaaauacgaauaucccuggcacacggccaagugccauuacgagcgggauuaucaauacgaaaccuccuggggauguaacccgucugacugcccuggcgucgggacaggauguaccgcgugcggccuuuaccuggaccagcucaaacccguggggagcgccuauaagaucauuacaaucagauacucccgccggguuugcgugcaguucggcgaggaaaaucuguguaagauuaucgauaugaacgacugcuuugucucuagacacgugaaaguuuguaucauuggaaccgugagcaaguucucccagggcgauacgcugcucuuuuucgggccccucgagggaggcgggcugaucuuuaaacauuggugcacaagcaccugucaauucggagacccuggcgauauuaugucuccgcgcgacaagggguuucugugccccgaguucccuggcuccuuccggaaaaaguguaauuuugcuaccacacccaucugcgaauaugauggaaacauggucagcggcuacaaaaaggugauggccaccauugacucuuuccaguccuuuaauacaagcacgaugcacuucaccgaugagagaaucgaauggaaggacccugaugggaugcuccgcgaccauaucaacauucugguuacaaaagauaucgacuuugacaaccuuggagagaaucccuguaagauuggccugcagaccucuuccaucgaaggggcuuggggaagcggcgugggguucacacuuaccugccuggucucccugacggaguguccuaccuuucuuacaagcauuaaagccugcgauaaggcgaucugcuauggcgccgagucuggaacccucacacggggccagaacaccgugaaagugagcgggaagggaggccacuccgggucuacauucaaguguugccacggagaagacuguagccaaauuggccugcaugcugccgcuccccaccuggauaaagucaauggcaucuccgagaucgaaaacucuaagguuuacgacgauggggccccgcagugcggaauuaaauguugguuugugaaguccggcgaguggaucuccgggauuuucucuggaaauuggaucgugcucauuguccugugcguguuucuucuguucagccucguucugcuguccaucccuugucccgugagaaaacauaaaaagagcuga

SEQ ID NO: 13410 - RNA, 3408 nt, Artificial Sequence
  derived and/or modified CDS sequence (opt5) from HTNV(SN7)__AF288656.1__GP
augggcguguggaaguggcuggucauggccagccucguuuggcccgcuugcacccugagaaacguguacgacaugaaaaucgaguguccucacacaguguccuucggggaaaauucugucauuggauauguggagcuuccgcccaugccucuggccgauacgacccagcucguucccgaaagcuccugcucuauggacaaccaucaaagccugaauacaaucaccaaguacacacagguguccuggcggaaaaaggcggaucaggcucagucuagccaaaacuccuuugagaccgucagcguggaaguugaccuuaaaggcacaugugugcugaagcacaagaugauugaggagucuuaucgcuccagaaaaagcauuaccugcuacgaucucucuuguaauuccacguauugcaagccuacccuguacaugaucguccccauccaugccuguaacaugaugaaaagcugccugaucgcccucgggccuuaucggguucagguggucuacgaacgcacauacuguaugaccggaguucugauugagggcaagugcuucgugccggaccagucuguggucuccaucauuaaacacgggaucuuugauauugcuagcgugaagaucguuuguuucuuuguggccgucaagagaaauacauauaaacuuuucgaacaggugaagaaauccuuugacucuaccugcaacgauacggagaauaagguucaaggauacuauauuugcaucgugggcggcaacagcgcucccaucuacgucccuacacuggacgauuuccgguccauggaggccuuuagcgggauuuuccgcucuccccauggagaagaccacgaucucgcgggcgaggaaguggccuccuauagcaucgucgggccugcuaaugccaaagugccccacucugcuagcuccgacacccugucucuuauugccuacagcggaaucccguccuauagcucucuguccauucucacaagcucuaccgaggcgaagcauguguuuuccccuggcuucuuuccccagcugaaccacaccaaaugugacaagacagccaucccucugacguggaccgggaugaucgaucuccccggauacuacgaagcuauucaucccugcacaguguucuguguccugagcggcccuggcgccuccugcgaggcuuucucugaagggggaaucuuuaauauuaccagcccgaugugucuuguguccaagcagaacagauuccggcugacagagcagcaaguuaauuuugugugccagcgcgucgacauggauaucgugguguauuguaacggccagagaaaaguuauucucaccaagacgauggucaucgggcaaugcaucuacacaauuaccucucuguucagccuucugcccggaguggcccacuccaucgccguggagcucugugucccuggcuuucacgggugggcuaccgcggcccugcuggugacauucugcuuuggauggguucucauucccgcugugaccuucaucauucugacaguccuuaaauuuguggccaacaucuuccauacgagcaaucaggaaaaccggcugaagucuguucuccgcaaaauuaaggaggaauuugagaagaccaaaggcuccauggugugugacgucugcaaguaugagugcgaaacauacaaagagcugaaggcccacggcgugagcuguccucagucucagugccccuauuguuucacccauugcgaaccgacagaggcugccuuucaagcgcacuacagaguuugucaggugacccaucgguuccgcgaugaccuuaaaaagacggucaccccucagaauuucacacccgggugcuauagaacccugaaccucuuucgguacaaguccagauguuacaucuucacaauguggguguuucugcuggugcucgaaagcauccugugggcugccucugccagcgaggucccucuuaaucccauuuggaacgauaaugcucacggaguuggcuccgugccuaugcacaccgaccuggagcucgauuucagccugacgucuuccagcaaauauacauaccgccggaagcugaccaacccccuugaagagacacaggccaucgaccuccauauugaaaucgaggagcaaaccauugggguggauguccacgcucugggacauugguuugacggcagacugaaucucaaaaccuccuuccacugcuauggggccuguacaaaguacgaauauccguggcacacggcgaaaugccauuacgagcgcgacuaucaguacgaaaccucuuggggcuguaacccuagcgauugccccggagugggcacagggugcaccgccuguggacuguaccuugaccagcugaagcccguuggcuccgcuuauaagaucaucacaauucgguacucuagacgcgugugcguccaguuuggggaggaaaaucucuguaaagugaucgauaugaacgacugcuucguuagccggcacgugaaggucuguauuaucggaaccguguccaaauuuucucaaggcgauacgcugcuguucuuugggccucuugagggcggaggccucauuuucaagcauuggugcacaagcaccugucaguuuggggacccgggagauaucaugucccccagagacaaaggcuuccugugcccugaguuccccgggagcuuucgcaagaaauguaauuucgccaccacaccucugugcgaauaugauggaaacaugaucucuggcuacaagaagguuauggcuaccauugacuccuuucagagcuucaauacaucuacgaugcacuuuaccgaugagcggaucgaauggaaagaccccgaugggaugcucagagaccauauuaacauccuggugacaaaggacauugauuucgacaaccuuggcgagaauccuuguaaaaucggacugcagaccuccagcaucgaaggcgccugggggucuggagucggcuuuacacugaccugccucgugucccugacggagugccccaccuuccuuacaagcauuaaggcgugugauaaagccaucugcuauggggcugaguccgugacccucacacgcggacaaaacaccgucaagguuagcggcaaagggggccacucuggaagcacauuuaaguguugccacggcgaagacuguucccagaccgggcugcaugccgcugccccgcaccuggauaaggugaauggaauuucugagagcgaaaacuccaaaguguacgacgauggcgccccucagugcgggaucaaguguugguucgucaaaucuggagaguggauuagcggcaucuuuuccggcaauuggauugugcucaucguucugugcguguuccuucuguucucucucguccugcugagcgugcuuugucccguucggaagcauaagaaauccuga

SEQ ID NO: 13411 - RNA, 3408 nt, Artificial Sequence
  derived and/or modified CDS sequence (opt5) from HTNV(84FLi)__AF366569.1__GP
augggcguguggaaguggcuggucauggccagccucguuuggcccgcuugcacccugagaaacguguacgacaugaaaaucgaguguccucacacaguguccuucggggaaaauucugucauuggauauguggagcuuccgcccaugccucuggccgauacgacccagcucguucccgaaagcuccugcucuauggacaaccaucaaagccugaauacaaucaccaaguacacacagguguccuggcggaaaaaggcggaucaggcucagucuagccaaaacuccuuugagaccgucagcguggaaguugaccuuaaaggcacaugugugcugaagcacaagaugauugaggagucuuaucgcuccagaaaaagcauuaccugcuacgaucucucuuguaauuccacguauugcaagccuacccuguacaugauuguccccauccaugccuguaacaugaugaaaagcugccugaucgcccucgggccuuaucggguucagguggucuacgaacgcacauacuguaugaccggaguucugauugagggcaagugcuucgugccggaccagucuguggucuccaucauuaaacacgggaucuuugauauugcuagcgugaagaucguuuguuucuuuguggccgucaagggaaauacauauaaacuuuucgaacaggugaagaaauccuuugacucuaccugcaacgauacggagaauaagguucaaggcuacuauauuugcaucgugggcgggaacagcgcucccaucuacgucccuacacuggacgauuucagauccauggaggccuuuagcggaauuuuccggucuccccauggcgaagaccacgaucucgcgggggaggaaguggccuccuauagcaucgucggaccugcuaaugccaaagugccccacaacgcuucuagcgacacccugucccuuauugccuacucuggcaucccgagcuauuccagccugucuauucucacauccagcaccgaggcgaagcauguguuuucuccuggguucuuuccccagcugaaucacaccaaaugugacaagacagccaucccucugacguggaccggaaugaucgaucuccccggcuacuacgaagcuauucaucccugcacaguguucuguguccuguccggcccuggggccagcugcgaggcuuucuccgagggaggcaucuuuaacauuaccucuccgaugugucuugugagcaagcagaaucgcuucagacugacaaaacagcaaguuaacuuugugugccagcgggucgacauggauaucgugguguauuguaacgggcagcgcaagguuauucucaccaaaacgauggucaucggacaaugcaucuacacaauuaccucccuguucucucuucugcccggcguggcccacagcaucgccguggaacucugugucccuggguuucacggaugggcuaccgcggcccugcuggugacauucugcuuuggcuggguucucauucccgcugugaccuucaucauucugacaguccuuaaguuuguggccaauaucuuccauacguccaaccaggagaauagacugaaaagcguucuccggaagauuaaggaagaguuugagaaaaccaagggcucuauggugugugacgucugcaaauaugagugcgagacauacaaggaacugaaagcccacgggguguccuguccucagagccagugccccuauuguuucacccauugcgagccgacagaagcugccuuucaagcgcacuaccgcguuugucaggugacccauagauuccgggaugaccuuaagaagacggucaccccucagaacuucacacccggaugcuaucgcacccugaaucucuuuagauacaaaucucgguguuacaucuucacaauguggguguuucugcuggugcucgaguccauccugugggcugccagcgccucugaagucccucuuaaccccauuuggaaugauaacgcucacggcguugggagcgugccuaugcacaccgaccuggagcucgauuucucccugacgucuucuuccaaguauacauacagacgcaaacugaccaauccccuugaggaaacacaggccaucgaccuccauauugagaucgaagaacaaaccauuggaguggauguccacgcucugggccauugguuugacgggcggcugaaccucaagaccagcuuccacugcuauggcgccuguacaaaauacgaguauccguggcacacggcgaagugccauuacgaaagagacuaucaguacgagaccuccuggggauguaauccuucugauugccccggcguggggacaggaugcaccgccuguggccuguaccuugaccagcugaagcccguugggagcgcuuauaaaaucaucacaauucgcuacucccggagagugugcguccaguuuggagaagagaaccucuguaaggugaucgauaugaaugacugcuucguuucucgccacgugaaagucuguauuaucggcaccgugagcaaguuuucccaaggggauacgcugcuguucuuuggcccucuugaaggaggcgggcucauuuucaaacauuggugcacaucuaccugucaguuuggagacccgggcgauaucaugagcccccgggacaagggguuccugugcccugaguuccccggauccuuucgcaaaaaguguaacuucgccaccacaccucugugcgaguaugauggcaauaugaucagcggguacaagaaaguuauggcuaccauugacucuuuucaguccuucaacacaagcacgaugcacuuuaccgaugaaagaaucgaguggaaggaccccgauggcaugcuccgggaccauauuaacauccuggugacaaaagacauugauuucgacaaucuuggagaaaacccuuguaagaucggccugcagaccucuuccaucgagggggccuggggaagcggcgucggguuuacacugaccugccucgugucucugacggaaugccccaccuuccuuacauccauuaaagcgugugauaaggccaucugcuauggagcugagagcgugacccucacaagaggccaaaauaccgucaagguuuccgggaaaggcggacacagcggcucuacauuuaaguguugccacggggaggacuguagccagaccggacugcaugccgcugccccgcaccuggauaaagugaacggcauuuccgaaaucgagaauagcaagguguacgacgauggggccccucagugcggaauuaaauguugguucgucaagagcggcgaauggaucuccggcaucuuuucugggaacuggaucgugcucaucguucugugcguguuccuucuguucagccucguccugcuguccgugcuuugucccguucgcaagcauaaaaagucuuga

SEQ ID NO: 13412 - RNA, 3408 nt, Artificial Sequence
  derived and/or modified CDS sequence (opt5) from HTNV(Aa08-1111)__KY594715.1__GP
augggcaucuggaaguggcuggugauggccagccucgucuggcccguuuucacccugagaaacguguacgacaugaaaauugagugcccucacacaguguccuuuggggaaaauucugucaucggauauguggagcuuccgcccaugccucuggcugauacggcccagaugguucccgaaagcuccuguucuauggacaaccaucaaagccucaauaccauuacaaaguacacccagguguccuggcggggcaaagcggaucagucucagagcucccaaaacagcuucgagacagucucuaccgaaguggaccugaaggggacaugcguucuuaaacacaagaugguggaggaguccuaucgcagcagaaagucuaucaccuguuacgaucuguccugcaauagcacguauuguaaaccuacccucuacaugauuguccccauccaugcuugcaacaugaugaagucuugucugaucgcccugggaccuuaucggguccaggugguguacgaacgcacauacugcaugaccggcguucucauugaggggaaauguuuugugccggaccaguccguggucagcaucauuaagcacggaaucuucgauauugccuccgugcauaucguuugcuuuuucguggcugucaaaggcaauacauauaagauuuuugaacaggugaagaaaucuuucgagagcaccuguaacgacacggagaauaagguucaaggcuacuauaucugcaucgucgggggaaacuccgcccccauuuacgcuccuacacuggaugacuuuagaagcauggaagccuucaccggcaucuuucggucuccccacggggaggaucacgaccuugcgggagaagagauugccuccuauagcaucgugggcccugcuaaugccaaagugccccauucugcuagcuccgauacacugucucucauugccuacagcgggaucccguccuauagcucucuguccaucauuaccagcucuaccgaagcgaagcacgucuucuccccuggacuuuuucccaaacugaaccauacaaauugcaacaagggcgccaucccucucauuuggacgggcaugaucgaccugcccggguacuacgaggcugugcaccccuguaccguuuucugcgugcugagcggaccuggcgccuccugugaggcuuucucugaagggggaauuuuuaauaucacaagcccgaugugccucgucuccaaacagaaccgcuucagacugaccgagcaacaggugaacuuuguuugucagcggguggacauggauaucgucguguauugcaauggccagcgcaaggugauucuuacaaagacccugguuaucgggcaguguauuuacacgaucacaucucucuucagccugcuucccggagucgcccacuccauugccguggaacugugcgugccuggcuuucauggcugggcuaccgcggcccuccuggucaccuucuguuuugggugggugcugauccccgcuauuacauucaucauccucaccguucugaaauuuauugccaacaucuuccacacaagcaaucaagagaacagacuuaagucugugcugcggaaaauuaaggaagaguuugagaaaacgaagggauccauggucugcgacaucuguaaguaugaaugcgagaccuacaaagaacucaaggcccauggcgugagcugcccucagucucagugucccuauugcuucacacacugugagccgaccgaagcugccuuucaggcgcauuacaaaguuugccaagugacacaccgcuucagagaugaccugaagaaaaccgucacgccucagaauuucacccccggguguuaucggacacuuaaccuguuucgcuacaaguccagaugcuacauuuucaccauguggaucuuucuccuggugcuggagagcauccucugggcugccucugccagcgagacaccucugacccccguuuggaaugauaacgcucacggagugggcuccgucccuaugcauacggaccuugaacuggauuucagccucacaucuuccagcaaguauaccuaccggagaaaacugacaaauccccuggaggaagcccaguccauugggcuucacaucgagauugaggaacagaccaucggcguggacgugcaugcucucggacacugguuugauggccgccugaaccugaagaccucuuuccacuguuauggggccugcacaaaauacgaguauccguggcauacggcgaagugucacuacgaacgggacuaucaauacgagaccagcuggggaugcaauccuuccgauugucccggcgucgggacaggaugcaccgccugcggccucuaccuggaccagcuuaaacccguugggucugcuuauaagauuaucacaaucagauacagccgccgggugugugugcaguuuggcgaagaacaucugugcaagauuaucgacaugaacgauuguuucgucuccagacacgugaaaguuugcauuaucggaaccgugucuaaguuuagccagggcgacacgcuccuguucuuugggccucuggagggaggcgggcuuauuuucaaacauugguguacauccacaugccaauuuggagauccgggcgacaucaugagcccccgcgauaagggguuccucuguccugaguuccccggcucuuuucggaaaaagugcaauuucgccaccaccccuaucugugaguaugacggaaacauggucuccggcuacaaaaaggugauggcuaccauugauagcuuucagucuuucaauacauccacgaugcacuuuaccgacgaaagaaucgaguggaaggaucccgacgggaugcugcgcgaucacauuaacauccugguuacaaaagacauugauuucgacaaccucggagaaaauccuugcaagaucggccugcagaccagcucuauugagggggccuggggauccggcgugggguuuacacuuaccugucuggucagccucacggagugccccaccuuccugacauccaucaaagcgugcgacaaggccaucuguuauggcgcugaaagcgugacccugacacggggacagaacaccguuaaagugucuggcaaagggggacauagcggcuccacauuuaagugcugucacggggaggaaugcucucaaauuggacuucaugccgcugccccgcaccucgauaaggucaauggcaucagcgagauugaaaacuccaagguguacgacgauggcgccccucagugugggaucaaaugcugguucgugaagucuggagaguggauuagcggcaucuuuuccgggaauuggaucguccugauuguucuguguguguuccuccuguucucucuugugcugcucagcauccugugccccgucagaaaacauaagaaguccuga

SEQ ID NO: 13413 - RNA, 3408 nt, Artificial Sequence
  derived and/or modified CDS sequence (opt5) from HTNV(Aa09-189)__KY594716.1__GP
augggcaucuggaaguggcuggugauggccagccucgucuggcccguuuucacccugagaaacguguacgacaugaaaauugagugcccucacacaguguccuuuggggaaaauucugucaucggauauguggagcuuccgcccaugccucuggcugauacggcccagaugguucccgaaagcuccuguucuauggacaaccaucaaagccucaauaccauuacaaaguacacccagguguccuggcggggcaaagcggaucagucucagagcucccaaaacagcuucgagacagucucuaccgaaguggaccugaaggggacaugcguucuuaaacacaagaugguggaggaguccuaucgcagcagaaagucuaucaccuguuacgaucuguccugcaauagcacguauuguaaaccuacccucuacaugauuguccccauccaugcuugcaacaugaugaagucuugucugaucgcccugggaccuuaucggguccaggugguguacgaacgcacauacugcaugaccggcguucucauugaggggaaauguuuugugccggaccaguccguggucagcaucauuaagcacggaaucuucgauauugccuccgugcauaucguuugcuuuuucguggcugucaaaggcaauacauauaagauuuuugaacaggugaagaaaucuuucgagagcaccuguaacgacacggagaauaagguucaaggcuacuauaucugcaucgucgggggaaacuccgcccccauuuacgcuccuacacuggaugacuuuagaagcauggaagccuucaccggcaucuuucggucuccccacggggaggaucacgaccuugcgggagaagagauugccuccuauagcaucgugggcccugcuaaugccaaagugccccauucugcuagcuccgauacacugucucucauugccuacagcgggaucccguccuauagcucucuguccaucauuaccagcucuaccgaagcgaagcacgucuucuccccuggacuuuuucccaaacugaaccauacaaauugcgacaagggcgccaucccucucauuuggacgggcaugaucgaccugcccggguacuacgaggcugugcaccccuguaccguuuucugcgugcugagcggaccuggcgccuccugugaggcuuucucugaagggggaauuuuuaacaucacaagcccgaugugccucgucuccaaacagaaucgcuucagacugaccgagcaacaggugaacuuuguuugucagcggguggauauggacaucgucguguauugcaacggccagcgcaaggugauucuuacaaagacccugguuaucgggcaguguauuuacacgaucacaucucucuucagccugcuucccggagucgcccacuccauugccguggaacugugcgugccuggcuuucauggcugggcuaccgcggcccuccuggucaccuucuguuuugggugggugcugauccccgcuauuacauucaucauccucaccguucugaaauuuauugccaauaucuuccacacaagcaaccaagagaauagacuuaagucugugcugcggaaaauuaaggaagaguuugagaaaacgaagggauccauggucugcgauaucuguaaguaugaaugcgagaccuacaaagaacucaaggcccauggcgugagcugcccucagucucagugucccuauugcuucacacacugugagccgaccgaagcugccuuucaggcgcauuacaaaguuugccaagugacacaccgcuucagagacgaucugaagaaaaccgucacgccucagaacuucacccccggguguuaucggacacuuaaucuguuucgcuacaaguccagaugcuacauuuucaccauguggaucuuucuccuggugcuggagagcauccucugggcugccucugccagcgagacaccucugacccccguuuggaacgacaaugcucacggagugggcuccgucccuaugcauacggaucuugaacuggacuucagccucacaucuuccagcaaguauaccuaccggagaaaacugacaaacccccuggaggaagcccaguccauugggcuucacaucgagauugaggaacagaccaucggcguggaugugcaugcucucggacacugguuugacggccgccugaaucugaagaccucuuuccacuguuauggggccugcacaaaauacgaguauccguggcauacggcgaagugucacuacgaacgggauuaucaauacgagaccagcuggggaugcaacccuuccgacugucccggcgucgggacaggaugcaccgccugcggccucuaccuggaccagcuuaaacccguugggucugcuuauaagauuaucacaaucagauacagccgccgggugugugugcaguuuggcgaagaacaucugugcaagauuaucgauaugaaugacuguuucgucuccagacacgugaaaguuugcauuaucggaaccgugucuaaguuuagccagggcgauacgcuccuguucuuugggccucuggagggaggcgggcuuauuuucaaacauugguguacauccacaugccaauuuggagacccgggcgauaucaugagcccccgcgacaagggguuccucuguccugaguuccccggcucuuuucggaaaaagugcaacuucgccaccaccccuaucugugaguaugauggaaauauggucuccggcuacaaaaaggugauggcuaccauugacagcuuucagucuuucaacacauccacgaugcacuuuaccgaugaaagaaucgaguggaaggaccccgaugggaugcugcgcgaccacauuaauauccugguuacaaaagauauugacuucgacaaccucggagaaaacccuugcaagaucggccugcagaccagcucuauugagggggccuggggauccggcgugggguuuacacuuaccugucuggucagccucacggagugccccaccuuccugacauccaucaaagcgugcgauaaggccaucuguuauggcgcugaaagcgugacccugacacggggacagaauaccguuaaagugucuggcaaagggggacauagcggcuccacauuuaagugcugucacggggaggaaugcucucaaauuggacuucaugccgcugccccgcaccucgacaaggucaacggcaucagcgagauugaaaauuccaagguguacgaugacggcgccccucagugugggaucaaaugcugguucgugaagucuggagaguggauuagcggcaucuuuuccgggaacuggaucguccugauuguucuguguguguuccuccuguucucucuugugcugcucagcauccugugccccgucagaaaacauaagaaguccuga

SEQ ID NO: 13414 - RNA, 3408 nt, Artificial Sequence
  derived and/or modified CDS sequence (opt5) from HTNV(CJilin93)__AY748307.1__GP
augggcauguggaaguggcuggugaucgccagccucgucuggcccgcucuggcccuuagaaacguuuacgacaugaaaauugagugcccucacaccguguccuucggggaaaauucugugaucggauaugucgagcugccgcccaugccucucgcggauacagcucagauggugcccgaaagcuccuguucuauggacaaccaucaaagcauuaauacgaucaccaaguacacacagguuaccuggcggggcaaagccgauccugggcaguccucucagaacagcuuugagacacuguccgccgaaguggaccuuaagggaaccugcguccugaaacacaagaugguggaggagagcuaucgcucuagaaaguccauuacauguuacgaucucagcugcaauucuaccuauuguaaacccacgcuguacaugaucguuccuauccaugcuugcaacaugaugaaguccugucugauugcccucggcccguaucgggugcaagucguguacgaacgcaccuacugcaugacaggggugcugaucgagggaaaauguuucguccccgaccagagcguugugucuauuaucaagcacggcauuuuugauaucgcuuccgugcauauugucugcuucuuuguggccguuaaaggcaauaccuauaaacuuuucgaacaggugaagaagucuuuugaguccacauguaacgacaccgagaauaagguccagggguacuauaucugcaucgugggaggcaacucugcgccuauuuacguucccacgcuggaugacuucagaagcauggaagccuuuacagggaucuucaaauccccucacggagaggaucacgaccucgcuggcgaagagauugccagcuauucuaucguggggcccgcuaaugccaaggucccgcauuccgcgagcucugauacccugagccuuauugccuacuccggaaucccuucuuauagcucccugagcauccucacaucuuccaccgacgcuaaacacguguuuagccccggccuguucccuaagcugaaccauaccaauugcgacaaaucugccauuccccucacauggacgggcaugaucgaucugcccggguacuacgaagcuauucacccuuguaccgucuuuugcgugcuuuccggaccgggcgccagcugugaggccuucuccgaagggggaaucuucaacauuacaucucccaugugccugguuagcaagcaaaaucgguuucgccucaccgagcaacaggugaacuucgucugucagagaguggacauggauaucguuguguauugcaacggccaacggaaggucauccugacaaaaacccuugugauugggcaguguaucuacacgauuacaucccuguuuucucuccugccuggaguggcucacagcaucgcgguugagcugugcguccccggcuuccauggcugggccaccgcugcccuccuggugaccuauuguuuugggugggugcuuauuccugccaucacauucauuauccugaccguccucaaguuuaucgcuaauauuuuccacacauccaaccaggaaaaucgccugaaaagcgugcuuagaaagaucaaagaggaauuugagaagacgaagggaucuaugguuugcgacguguguaaauacgagugcgaaaccuauaaggagcugaaagcccauggcgucuccugcccccaaagccaguguccguacugcuucacacacugugaaccuaccgaggcggcuuuucaggcccauuauaaggugugccagguuacacaccgguuccgcgaugaccucaaaaagaccgugacgccccaaaacuuuaccccuggguguuacagaacacugaaucuguuccgguacaagucucgcugcuauauuuucaccaugugggucuuucuccugauccuugaauccgugcugugggccgcuagcgccucugagacaccccucaccccuguuuggaacgauaaugcucacggagugggcagcguccccaugcauacggaccuggagcuggauuucucccuuacaagcagcuccaaauacaccuauagacggaagcucacaaacccgcuggaagaggcccagagcauugaccugcacaucgaaaucgaggagcagaccauugggguggaugugcaugcgcucggccacugguuugacggaagacugaauaucaaaaccuccuuccacuguuacggcgccugcacaaaguaugaauacccuuggcauacggcuaaaugucacuaugagcgcgacuaccaguacgaaaccucuugggggugcaaccccagcgauugucccggagucggcacagggugcaccgccugcggacuuuaucuggaccaacucaagccuguuggcuccgcuuacaagauuaucacaauucgguauucuagacgcgugugugugcaguuuggggaggaaaaucugugcaaaaucaucgauaugaacgacuguuucgucagccggcaugugaagguuugcauuaucggcaccguguccaaauuuucucagggagauacgcugcuuuucuuuggcccgcucgaagggggaggccugauuuucaagcacugguguacaagcacaugccaguuuggggaccccggagauaucauguccccuagagacaaaggcuuccugugucccgaguuuccugggagcuuccgcaagaaaugcaauuucgccaccacccccauuugugaguacgauggcaacauggucucuggauauaagaaggugauggcgaccaucgacuccuuucagagcuucaauacaucuacgaugcauuuuaccgaugagcggaucgaauggaaagacccugauggcaugcucagagaccacauuaacauccugguuacaaaggacauugauuucgacaaccuuggggagaaucccugcaaaaucggacugcagaccuccagcauugaaggcgccugggggucuggagugggcuuuacacucaccugucuggucucccugacggagugcccgaccuuccuuacaagcaucaaggcuugcgauaaagccauuuguuacggggcugaguccgugacccucacacgcggccagaacaccguuaaggugagcggaaagggcgggcacucuggaagcacauuuaaaugcugucauggcgaagacugcuccaagaucgggcugcacgccgccgcuccucaucuggauaaagucaauggaaucucugagauugaaaacagcaagguguaugacgauggcgcgccccaguguggcaucaaaugcugguucgugaaguccggggaguggauuucuggaaucuuuagcggcaauuggauuguccucaucguucuguguguguuccuucuguuuucccucgugcugcugucuauccuuugcccuguccggaagcacaaaaagagcuga

SEQ ID NO: 13415 - RNA, 3408 nt, Artificial Sequence
  derived and/or modified CDS sequence (opt5) from HTNV(KHF,clone:4)__LC209208.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgccgauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaggcuuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccaagcaacaggugaacuuuguuugucaacggguggaugucgacauugugguguacugcaacggccagcgcaagguuauccugacgaaaacacuugucaucgggcaguguauuuauaccaucaccucccuguucucucuccugcccggaguggcucacagcauugccguggagcugugcgucccuggcuuucauggcugggccacagcugcgcuccuggugaccuucuguuuuggguggguucuuauccccgccgugacauucauuauccuggcuauucucaaguuuaucgccaauaucuuccacacguccaaccaagaaaauagacugaaaagcguccuucggaagauuaaagaggaauuugagaagaccaagggaucuauggugugcgauguuuguaaauacgagugcgaaacauauaaggagcugaaagcccauggcguguccugcccucagagccagugucccuacugcuucacccacugugaaccgacagaggcugccuuucaggcgcauuauaaggucugccaagugacccaccgcuucagagacgaucucaaaaagacgguuaccccucagaacuucacacccggguguuaccggacccugaaucuguuucgcuauaagucuagaugcuacaucuucacaauguggauuuuucuccuggugcuugaauccauccugugggcugccagcgccucugagaccccucucacgcccgucuggaacgacaaugcucacggagugggcagcauuccuaugcauacagaucuggagcuggacuucucccuuaccuccucuuccaaauacacauaucggagaaagcucaccaacccccuggaagaggcccagagcaucgaucugcacaucgaaauugaggagcagaccaucgggguggacguccaugcucucggccacugguuugauggacgccugaaucuuaaaacauccuuccacuguuacggcgccugcacgaaguaugaauacccguggcauaccgcgaaaugucacuaugagcgggacuaccaauaugaaacaucuugggggugcaacccuagcgacugucccggaguuggcaccgggugcacagccugcggacuguaccucgauagacugaagcccgugggcuccgcuuacaagauuaucaccauucgcuauucucggagaguguguguccaguuuggggaggaaaaucugugcaaaaucaucgacaugaacgauuguuucgugagccgccauguuaaggugugcauuaucggcacggucuccaaauuuucucagggagacacacuucucuucuuuggcccucuggaagggggaggccugauuuucaagcacugguguaccucuaccugccaguuuggggauccgggagacaucaugagcccccgggauaaaggcuuccucuguccugaguuccccgggagcuuuagaaagaaaugcaauuucgccacaaccccuauuugugaauacgacggcaacauggugagcggauauaagaagguuauggcuacaaucgauuccuuucagagcuucaauacgucuaccaugcauuuuacagacgagcgcaucgaauggaaagaucccgacggcaugcugcgggaucacauuaacauccuugugaccaaggacauugacuucgauaaccugggggagaauccuugcaaaaucggacuccagacauccagcauugaaggcgccugggggucuggagucggcuuuacccugacgugucuggugucccuuaccgagugccccacauuccucaccagcaucaaggcgugcgacaaagccauuuguuacggggcugaguccguuacacugaccagaggccagaacacagugaaggucagcggaaagggcgggcacucuggaagcaccuuuaaaugcugucauggcgaagauugcuccccgaaugggcugcacgccgcugccccucaucucgacaaggugaacggaaucucugagaucgaaaauagcaaaguguaugaugacggcgcuccccaguguggcauuaagugcugguucgucaaauccggggaguggaucucuggaauuuuuagcggcaacuggaucguucugauugugcuuuguguguuccuccuguucucccugguccugcuuucuauccucugcccugugcgcaagcacaagaaaagcuga

SEQ ID NO: 13416 - RNA, 3408 nt, Artificial Sequence
  derived and/or modified CDS sequence (opt5) from HTNV(KHF,clone:5)__LC209209.1__GP
augggcaucuggaaguggcuggugauggccagccucgucuggcccguucugacccuuagaaacguguacgacaugaaaauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaagccuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugaccugcccggguauuacgaggccauccaccccuguaccguuuucugcgugcuuuccggaccuggcgcuagcugugaggccuucuccgaagggggaauuuuuaacaucacaucuccgaugugccuggucagcaaacagaaucgcuucagacucaccgagcaacaggugaacuuuguuugucaacggguggaugucgacauugugguguacugcaacggccagcgcaagguuauccugacgaagacacuugucaucgggcaguguauuuauaccaucaccucccuguucucucuccugcccggaguggcucacagcauugccguggaacugugcgucccuggcuuucauggcugggccacagcugcgcuccuggugaccuucuguuuuggguggguucuuauccccgccgugacauucauuauccuggcuauucucaaauuuaucgccaauaucuuccacacguccaaccaagagaauagacuuaagagcguccugcggaaaauuaaggaagaguuugagaaaaccaagggaucuauggugugcgauguuuguaaguacgaaugcgagacauauaaagaacugaaggcccauggcguguccugcccucagagccagugucccuacugcuucacccacugugagccgacagaagcugccuuucaggcgcauuauaaagucugccaagugacccaccgcuucagagacgaucucaagaaaacgguuaccccucagaacuucacacccggguguuaccggacccugaaucuguuucgcuauaagucuagaugcuacaucuucacaauguggauuuuucuccuggugcuugaguccauccugugggcugccagcgccucugagaccccucucacgcccgucuggaacgacaaugcucacggagugggcagcauuccuaugcauacagaucuggaacuggacuucucccuuaccuccucuuccaaguacacauaucggagaaaacucaccaacccccuggaggaagcccagagcaucgaucugcacaucgagauugaggaacagaccaucgggguggacguccaugcucucggccacugguuugauggacgccugaaucuuaagacauccuuccacuguuacggcgccugcacgaaauaugaguacccguggcauaccgcgaagugucacuaugaacgggacuaccaauaugagacaucuugggggugcaacccuagcgacugucccggaguuggcaccgggugcacagccugcggacuguaccucgauagacugaaacccgugggcuccgcuuacaagauuaucaccauucgcuauucucggagaguguguguccaguuuggggaagagaaucugugcaagaucaucgacaugaacgauuguuucgugagccgccauguuaaagugugcauuaucggcacggucuccaaguuuucucagggagacacacuucucuucuuuggcccucuggaagggggaggccugauuuucaaacacugguguaccucuaccugccaguuuggggauccgggagacaucaugagcccccgggauaagggcuuccucuguccugaguuccccgggagcuuuagaaagaagugcaauuucgccacaaccccuauuugugaguacgacggcaacauggugagcggauauaaaaagguuauggcuacaaucgauuccuuucagagcuucaauacgucuaccaugcauuuuacagacgaacgcaucgaguggaaggaucccgacggcaugcugcgggaucacauuaacauccuugugaccaaagacauugacuucgauaaccugggggaaaauccuugcaagaucggacuccagacauccagcauugagggcgccugggggucuggagucggcuuuacccugacgugucuggugucccuuaccgagugccccacauuccucaccagcaucaaagcgugcgacaaggccauuuguuacggggcugaauccguuacacugaccagaggccagaacacagugaaagucagcggaaagggcgggcacucuggaagcaccuuuaagugcugucauggcgaggauugcuccccgaaugggcugcacgccgcugccccucaucucgacaaagugaacggaaucucugaaaucgagaauagcaagguguaugaugacggcgcuccccaguguggcauuaaaugcugguucgucaaguccggggaauggaucucuggaauuuuuagcggcaacuggaucguucugauugugcuuuguguguuccuccuguucucccugguccugcuuucuauccucugcccugugcgcaaacacaaaaagagcuga

SEQ ID NO: 13417 - RNA, 3405 nt, Artificial Sequence
  derived and/or modified CDS sequence (opt5) from HTNV__D00376.1__GP
augggcaucuggaaguggcuggugauggccagccucgucuggcccguucugacccuuagaaacguguacgacaugaagauugagugcccucacacaguguccuucggggaaaauucugucaucggauauguggagcugccgcccaugccucucgcugauacggcccagcugguucccgaaagcuccuguucuauggacaaccaucaaagccuuaauaccauuacaaaguacacccagguguccuggcggggcaaagcggaucagucucagagcucccaaaacagcuuugagacagucucuaccgaaguggaccugaaggggacaugcguucucaaacacaagaugguggaggaguccuaucgcagcagaaagucuaucaccuguuacgaucuguccugcaauagcacguauuguaaaccuacccuguacaugauuguccccauccaugcuugcaacaugaugaagucuugucucaucgcccugggaccuuaucggguccaggugguguacgaacgcacauacugcaugaccggcguucuuauugaggggaaauguuucgugccggaccaguccguggucagcaucauuaagcacggaaucuuugauauugccuccgugcauaucguuugcuucuuuguggcugucaaaggcaauacauauaagauuuucgaacaggugaagaaaucuuuugagagcaccuguaacgacacggagaauaagguucaaggcuacuauaucugcaucgucgggggaaacuccgcccccauuuacgugccuacacuggaugacuucagaagcauggaagccuuuaccggcaucuuccggucuccccacggggaggaucacgaccucgccggagaagagacagcgaccuauuccauugugggcccugccaaugcuaaagucccccauagcgccucuagcgauacccugucccuuaucgcuuuuucugggauuccgagcuacuccagccugucuauccucacauccagcacggaagccaagcacguguucucuccuggacuguuucccaaacugaaccauaccaauugcgacaagggcgcgaucccucucauguggacaggcaugauugacguuccccgcuauuacgaugggauccaccccuucaccguguucuguguccuguccggaccuggcgccagcugcgaggcuuuuuccgaagggggaauuuucaacaucacaucuccgaugugucuugugagcaaacagaauagauuucggcugaccgaacagcagguuaacuucgugugccaacgcgucgacguggauauugugguuuacuguaacggccagagaaaggucauccucacgaagacacuggugaucgggcagugcauuuauaccaucaccucccuuuuuagccugcuccccggaguggcccacagcauugcugucgagcugugugugccuggcuuccauggcugggccacagccgcucugcucguuaccuuuugcuucgggugggugcugauccccgcggucacauuuauuauccuugccauucugaaauucaucgcuaauaucuuucacacguccaaccaagaaaaucggcucaagagcgugcugcgcaaaauuaaggaggaguucgagaaaaccaagggaucuaugguuugugacgugugcaaguacgagugugaaacauauaaagagcuuaaggcccauggcgucuccugcccucagagccagugccccuacuguuuuacccacugcgaaccgacagaggccgcuuuccaggcccauuauaaagugugucaaguuacccacagauuccgggaugaccugaagaaaacggugaccccucagaacuuuacacccgggugcuaccgcacccucaaucuguucagauauaagucucgguguuacaucuuuacaauguggauuuuccugcucguccuggaauccauccuuugggcggcuagcgccucugagaccccucugacgcccguguggaacgauaaugcccacggagugggcagcauuccuaugcauacagaccucgagcuggauuuuucccugaccucuucuuccaaguacacauauagacgcaaacuuaccaacccccucgaagcucagagcaucgaccugcacaucgagauugaggaacagaccaucggggucgauguucaugcccugggccacugguucgacggacggcucaaucugaagacauccuuucacugcuacggcgcuuguacgaaauaugaguacccguggcauaccgccaagugccacuaugaaagagacuaccaauaugagacaucuuggggguguaacccuagcgauugccccggauguggcaccgggugcacagcgugcggacuuuaccuggaccgccucaaacccgugggcuccgccuacaagauuaucaccauucgguauucuagacgcguguguguccaguucggggaagagaaucugugcaagaucaucgauaugaacgacuguuuugugagccggcauguuaaagugugcauuaucggcacggucuccaaguucucucagggagauacacugcucuuuuucggcccucuugaagggggaggccugauuuuuaaacacuggagaaccagcaccugucaguucggggacccgggagauaucaugagcccccgcgacaagggcuuccugugcccugaguuucccgggagcuuccggaaaaaguguaauuuugcuacaaccccuauuugcgaguacgauggcaacauggugucuggauauaaaaagguuauggccacaaucgacuccuuccaauccuuuaauacgucuaccaugcauuucacagaugaaagaaucgaguggaaggaccccgauggcaugcuccgcgaccacauuaacauccuggugaccaaagacauugauuuugacaaccuuggggaaaauccuuguaagaucggacugcagacauccagcauugagggcgcuugggggucuggagucggcuucacccucacgugccuggugucccugaccgaaugucccacauuucuuaccagcaucaaagccugcgauaaggcgauuugcuacggggccgaguccguuacacucacccggggccagaacacagugaaagucagcggaaagggcgggcacucuggaagcaccuucaaguguugccauggcgaggacuguuccccgaaugggcugcacgcugccgcuccucaucuggauaaagugaacggaaucucugaaaucgagaauagcaaggaauaugacgauggcgcuccccagugcggcauuaaauguugguuugugaaguccggggaguggaucucuggaauuuucagcggcaacuggaucguccucauuguucugugcguguuccuucuguuuucccucgugcugcugucuauccuuuguccugucagaaaacacaaaaagagcuga

SEQ ID NO: 13418 - RNA, 3417 nt, Artificial Sequence
  derived and/or modified CDS sequence (opt5) from LANV(510B)__AF005728.1__GP
auggagggcuggcuguucaccauccucggggugugcuacauuaugacaacgguccugcccaagaccaucuaugaacuuaaaauggaguguccucacacaguuggacugggccagggguacauuaucggaagcgccgaacucggccugauugacaucgcuaccgugccggagaucaaacuugaauccucuugcaacuuugaucugcauacaaccagcuccacacaaaagucuuucacccagcucgaguggagaaagaaagccgagacgaccgacacaacccaggcggcuagcacaaccuuugaagcccagacgaagacagugaauauucgggggaccuguauccuggccuccgaucuguaugacacacucaagcgcgucaaaaagaccgugcugugcuacgaucuuaccuguaaccaaacacagugccagcccacgguuuaucugauuaccccugugggaacauguaugucuaucagaagcugcauggcuaaucuccuguccaaccggauucagaucaccuucgagaaaacacacugugucaccggccaacuuguggaaggccagugcuuuaaucccagccauucucugacgcucucccagccuccccacacauacgacguugugacccugccuaccacauguuucuuuaccgccaagaaagcugaucaguauaagauugucaagacauucgaggggaucaucagcaaaacgggaugcaccgagaacucuauucaaggcuacuacgugugcuuuaucgggucccauagcgaaccgcugauuauccccacacucgaggacauucgcucugccgaacuggcguccagaaugcuucugcacccucggggagaggaucacgacccccuccagaaugcccaggcugugcugcgcaucgucggcccuaucaccgccaagguucccagcuccucuagcacagaaacccuucaagggauugcuuucgccggagugccgauguauuccagcuuuucuacgcuggugagaaacgcggauccugaguacgucuucucccccggcaucauuccugagagcaaucagucugugugugacaaaaagacccucccccugacauggaccggcuaucugcccaucagcggggaaauggagaaaguuacaggaugcaccguguuuuguacgcucgccggcccuggggcuaacugcgaagccuacuccgagucuggaauuuucaauaucagcuccccgacaugucuggucaacaaggugcagcgguuccgcggcagcgaacagaaaaucaauuuuaugugccaaagaauugauaacaauguuguggucuauuguaacgggcagaagaaggugauccuuaccaaaacacuggucauuggacagugcaucuacaccuucaccucucucuuuucccugaugcccgacguggcucauagccuugccguugagcugugugugccuggccuccacggcugggccacaauugcucugcugucuacguucugcuuuggguggcuccugauccccggaauuacccuuaucguccugaagauccucaaaauucugacauauuccuguagccauuacuccucugagagcaaguucaaaaugauccuggaaaaggugaagguugaguaccagaaaaccaugggcuccauggugugcgacauuugccaccacgaaugugagacagucaaggaacuugagucucauaaacaaagcugcguggaggggcaguguccuuauugcaugaccgugacggaagcgacacaguccgcccuccaggcucacuuuagcaucuguaagcugaccggacgguuccaugaggcccugaaaaagucucucaagaaacccgaaguucaccgcggcugcuacagaacccugggggucuuucgguaucgcuccagauguuacgugggccuuguguggggaugccugcucacaauugagcugguccugugggccgcuagcgccgagaccccgcuucucgaaccuggcuggucugauacagcgcauggggugggagagcugccccugaagacggaccucgaacuggauuucucccuuccuagcucuagcuccuauagcuaccggagacgccugaccaaccccgcuaauaaagaggaaucucucccuuuucacuuccaaauggagaagcagguuauccacgccgagauccagucccugggccauuggauggacgccacauuuaacauuaaaaccgcuuuccacuguuauggggccugcaagcaguacagcuaccccuggcaaacagcuaaguguuucuuugaaaaagauuaucaguacgagaccggauggggcugcaauccgggggacugcccuggcgugggaacgggcuguaccgccugcgggaucuaucuggauaaacuuaaguccgucggaaaggcguacaaagugauuucucucaaguauacacggaaaguuuguauccagcugggcaccgaacaagugugcaagcauauugacgccaacgauugucuggucacacccagcgugaagguuugcaucaucgggaccguguccaaaauucagcccucugacacacuccuguuccuuggaccucuggagcagggcggggucauccucaagcagugguguaccacgagcugcacauuuggcgauccgggagacauuauguccaccaccucuggcaugagaugucccgaacacacagggagcuuccgcaaaaucugcggauuugcuaccacgccugugugugaguaccaaggcaauacaauuuccggguaucagcggcugauggccaccaaggacagcuuccagucuuuuaaccugacagauccccacaucaccuccagcaaacuugaguggaucgacccugauggaaauacaagagaccaugugaaccucauucugaaucgcgaugucucuuuccaggaccuguccgauaaccccugcaagguugaccuccacacccaaagcaucgauggcgcuugggggucuggcgugggauuuacgcugaccugcguggucggccuuacagaauguccuuccuucauuaccagcaucaaggccugcgaccuggcgauguguuacggguccacaguggccacccucgcucggggaagcaauacgguuaaaguggucggcaaagggggacauucuggcagcuccuuuaagugcugucacgauucugacugcagcuccgagggccugauggccucugcuccccaucuggaaagagugacaggguucaaccagauugauagcgacaagguuuacgacgauggagccccgccuuguuccuuuaaaugcugguucaccaagucuggcgaguggcuucuggggauccucaauggaaacuggauugugaucgccguccuggugaucauucucaucauuagcaucauucuguucuccuuucuuuguccccgccggagccacaagaaaaauguuuga

SEQ ID NO: 13419 - RNA, 3402 nt, Artificial Sequence
  derived and/or modified CDS sequence (opt5) from LQUV(Longquan-Rs-32)__JX465402.1__GP
augaaaagcauccugcucauucugcuucuggaacaggugagauccaaggccaccaacgaaaucaagcucgagugcccccacgaccaacgggucgaaacaggcuucucucauggguuuacggaucugagcccuauucuuuacaccaaaggacuguucacaaagcaccucgagaauaacuguccguuugacaucuccauuaucaaucgccugguuagagaugugcggaucucuaccuggcaggcuaaaagcacaaacaccgacgccacaguggcguccgcuaccucuuucgaaacgaaggauaccgacgauaagcuggccggcgucugcggguuuuucgacgauauuacaaaacccaagcagggacagcgcaaagccaucauuuguuaugaccucagcugcaaucaaacccauugucugccuacacuucaccugaucuuuccccagcaguucugccagucccucaagcaauguagcauuaacgcuuacgaucauaaaauccugauuaccaucucucuuuccuuuugcccugagggccugaucauugggggaaauuguaucgugcccguucucgcccagagccagcugcugcacaaccacaugacguauaauauuaaggugacaugcuucuuugaguacucuauggcuagagaaucccucgacaacaaguuccuggaggaaaugaaucggcuuguccugggccgcaacugugagaaaaccgaguaucucggcggguacgugugcuuucuggccggauauggcacagcgauccauguuccuuacgauaauaccuaccuuagcggggccguggucaacucuaugaaggcuaaucugcacggagaagaccaugacagacucaaacugggcgauaccuccgccgugauugcugggaaccugaaguucgugaucgacagcacagccccggagaaauccuaucagggagaaugcuucacgggccacaugggcuacaccucucucuauuuuuaccccguccggagcaaggggaaauauguuacaauccugaccaagggagugauuccugugaucaacaagacaaccuguaugcccaaaauugucccucuuguguggacgggcaugguugagaugcgcgggaucgaagagaagcuggaggcgugcacaaugcacuguauuauggugggaaauggcgcuaccugcgaagccuucuccgccaccgggaucuuugauaucaaaagcacaaccugucaaauuggaaagacacauaaauacagacggacggaggaccagaucaccuucacaugccaggaucucaacaaggacauuucugucaucuguaauggcgaaaacauuaccgugcccguuaagucccugaucgugggccaaugcauuuauacaaucaccagcaucuuuucuauuuucccggcuacggcccacagcaucgccaccgagauguguguccaggggauucauggauggcuuacaaucauuaucuuuuucaccuuuugcuucggcuggcugcucaucccuauucugacaugucugaucauuaauaccaucgcuuacucccucauuacgcuggcguacuuuaaaaacggggcccgccuuggaaaucugaucaagagaaugaaaucugaguuccagcggacaaucggcaacaccacaugcaauauuugccuccgcgagugugagagcgaauccgaguauaagagccacgaggaacugugcaaaaacgggucuugucccuacugcaugaaggauaucggcgugucccagguccugcuuaaugaacauuauaacgcuuguaugcucauugacagauacgagaagcggcugacccacacccugaaucaaacaccucucuauagcagaaaagugcgcaagauccagucuuuucgguacagaaaccgcugcuucauucugacgguuuggaucauccuucugaccguggagucccucauuugggccagcuccgccgaagauaucaaacccgcucccaaguggcagaauacagcccacggaauuggcaccaucaaacugaacucugacuaugagcuggauuucagcgucguggcgggguccgaauuuacacauaagcggaugcuucagucuccugagagcggaaagaaaaacauuccguucaccguuuaccucuccgagcaacugaucacgagcacagugcagauucugggcaauuggauggacgcugaaaucaacgucaagucuguguuucacuguuacgggaccugcaaaaaguauuccuaccccuggcagagcucuccuugucauaaagagguggacuucgaauuucaguccagcuggggaugcaaucccaucucuuguccuggcauuaacagcgggugcaccgccugcggcacauauguugauaagcucaaaaccaucgccaaggcuuacagaauuaucacagucaaguauucccgcaaaguguguuaccaaauuggaacgaagaaagccugcaagacccuggagagcaaugacugucuugugucuaacggcgucaaaaucugcgcuaucgggacaauuuccacccugcagacaggaaugacccucguguucuuuggcccccugaaugggggagcccugcuuaucaaggauugguguauuagcuccugcaaguucggcgacccgggggauaucaugcagauuucuaacaauaucacguguccuagcuuugacggcaccaugcagcggguuugcagauucggacucgaacccauguguuccuauucuggcaacaaaaucagcggggugaagcgcguccuggagacaaaagauuccuaccugucugugaaucucaccaagccuaaacugguuggaagcacacuucuguggaacucccucgacagcucuauuaaggaucacaucaauauuguggucuccaacgacaucgauuuugaggaccuggcggaaacccccugcaaggugacaauuaaaaaucugaagaucgagggcgccugggggagcggaauuggcaucaaacuucacugugaaguuucucucuccgagugcagcgaauaccugaccacgaucaaggugugcgauaacgcuauuuguuaugggggcaacgucgcccaucugucucggggacucaauacagugaucauuaaaggcgcugggggacacuccggcagcuccuucaagugcugucaugagaccagcugcucugacaucggguuuaaggccgaggcgccucaccuggccagaauuguggacgauggaaucaccacaagcauguccuacucugacggcgcucccgaagccggcaucgucagcuggauuuauaaaguugcugaguggaucaaggggauguucaacggaaauugguucgugcuuauuaucaugauucuguuucucaucaucuccauugugcugcugaucuuccuuuguccggucaaaaaguacaaauga

SEQ ID NO: 13420 - RNA, 3402 nt, Artificial Sequence
  derived and/or modified CDS sequence (opt5) from LQUV(Longquan-Ra-25)__JX465397.1__GP
augaaaagcauccugcucauucugcuucugggccaggugagauccaaagccaccaacgagaucaagcucgaaugcccccacgaccaacgggucgagacaggguucucucauggauuuacggaucugagcccuauucuuuacaccaaaggccuguucacaaagcaccucgaaaauaacuguccguuugacaucuccauuaucaaucgccugguuagagaugugcggaucucuaccuggcaggcuaaaagcacaaacaccgacgccacaguggcguccgcuaccucuuucgagacgaaggauaccgacgauaagcuggccggggucugcggauuuuucgacgauauuacaaaacccaagcagggccagcgcaaagccaucauuuguuaugaccucagcugcaaucaaacccauugucugccuacacuucaccugaucuuuccccagcaguucugccagucccucaagcaauguagcauuaacgcuuacgaucauaaaauccugauuaccaucucucuuuccuuuugcccugaagggcugaucauuggaggcaauuguaucgugcccguucucgcccagagccagcugcugcacaaccacaugacguauaauauuaaggugacaugcuucuuugaguacucuauggcuagagagucccucgacaacaaguuccuggaagagaugaaucggcuuguccugggccgcaacugugaaaagaccgaguaucucgggggauacgugugcuuucuggccggcuaugggacagcgauccauguuccuuacgauaauaccuaccuuagcggagccguggucaacucuaugaaggcuaaucugcacggcgaggaccaugacagacucaaacugggggauaccuccgccgugauugcuggaaaccugaaguucgugaucgacagcacagccccggaaaaauccuaucagggcgagugcuucacgggccacaugggguacaccucucucuauuuuuaccccguccggagcaagggaaaauauguuacaauccugaccaagggcgugauuccugugaucaacaagacaaccuguaugcccaaaauugucccucuuguguggacggggaugguugaaaugcgcggaaucgaggaaaagcuggaggcgugcacaaugcacuguauuauggugggcaauggggcuaccugcgaggccuucuccgccaccggaaucuuugauaucaaaagcacaaccugucaaauuggcaagacacauaaauacagacggacggaagaccagaucaccuucacaugccaggaucucaacaaggacauuucugucaucuguaauggcgagaacauuaccgugcccguuaagucccugaucguggggcaaugcauuuauacaaucaccagcaucuuuucuauuuucccggcuacggcccacagcaucgccaccgaaauguguguccagggcauucauggauggcuuacaaucauuaucuuuuucaccuuuugcuucggguggcugcucaucccuauucugacaugucugaucauuaauaccaucgcuuacucccucauuacgcuggcguacuuuaaaaacggagcccgccuuggcaaucugaucaagagaaugaaaucugaguuccagcggacaaucgggaacaccacaugcaauauuugccuccgcgaaugugagagcgaguccgaauauaagagccacgaggaacugugcaaaaacggcucuugucccuacugcaugaaggauaucggagugucccagguccugcuuaaugagcauuauaacgcuuguaugcucauugacagauacgaaaagcggcugacccacacccugaaucaaacaccucucuauagcagaaaagugcgcaagauccagucuuuucgguacagaaaccgcugcuucauucugacgguuuggaucauccuucugaccguggagucccucauuugggccagcuccgccgaggauaucaaacccgcucccaaguggcagaauacagcccacggcauugggaccaucaaacugaacucugacuaugaacuggauuucagcgucguggcgggauccgaguuuacacauaagcggaugcuucagucuccugaaagcggcaagaaaaacauuccguucaccguuuaccucuccgagcaacugaucacgagcacagugcagauucuggggaauuggauggacgcugagaucaacgucaagucuguguuucacuguuacggaaccugcaaaaaguauuccuaccccuggcagagcucuccuugucauaaagaaguggacuucgaguuucaguccagcuggggcugcaaucccaucucuuguccugggauuaacagcggcugcaccgccugcggaacauauguugauaagcucaaaaccaucgccaaggcuuacagaauuaucacagucaaguauucccgcaaaguguguuaccaaauuggcacgaagaaagccugcaagacccuggaaagcaaugacugucuugugucuaacggggucaaaaucugcgcuaucggaacaauuuccacccugcagacaggcaugacccucguguucuuugggccccugaauggaggcgcccugcuuaucaaggauugguguauuagcuccugcaaguucggggacccgggcgauaucaugcagauuucuaacaauaucacguguccuagcuuugacggaaccaugcagcggguuugcagauucggccucgagcccauguguuccuauucugggaacaaaaucagcggagugaagcgcguccuggaaacaaaagauuccuaccugucugugaaucucaccaagccuaaacugguuggcagcacacuucuguggaacucccucgacagcucuauuaaggaucacaucaauauuguggucuccaacgacaucgauuuugaggaccuggcggagacccccugcaaggugacaauuaaaaaucugaagaucgaaggggccuggggaagcggcauugggaucaaacuucacugugagguuucucucuccgaaugcagcgaguaccugaccacgaucaaggugugcgauaacgcuauuuguuauggcggaaacgucgcccaucugucucggggccucaauacagugaucauuaaaggggcuggaggccacuccgggagcuccuucaagugcugucaugaaaccagcugcucugacaucggauuuaaggccgaggcgccucaccuggccagaauuguggacgauggcaucaccacaagcauguccuacucugacggcgcucccgaggccgggaucauuagcuggaucuauaaagucgcugaauggauuaagggaauguucaacggcaauugguucguucuuaucauuaugauccuguuucucaucauuuccaucgugcugcugauuuuccuuuguccggugaaaaaguacaaauga

SEQ ID NO: 13421 - RNA, 3402 nt, Artificial Sequence
  derived and/or modified CDS sequence (opt5) from LQUV(Longquan-Ra-5)__JX465398.1__GP
augaaaagcauccugcucauucugcuucugggccaggugagauccaaagccaccaacgagaucaagcucgaaugcccccacgaccaacgggucgagacaggguucucucauggauuuacggaucugagcccuauucuuuacaccaaaggccuguucacaaagcaccucgaaaauaacuguccguuugacaucuccauuaucaaucgccugguuagagaugugcggaucucuaccuggcaggcuaaaagcacaaacaccgacgccacaguggcguccgcuaccucuuucgagacgaaggauaccgacgauaagcuggccggggucugcggauuuuucgacgauauuacaaaacccaagcagggccagcgcaaagccaucauuuguuaugaccucagcugcaaucaaacccauugucugccuacacuucaccugaucuuuccccagcaguucugccagucccucaagcaauguagcauuaacgcuuacgaucauaaaauccugauuaccaucucucuuuccuuuugcccugaagggcugaucauuggaggcaauuguaucgugcccguucucgcccagagccagcugcugcacaaccacaugacguauaauauuaaggugacaugcuucuuugaguacucuauggcuagagagucccucgacaacaaguuccuggaagagaugaaucggcuuguccugggccgcaacugugaaaagaccgaguaucucgggggauacgugugcuuucuggccggcuaugggacagcgauccauguuccuuacgauaauaccuaccuuagcggagccguggucaacucuaugaaggcuaaucugcacggcgaggaccaugacagacucaaacugggggauaccuccgccgugauugcuggaaaccugaaguucgugaucgacagcacagccccggaaaaauccuaucagggcgagugcuucacgggccacaugggguacaccucucucuauuuuuaccccguccggagcaagggaaaauauguuacaauccugaccaagggcgugauuccugugaucaacaagacaaccuguaugcccaaaauugucccucuuguguggacggggaugguugaaaugcgcggaaucgaggaaaagcuggaggcgugcacaaugcacuguauuauggugggcaauggggcuaccugcgaggccuucuccgccaccggaaucuuugauaucaaaagcacaaccugucaaauuggcaagacacauaaauacagacggacggaagaccagaucaccuucacaugccaggaucucaacaaggacauuggcgucaucuguaauggggagaacauuaccgugcccguuaagucucugaucgugggacaaugcauuuauacaaucaccuccaucuuuagcauuuucccggcuacggcccacucuaucgccaccgaaauguguguccagggcauucauggguggcuuacaaucauuaucuuuuucaccuuuugcuucggauggcugcucaucccuauucugacaugucugaucauuaauaccaucgcuuacagccucauuacgcuggcguacuuuaaaaacggcgcccgccuugggaaucugaucaagagaaugaaauccgaguuccagcggacaaucggcaacaccacaugcaauauuugccuccgcgaaugugagucugagagcgaauauaagucccacgaggaacugugcaaaaacggaagcugucccuacugcaugaaggauaucggcgugucucagguccugcuuaaugagcauuauaacgcuuguaugcucauugacagauacgaaaagcggcugacccacacccugaaucaaacaccucucuauuccagaaaagugcgcaagauccagagcuuucgguacagaaaccgcugcuucauucugacgguuuggaucacccuucugacaguggagucucucaucugggccuccagcgccgaggauauuaaacccgcucccaaguggcagaauaccgcccacgggaucggaacaauuaaacugaacuccgacuaugaacuggauuucucugucguggcgggcagcgaguuuacccauaagcggaugcuucaguccccugaaucugggaagaaaaacaucccguucacgguuuaccucagcgagcaacugauuacauccaccgugcagauccugggaaauuggauggacgcugagauuaacgucaagagcguguuucacuguuacgggaccugcaaaaaguauucuuaccccuggcaguccagcccuugucauaaagaaguggacuucgaguuucagucuuccuggggcugcaaucccaucagcuguccuggcaucaacucuggaugcacagccugcggcaccuauguugauaagcucaaaacaauugccaaggcuuacagaaucauuacggucaaguauagccgcaaaguguguuaccaaaucgggaccaagaaagccugcaagacacuggaauccaaugacugucuugugagcaacggagucaaaauuugcgcuaucggcaccaucucuacacugcagaccgggaugacgcucguguucuuuggaccccugaauggcggggcccugcuuauuaaggauugguguaucuccagcugcaaguucggcgacccgggagauauuaugcagaucuccaacaauauuaccuguccuucuuuugacggcacaaugcagcggguuugcagauucgggcucgagcccauguguagcuauuccggaaacaaaaucucuggcgugaagcgcguccuggaaaccaaagauagcuaccuguccgugaaucucacaaagccuaaacugguugggucuacccuucuguggaacagccucgacuccagcaucaaggaucacauuaauaucguggucucuaacgacauugauuuugaggaccuggcggagacacccugcaaggugaccaucaaaaaucugaagauugaaggagccuggggcuccgggaucggcauuaaacuucacugugagguuagccucucugaaugcuccgaguaccugacgacaaucaaggugugcgauaacgcuaucuguuauggaggcaacgucgcccaucugagccgggggcucaauaccgugauuaucaaaggagcuggcgggcacucuggauccagcuucaagugcugucaugaaaccuccugcagcgacauuggcuuuaaggccgaggcgccucaccuggccagaaucguggacgauggcauuacaaccucuaugagcuacuccgacggggcucccgaggccggaaucgucucuuggaucuauaaaguugcugaauggauuaagggcauguucaacgggaauugguucgugcuuaucauuaugauccuguuucucauuaucagcaucgugcugcugauuuuccuuuguccggucaaaaaguacaaauga

SEQ ID NO: 13422 - RNA, 3402 nt, Artificial Sequence
  derived and/or modified CDS sequence (opt5) from LQUV(Longquan-Ra-56)__JX465399.1__GP
augaaaagcauccugcucauucugcuucugggccaggugagauccaaagccaccaacgagaucaagcucgaaugcccccacgaccaacgggucgagacaggguucucucauggauuuacggaucugagcccuauucuuuacaccaaaggccuguucacaaagcaccucgaaaauaacuguccguuugacaucuccauuaucaaucgccugguuagagaugugcggaucucuaccuggcaggcuaaaagcacaaacaccgacgccacaguggcguccgcuaccucuuucgagacgaaggauaccgacgauaagcuggccggggucugcggauuuuucgacgauauuacaaaacccaagcagggccagcgcaaagccaucauuuguuaugaccucagcugcaaucaaacccauugucugccuacacuucaccugaucuuuccccagcaguucugccagucccucaagcaauguagcauuaacgcuuacgaucauaaaauccugauuaccaucucucuuuccuuuugcccugaagggcugaucauuggaggcaauuguaucgugcccguucucgcccagagccagcugcugcacaaccacaugacguauaauauuaaggugacaugcuucuuugaguacucuauggcuagagagucccucgacaacaaguuccuggaagagaugaaucggcuuguccugggccgcaacugugaaaagaccgaguaucucgggggauacgugugcuuucuggccggcuaugggacagcgauccauguuccuuacgauaauaccuaccuuagcggagccguggucaacucuaugaaggcuaaucugcacggcgaggaccaugacagacucaaacugggggauaccuccgccgugauugcuggaaaccugaaguucgugaucgacagcacagccccggaaaaauccuaucagggcgagugcuucacgggccacaugggguacaccucucucuauuuuuaccccguccggagcaagggaaaauauguuacaauccugaccaagggcgugauuccugugaucaacaagacaaccuguaugcccaaaauugucccucuuguguggacggggaugguugaaaugcgcggaaucgaggaaaagcuggaggcgugcacaaugcacuguauuauggugggcaauggggcuaccugcgaggccuucuccgccaccggaaucuuugauaucaaaagcacaaccugucaaauuggcaagacacauaaauacagacggacggaagaccagaucaccuucacaugccaggaucucaacaaggacauuucugucaucuguaauggcgagaacauuaccgugcccguuaagucccugaucguggggcaaugcauuuauacaaucagcucuaucuuuagcauuuucccggcuaccgcccacuccaucgccacggaaauguguguccagucuauucauggauggcuuaccaucauuaucuuuuucacauuuugcuucggcuggcugcucaucccuauucugaccugucugaucauuaauacaaucgcuuacagccucauuacccuggcguacuuuaaaaacggggcccgccuuggaaaucugaucaagagaaugaaauccgaguuccagcggacgaucggcaacacaaccugcaauauuugccuccgcgaaugugagagcgagucugaauauaagucccacgaggaacugugcaaaaacgggagcugucccuacugcaugaaggauaucggcgugucucagguccugcuuaaugagcauuauaacgcuuguaugcucauugacagauacgaaaagcggcugacacacacccugaaucaaaccccucucuauuccagaaaagugcgcaagauccagagcuuucgguacagaaaccgcugcuucauucugacaguuuggaucauccuucugacgguggagucccucauuugggccucuagcgccgaggauaucaaacccgcucccaaguggcagaauaccgcccacggaauuggcacaaucaaacugaacuccgacuaugaacuggauuucucugucguggcggggagcgaguuuacccauaagcggaugcuucaguccccugaaagcggaaagaaaaacauuccguucacaguuuaccucucugagcaacugaucaccuccacggugcagauucugggcaauuggauggacgcugagaucaacgucaagagcguguuucacuguuacgggacaugcaaaaaguauucuuaccccuggcaguccagcccuugucauaaagaaguggacuucgaguuucagucuagcuggggaugcaaucccaucuccuguccuggcauuaacagcgggugcaccgccugcggcaccuauguugauaagcucaaaacaaucgccaaggcuuacagaauuaucaccgucaaguauucucgcaaaguguguuaccaaauuggaacaaagaaagccugcaagacgcuggaauccaaugacugucuugugagcaacggcgucaaaaucugcgcuaucgggaccauuuccacacugcagaccggaaugacacucguguucuuuggcccccugaaugggggagcccugcuuaucaaggauugguguauuucuagcugcaaguucggcgacccgggggauaucaugcagauuuccaacaauaucaccuguccuucuuuugacggcacgaugcagcggguuugcagauucggacucgagcccauguguagcuauuccggcaacaaaaucucuggggugaagcgcguccuggaaaccaaagauagcuaccuguccgugaaucucacaaagccuaaacugguuggaagcacccuucuguggaacucucucgacuccagcauuaaggaucacaucaauauuguggucucuaacgacaucgauuuugaggaccuggcggagacacccugcaaggugaccauuaaaaaucugaagaucgaaggcgccuggggguccggaauuggcaucaaacuucacugugagguuagccucucugaaugcuccaaguaccugacaaccaucaaagugugcgauaacgcuauuuguuaugggggcaacgucgcccaucugagccggggacucaauacggugaucauuaagggcgcugggggacacuccggcagcucuuucaagugcugucaugagacaagcugcuccgacaucggguuuaaagccgaagcgccucaccuggccagaauuguggacgauggaaucaccaccucuaugagcuacuccgacggcgcucccgaggccggcaucgucucuuggauuuauaagguugcugaguggaucaaagggauguucaacggaaauugguucgugcuuauuaucaugauucuguuucucaucaucagcauugugcugcugaucuuccuuuguccggucaagaaauacaaguga

SEQ ID NO: 13423 - RNA, 3402 nt, Artificial Sequence
  derived and/or modified CDS sequence (opt5) from LQUV(Longquan-Ra-90)__JX465400.1__GP
augaaaagcauccugcucauucugcuucugggccaggugagauccaaagccaccaacgagaucaagcucgaaugcccccacgaccaacgggucgagacaggguucucucauggauuuacggaucugagcccuauucuuuacaccaaaggccuguucacaaagcaccucgaaaauaacuguccguuugacaucuccauuaucaaucgccugguuagagaugugcggaucucuaccuggcaggcuaaaagcacaaacaccgacgccacaguggcguccgcuaccucuuucgagacgaaggauaccgacgauaagcuggccggggucugcggauuuuucgacgauauuacaaaacccaagcagggccagcgcaaagccaucauuuguuaugaccucagcugcaaucaaacccauugucugccuacacuucaccugaucuuuccccagcaguucugccagucccucaagcaauguagcauuaacgcuuacgaucauaaaauccugauuaccaucucucuuuccuuuugcccugaagggcugaucauuggaggcaauuguaucgugcccguucucgcccagagccagcugcugcacaaccacaugacguauaauauuaaggugacaugcuucuuugaguacucuauggcuagagagucccucgacaacaaguuccuggaagagaugaaucggcuuguccugggccgcaacugugaaaagaccgaguaucucgggggauacgugugcuuucuggccggcuaugggacagcgauccauguuccuuacgauaauaccuaccuuagcggagccguggucaacucuaugaaggcuaaucugcacggcgaggaccaugacagacucaaacugggggauaccuccgccgugauugcuggaaaccugaaguucgugaucgacagcacagccccggaaaaauccuaucagggcgagugcuucacgggccacaugggguacaccucucucuauuuuuaccccguccggagcaagggaaaauauguuacaauccugaccaagggcgugauuccugugaucaacaagacaaccuguaugcccaaaauugucccucuuguguggacggggaugguugaaaugcgcggaaucgaggaaaagcuggaggcgugcacaaugcacuguauuauggugggcaauggggcuaccugcgaggccuucuccgccaccggaaucuuugauaucaaaagcacaaccugucaaauuggcaagacacauaaauacagacggacggaagaccagaucaccuucacaugccaggaucucaacaaggacauuucugucaucuguaauggcgagaacauuaccgugcccguuaagucccugaucguggggcaaugcauuuauacaaucaccagcaucuuuucuauuuucccggcuacggcccacagcaucgccaccgaaauguguguccagggcauucauggauggcuuacaaucauuaucuuuuucaccuuuugcuucggguggcugcucaucccuauucugacaugucugaucauuaauaccaucgcuuacucccucauuacgcuggcguacuuuaaaaacggagcccgccuuggcaaucugaucaagagaaugaaaucugaguuccagcggacaaucgggaacaccacaugcaauauuugccuccgcgaaugugagagcgaguccgaauauaagagccacgaggaacugugcaaaaacggcucuugucccuacugcaugaaggauaucggagugucccagguccugcuuaaugagcauuauaacgcuuguaugcucauugacagauacgaaaagcggcugacccacacccugaaucaaacaccucucuauagcagaaaagugcgcaagauccagucuuuucgguacagaaaccgcugcuucauucugacgguuuggaucauccuucugaccguggagucccucauuugggccagcuccgccgaggauaucaaacccgcucccaaguggcagaauacagcccacggcauugggaccaucaaacugaacucugacuaugaacuggauuucagcgucguggcgggauccgaguuuacacauaagcggaugcuucagucuccugaaagcggcaagaaaaacauuccguucaccguuuaccucuccgagcaacugaucacgagcacagugcagauucuggggaauuggauggacgcugagaucaacgucaagucuguguuucacuguuacggaaccugcaaaaaguauuccuaccccuggcagagcucuccuugucauaaagaaguggacuucgaguuucaguccagcuggggcugcaaucccaucucuuguccugggauuaacagcggcugcaccgccugcggaacauauguugauaagcucaaaaccaucgccaaggcuuacagaauuaucacagucaaguauucccgcaaaguguguuaccaaauuggcacgaagaaagccugcaagacccuggaaagcaaugacugucuugugucuaacggggucaaaaucugcgcuaucggaacaauuuccacccugcagacaggcaugacccucguguucuuugggccccugaauggaggcgcccugcuuaucaaggauugguguauuagcuccugcaaguucggggacccgggcgauaucaugcagauuucuaacaauaucacguguccuagcuuugacggaaccaugcagcggguuugcagauucggccucgagcccauguguuccuauucugggaacaaaaucagcggagugaagcgcguccuggaaacaaaagauuccuaccugucugugaaucucaccaagccuaaacugguuggcagcacacuucuguggaacucccucgacagcucuauuaaggaucacaucaauauuguggucuccaacgacaucgauuuugaggaccuggcggagacccccugcaaggugacaauuaaaaaucugaagaucgaaggggccuggggaagcggcauugggaucaaacuucacugugagguuucucucuccgaaugcagcgaguaccugaccacgaucaaggugugcgauaacgcuauuuguuauggcggaaacgucgcccaucugucucggggccucaauacagugaucauuaaaggggcuggaggccacuccgggagcuccuucaagugcugucaugaaaccagcugcucugacaucggauuuaaggccgaggcgccucaccuggccagaauuguggacgauggcaucaccacaagcauguccuacucugacggcgcucccgaggccgggaucgucagcuggauuuauaaaguugcugaauggaucaagggaauguucaacggcaauugguucgugcuuauuaucaugauucuguuucucaucaucuccauugugcugcugaucuuccuuuguccggucaaaaaguacaaauga

SEQ ID NO: 13424 - RNA, 3423 nt, Artificial Sequence
  derived and/or modified CDS sequence (opt5) from NYV(Rhode Island-1 (RI-1))__U36801.1__GP
auggugggcugggucugcaucuuccugguugugcucgccaccacaacggcugggcugaccagaaaccuuuacgagcugaagauugaauguccccacacagugggacucggccagggguaugucaccggaagcguggagacaaccccuauccugcuuacacaaguuaccgaccugaaaauugaauccucuugcaauuuugaucuccaugugccgagcacguccauccagaaguacaaccaggucgagugggccaaaaagucuagcaccacagaauccaccucugcgggcgcuacaaccuucgaggccaaaacgaaggaggugagccugaaggggacauguaauauucccguuaccacauuugaagccgcuuauaaauccagaaagaccgugaucugcuacgaccuggccuguaaccagaccuauugccucccuacaguccaccugaucgcucccgugcaaacguguaugagcgugcgcucuugcaugauuggacuucuguccagcagaauccaggucauuuacgagaaaaccuauuguguuacaggccagcucguggaaggccugugcuucaucccuacccauacaauugcccuuacccagcccgggcacacguacgauacaaugacccugccuaucaccuguuuucucguggcgaagaaacugggaacacaacugaagauugccgucgagcucgagaagcugaucaccgcuucuggcugcacagaaaauuccuuccagggguacuauaucugcuuucuuggaaaacauagcgagccgcugucugugcccaugauggacgauuaccgguccgccgaacucuucacgcgcaugguucugaacccuagaggcgaggaccacgaucccgaccagaaugggcagggacuuaugcggauugcuggcccuaucaccgccaaggugcccagcacagaaaccacagagaccaugcaaggcauugcguuugccggggcuccgacguauuccucuuucagcacccugguccgcaaagccgauccugacuacguguuuucccccggaaucauugcugagagcaaccacucuguuugugauaagaaagccaucccucucacauggaccggcuuccuggccguguccggggaaaucgagaagauuacaggaugcaccgucuuuuguacgcuggugggccccggggcuagcugcaaagcguauucugaaacaggaaucuucaauauuagcucccccaccugucucgucaacaaggugcagaaguucagaggcucugagcagcggaucaauuuuaugugccaacgcguugaccaggaugugauugucuacuguaacggccagaaaaaggugauccugacaaaaacccuuaucauugggcagugcaucuauaccuucacaagccuguuuucccucauuccuggaguugcccauagccuggcuguggaacuuugugucccgggccugcacgggugggccacggccgcucuccugaucaccuucugcuuuggauggcugcucauucccacaaucaccaugauuauccugaagauccuuagacugcucacauucucuuguucccauuacagcaccgagucuaaauuuaaggccauucuggagcgggugaagguggaauaccagaaaacgaugggcuccaugguuugcgacgcgugccaccacgagugugaaacagcuaaggagcuggaaacccauaaaaagagcugcccugaggggcaaugucccuauugcaugaccaugacagaguccaccgaaucugcccuucucgcccacuucagcaucuguaaacugacaaaucgcuuucaggagaaccugaagaagucccucaaaagaccugaagucaagcagggccgguaccgcacgcugggaguguucagauauaaaucucggugcuacgugggccuugucuggggagugcugcucaccacagagcugauuguuugggcugccagcgcugacacaccccugauggaguccggauggagcgauaccgcccauggcguggggaucgucccgaugaagaccgaccuugaacucgauuuugcgcuggccucuuccagcucuuauuccuacagacgcaaacuggugaauccugcuaacaaggaggaaacgcuccccuuccacuuucaacuggacaagcagguugugcaugccgagauucagaaccuuggacacuggauggauggcaccuucaauaucaaaacagcuuuccacuguuauggggaaugcaagaaauacgccuacccuuggcagaccgcgaagugcuuuuucgagaaagacuaucaauacgagacaagcuggggcuguaaucccccugauugucccggagucggcaccgggugcacagccugcggaguguaucuggacaagcuccggucuggcgggaaggcuuacaaaaucguuagccugaaguuuaccagaaaaguguguauucagcugggaacggaacagacaugcaagcauaucgaugucaacgacugucuugugaccccguccgugaaagucugccucauuggcaccaucagcaagcugcagccuggggauacacuccuguuccugggcccccuugagcaaggaggcauuauccugaaacagugguguaccacgucuugcguuuuuggggaccccggagacaucauguccacaaccacaggcaugaaguguccugaacacaccgggagcuuccgcaagauuugcggauuugccacaaccccgacgugugaguaucagggcaacaccaucuccggguuccaacggaugauggcuacaagagauucuuuucagagcuucaaugugaccgaaccccauauuacauccaaccgccucgaguggaucgacccugauucuagcauuaaagaccacaucaauauggugcugaaccgggaugucuccuuucaggaccugucugauaaucccugcaagguggaccuucacacccagagcaucgauggcgccuggggauccggcguuggguucacgcucguguguacagucggacugaccgagugcgccaacuuuauuacaagcaucaaggcuugcgacucugcgauguguuacggcgccaccgugaccaaucugcucagaggguccaacacaguuaaaguggucggaaaaggcggccauucuagcucccuguucaagugcugucacgauacggacugcaccgaagaggggcuugcugccagcccuccccaucuggaucgcgugacaggauauaaucaaauugacucugacaagguuuacgaugacggcgccccucccuguaccaucaaaugcugguucacaaaguccggggaauggcuccuggggauucugaacggcaauuggguggucguggcugugcuuaucgucauucugauccucagcauccugcucuuuuccuucuuuuguccgauucgggggcggaaaaacaagagcaacuga

SEQ ID NO: 13425 - RNA, 3423 nt, Artificial Sequence
  derived and/or modified CDS sequence (opt5) from NYV(New York-1 (NY-1))__U36802.1__GP
auggugggcugggucugcaucagccugguugugcucgccaccacaacggcugggcugaccagaaaccuuuacgagcugaagauugaauguccccacacagugggacucggccagggguaugucaccggauccguggagacaaccccuauccugcuuacacaaguuaccgaccugaaaauugaaucuagcugcaauuucgaucuccaugugccguccacgucuauccagaaguacaaccaggucgagugggccaaaaagagcuccaccacagaaucuaccagcgcgggcgcuacaaccuuugaggccaaaacgaaggaggugucccugaaggggacauguaauauucccguuaccacauucgaagccgcuuauaaaagccggaagaccgugaucugcuacgaccuggccuguaaccagacccacugccucccuacaguccaucugaucgcucccgugcaaacguguaugucugugcgcuccugcaugauuggacuucugagcucuagaauccaggucauuuaugagaaaaccuacuguguuacaggccagcucguggaaggccugugcuuuaucccuacccacacaauugcccuuacccagcccgggcauacguaugauacaaugacccugccuaucaccuguuuccucguggcgaagaaacugggaacacaacugaagauugccgucgagcucgagaagcugaucaccgcuuccggcugcacagaaaauagcuuucagggguacuacaucugcuuccuuggaaaacacucugagccgcuguuugugcccaugauggacgauuaucgguccgccgaacucuucacgcgcaugguucugaacccuagaggcgaggaccacgaucccgaccagaaugggcagggacuuaugcggauugcuggcccuaucaccgccaaggugcccagcacagaaaccacagagaccaugcaaggcauugcguuugccggggcuccgauguacuccucuuucagcacgcugguccgcaaagccgauccugacuauguguuuucccccggaaucauugcugagagcaaccauucuguuugugauaagaaaaccaucccucucacauggaccggcuuccuggccguguccggggaaaucgagaagauuacaggaugcaccgucuuuuguacgcuggugggccccggggccagcugcgaggcuuacucugaaacaggaaucuucaauauuagcucccccaccugucucgucaacaaagugcagaaguucagaggcucugaacagcggaucaauuuuaugugccaacgcguugaccaggaugugauugucuauuguaacggccagaagaaagugauccugacaaagacccuuguuaucgggcagugcauuuacaccuucacaagccuguuuucccucaucccuggaguggcgcacagccuggccgucgagcuuugugugccgggccugcaugggugggcuacgaccgcccuccugauuacauucugcuuuggauggcugcucauccccaccauuacaaugaucauucugaaaauccuuagacugcucaccuucucuuguucccacuauagcacggagucuaaguuuaaagccauccuggaacgggugaagguugaguaccaaaagacaaugggcuccauggucugcgacgugugccaccaugaaugugagaccgcuaaagaacuggagacccacaagaaaagcugcccugaggggcagugucccuacugcaugacaaugaccgaauccacagagucugcccuucaggcgcauuucagcauuuguaagcucacgaaucgcuuucaggaaaaccugaaaaagucccugaagagaccugaggugaaacaaggcugcuaucggacccucggagucuuccgcuacaagucuagauguuaugugggccugguuuggggagugcuucugacaaccgagcucaucgucugggcugccagcgccgacacaccccugauggaauccggguggagcgauaccgcucacggcguggggauuguuccgaugaaaacggaccuggagcuugauuuugcccucgcuucuuccagcucuuacuccuaucggagaaagcuggugaauccugccaacaaagaagagacccugcccuuccauuuucagcucgacaagcaggucgugcacgcggaaauccagaaccugggacacuggauggauggcacauucaauauuaagaccgccuuccauugcuacggggaguguaaaaaguaugcuuacccuuggcaaacagccaaaugcuuuuucgagaaggacuaccaguaugaaaccagcuggggcuguaaucccccugauugccccggaguuggcacagggugcaccgcuuguggaguguaccuugacaaacugcgcucugucggcaaggccuauaaaaucgugagccucaaguuuacgcggaaggugugcauccagcuggggacagagcagaccuguaaacacauugaugucaacgacugccugguuaccccguccgugaaggugugucuuaucggaacaauuagcaaacuccaaccuggcgauacccugcuguuccucgggccccuggaacagggcggaaucauucuuaagcaguggugcacgacaucuugugucuuuggcgaccccggggacaucauguccaccacaaccggaaugaaaugcccugagcauacaggcagcuucagaaagaucuguggguuugcgaccacgccgaccugcgaauaccaaggaaacacaauuuccggcuuccagcgcaugauggccacccgggauucuuuucagagcuucaaugugacagagccccacaucaccuccaacagacuggaguggauugacccugauucuagcaucaaggaccacauuaauaugguucucaaccgcgauguguccuuucaggaccugucugauaaucccuguaaagucgaccugcauacgcaaagcaucgauggggcuuggggcuccggagugggcuucacacuuguuugcaccguggggcucacagaaugcgccaacuuuaucaccagcauuaaggcuugugacucugccaugugcuauggagccaccgucacaaaucugcugcggggcuccaacacggugaaaguuguggggaagggaggccacagcggcucucucuucaaauguugccaugauaccgacuguacagaggaagggcuggcugcguccccuccccaccuugauagagucaccggauacaaucagaucgacagcgacaagguguaugaugacggcgccccucccugcacaauuaaguguugguucaccaaaucuggggaguggcugcucggaauccugaacggcaauuggguggucguugcugugcugauugugauccuuauucuguccauccuccuguuuagcuucuuuugcccgauccgcgggcggaagaacaaauccaacuga

SEQ ID NO: 13426 - RNA, 3423 nt, Artificial Sequence
  derived and/or modified CDS sequence (opt5) from NYV(New York-2 (NY-2))__U36803.1__GP
auggugggcuucgucugcaucuuucugguugugcucgccaccacaacggcugggcugaccagaaaccuuuacgagcugaagauugaauguccccacacagugggacucggccagggguaugucaccggaagcgugggcacaaccccuauccugcuuacacaaguuaccgaccugaaaauugaguccucuugcaauuucgaucuccaugugccgagcacguccauccagaaguacaaccaggucgaaugggccaaaaagucuagcaccacagaguccaccucugcgggggcuacaaccuuugaagccaaaacgaaggaggugagccugaagggaacauguaauauucccguuaccacauucgaggccgcuuauaaaucccggaagaccgugaucugcuacgaccuggccuguaaccagacccacugccucccuacaguccaucugaucgcucccgugcaaacguguaugagcgugcgcucuugcaugauuggccuucuguccagcagaauccaggucauuuaugagaaaaccuacuguguuacaggccagcucguggaggggcugugcuuuaucccuacccacacaauugcccuuacccagcccggacauacguaugauacaaugacccugccuaucaccuguuuccucguggcgaagaaacugggcacacaacugaagauugccgucgaacucgagaagcugaucaccgcugggggaugcacagagaauagcuuucagggcuacuacaucugcuuccuugggaaacacuccgaaccgcuguuugugcccaugauggacgauuaucggagcgccgaacucuucacgcgcaugguucugaacccuagaggagaagaccacgaucccgaccagaauggccagggccuuaugcggauugcugggccuaucaccgccaaggugcccucuacagagaccacagaagcgaugcaaggaauugccuuugcuggcgccccgauguacuccagcuucuccacccugguccgcaaagcugauccugacuauguguuuucucccgggaucauugccgagagcaaccauuccguuugugauaagaaaacgaucccucucaccuggacaggauuccuggccgugagcggcgagaucgaaaagauuaccgggugcacagucuucuguacccuggugggacccggcgcuucuugcgaggcguacuccgaaacgggcaucuuuaauauuagcucucccacaugucucgucaacaaagugcagaaguucagagggagcgagcagcggaucaauuuuaugugccaacgcguugaccaggaugugauugucuauuguaacggacagaagaaagugauccugaccaagacacuuguuaucggccagugcauuuacaccuucaccucccuguuuucucucaucccugggguggcccacagccuggcugucgaacuuugugugccgggacugcauggcugggccacaacggcccuccugauuaccuucugcuuuggguggcugcucauccccacaauuaccaugaucauucugaaaauccuuagacugcucacauucuccuguagccacuauucuaccgaguccaaguuuaaagcuauccuggagcgggugaagguugaauaccaaaagacgaugggcagcauggucugcgacgugugccaccaugagugugaaacagccaaagagcuggaaacccacaagaaaucuugcccugagggacagugucccuacugcaugaccaugacagaguccaccgaaagcgcgcuucaggcucauuucuccauuuguaagcucacaaaucgcuuucaggagaaccugaaaaagucucugaagagaccugaagugaaacaaggcugcuaucggacgcucggggucuuccgcuacaagagcagauguuaugugggacugguuuggggcgugcuucugaccacagagcucaucgucugggccgccuccgcugacacaccccugauggagucuggguggagcgauaccgcccacggagugggcauuguuccgaugaaaaccgaccuggaacuugauuuugcucucgccuccucuucuuccuacagcuaucggagaaagcugguggacccugcgaauaaagaggaaacgcugcccuuccauuuccagcucgauaagcaggucgugcacgccgagauccagaaccuggggcacuggauggacggcaccuuuaacauuaagacagcuuuccauugcuacggagaauguaaaaaguaugccuacccuuggcaaaccgcuaaaugcuuuuucgagaaggauuaccaguaugagacaucuuggggcuguaaucccccugacugccccgggguuggaaccggcugcacagccugugggguguaccuugauaaacugcgcuccgucggaaaggcguauaaaaucgugagccucaaguuuacccggaaggugugcauccagcugggcacggaacagacauguaaacacauugacgucaacgauugccugguuaccccgucugugaaggugugucuuaucgggaccauuagcaaacuccaaccuggcgacacacugcuguuccucggaccccuggagcagggcgggaucauucuuaagcaguggugcaccacguccugugucuuuggagaccccggcgauaucaugagcacaaccacagggaugaaaugcccugaacauaccggaucuuucagaaagaucuguggcuuugccacaaccccgacgugcgaguaccaagggaauaccauuuccggcuuccagcgcaugauggcuacacgggacagcuuucaguccuucaacgugaccgaaccccacaucacaucuaauagacuggaguggauugauccugacagcuccaucaaggaucacauuaacaugguucucaaucgcgacgugucuuuucaggaucugagcgacaaccccuguaaagucgaucugcauacccaauccaucgacggagccuggggcucuggggugggauucacgcuuguuugcacagugggccucaccgagugcgcuaauuucaucacaagcauuaaggccugugauuccgccaugugcuauggggcuaccgucaccaaccugcugcggggaagcaauacagugaaaguugugggcaagggcgggcacucuggaucccucuuuaaauguugccaugacacggauuguaccgaagagggccuggcggccagcccuccccaccuugacagagucacaggguacaaccagaucgacucugauaagguguaugacgauggagcuccucccugcaccauuaaguguugguucacaaaauccggcgaauggcugcucgggauccugaauggaaacuggguggucguugccgugcugauugugauccuuauucugagcauccuccuguuuucuuucuuuugcccgauccgcggccggaagaauaaauccaacuga

SEQ ID NO: 13427 - RNA, 3447 nt, Artificial Sequence
  derived and/or modified CDS sequence (opt5) from PUUV(K27)__L08754.1__GP
augggcgagcugagccccgugugccucuaccugcuucugcaggggcuccugcuuuguaacaccggagccgcuagaaaucugaacgaacucaagauggagugcccucacacaauccggcugggccaagggcuggucguuggauccguggaacucccgucucugcccauucaacagguggagacgcuuaaacuggaaagcuccuguaauuucgaccuccauaccucuacagccggccagcagagcuuuaccaaguggacaugggagaucaaaggggaucuggcggagaacacccaggcuuccucuaccagcuuccagacaaaguccagcgaagucaaucuucgcggacugugccucauuccuacgcuggugguugagaccgccgccagaaugcggaaaacaaucgcuuguuaugaccugucuugcaaccagaccgugugucaacccacagucuaccucaugggcccuauucagaccugcaucacgacaaaguccugucugcuuagccugggcgaucagcgcauccaggugaauuaugaaaagaccuacugcguuucugggcaacucguggagggaauuuguuuuaaccccauccacacaauggcccugucccagccuagccauaccuaugacauuaugaccaugauggucagaugcuuccuugugaucaaaaaggugacaucuggcgauuccaugaaaauugagaagaauuuugaaacgcugguccagaaaaacgggugcaccgcuaauaacuuccaaggauacuauaucugucucauuggcagcuccucugagccgcuguacguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguauaccuccacgggaguucuuacaucuaaggaugaccccguguacaucugggcuccgggcauuaucauggaggggaaccacagcauuugcgagaaaaagacccugccucucaccuggacaggauuuaucucccugcccggcgaaaucgagaaaaccacacaguguacggucuucugcacccuugccgggccuggagcugauugugaagccuauagcgaaacaggcauuuuuaauaucucuuccccuaccugcagcauuaaccgggugcagcgcuucagaggcucugagcaacagaucaaguuuguuugucagcggguggacauggacauuacagucuacugcaacgggaugaaaaaggugauccugaccaagacgcucgucaucggacaguguauuuauaccuucacauccaucuucagccugauucccggcguggcccacucccuggcuguugagcucugcgugcccgggcugcauggaugggcgaccaugcuucugcuccugacacuguguuuuggcuggguccuuaucccgaccauuacgaugauccuccugaaaauucugaucgccuucgcuuaccucugcucuaaguauaauacagauagcaaauuucgcauccugauugaaaaggugaaaagagaguaccaaaagaccaugggguccaugguuugcgaagugugucaguacgagugcgaaacagccaaggagcuugagucucaccggaaaagcuguuccaucggcagcugccccuauugucugaacccuucugaagccaccaccuccgcucuccaggcccauuucaaggucugcaaacugacaagccgcuuucaggagaaucugagaaagucucuuacgguguacgaacccaugcaaggauguuaucggacccucucccuguucagauaccgcagccgguuuuucgugggccugguuuggugcguccuccuggugcuugagcugauugugugggcggcuucugccgagacacagaaccucaaugccggguggaccgacacagcucacggaagcggcaucauuccuaugaaaaccgaucuggaacuggacuuuucccuucccagcucugccuccuauacguacagacgccagcuccagaacccggcuaaugagcaagaaaagaucccuuuccaucugcagcugagcaagcaggucauccacgccgagauucaacaccucgggcauuggauggaugcgacauuuaaccugaaaaccgccuuccacuguuauggauccugcgaaaaguacgcuuaccccuggcagaccgccggcuguuuuaucgagaaagacuaugaguacgaaacaggguggggcugcaauccucccgauugcccuggagugggcaccggguguacagcuugcggaguuuaucuugacaagcugaaaucugugggcaaggucuucaagauugugagccuccgguacacgagaaaaguuuguauccagcuggggaccgagcagacaugcaagaccguggauuccaacgacugucugauuacaaccucugucaaagugugccuuaucggaacgaucagcaaguuccaacccuccgauacccuccuguuucugggcccgcuccagcagggaggccugauuuucaaacagugguguacaaccacaugccaauuuggagacccuggcgacaucaugucuacccccacagggaugaagugucccgaacuuaaugggagcuuccgcaaaaagugcgccuuugcgaccacgccuguuugucaguucgauggcaacacaauuuccggguauaagcggaugaucgccaccaaagacagcuuucagucuuucaaugugaccgagccgcauauuuccacaagcgcucuggaauggaucgaucccgacucuucccucagagaucacaucaacgucauugugagccgcgaccugucuuuucaggaucuguccgagaccccuugccaaaucgaccuugccacggcuagcauugauggagccuggggcuccggggugggcuucaaucuggucugcacaguuagccucaccgaguguucugccuuucugacaagcaucaaggcuugcgacgcggccauguguuacggauccaccacagcuaaccucgugcggggccagaacaccauucacaucguggggaaaggaggccauucugggagcaaguucaugugcugucacgauacgaaaugcuccucuaccggacuggucgccgccgcuccccaucuugacagagugacaggcuauaaucaggccgauagcgacaagauuuuugacgauggcgcgccugaaugugggauguccugcugguucaagaaaucuggagaguggauccugggcguucucaacgggaauuggaugguggucgcugugcugguugugcugcuuauccugagcauucuccuguucacccucuguugcccccgccggccuuccuacagaaaggaacacaaacccuga

SEQ ID NO: 13428 - RNA, 3447 nt, Artificial Sequence
  derived and/or modified CDS sequence (opt5) from PUUV(13891)__U22418.1__GP
augggcaagaucauucccgugugccuguaccuccuguuccuuugucugcuccuguggaacagaggggacgcccggaaucuuaacgagcugaaaauggaaugcccucacaccaucggacucggccaggggcuggucauuggaagcguugagcugccgcccgugccucucacacaaguggaaucccugaaacuugagucuagcuguaauuuugaucugcauacguccaccucuagccagcaguccuucacaaaauggaccugggaaaucaagaacgaccucgcugagaauacacaggccucuagcaccuccuuucaaacaaaaagcucugagauuaaccugcgcggccuuugccugauucccccucucgucaucgaaaccgcggcuagaacgcggaagaccauugccuguuucgaucuguccugcaaucagacagccugucagcccaccguguuucugaucgggccuauucagacaugcaucaccacaaagagcugucuccugggacuuggcgaccaacgcauucagguuaacuaugagaaaacguacugcgugucuggccagcuggucgaagggguguguuucaauccgguucacaccauggcucucucccagcccagccauacauaugauaucgugaccgucauggugagaugcuuucugauugugaagaaagucucuaccggagacuccaugaaacuugagaaguccuucgagacacugguucaaaagacgggcugcaccgggaacggauuucagggcuacuaugugugucucguggggagcucuagcgaaccucuguacauccccacacuggaugacuaucgguccgccgagauccucagccgcauggcuuucgccccucacggagaagaucaugacgucgagaagaaugcgauuucugccaugagaaucgugggcaaaguuaccggcaaggcucccuccacagaaagcucugauaccauucaggggaucgccuuuagcggaaacccgcuguacacguccacaggcgugcuuaccgcuaaagacgauccugucuacauuugggcccccgggaucaucauggagggaaaucacucugugugcgacaagaaaacccugccucucacauggaccggcuucauuccccugcccggggagaucgaaaagacaacgcaauguaccguguuuugcacacuugcgggaccuggcgccgacugugaggcuuauagcgaaaccggcauuuucaacaucuccagcccgacaugccugauuaaucggguucagcgcuucagaggggccgagcagcagaucaaauuuaucugucaacgggucgauauggacauuaccguguacugcaacggacucaagaaggucauccugacgaaaacccuggugauuggccaguguaucuauacauucaccucuaucuuuucccucauccccgggguugcucacagccuggccguggaacuuugcgucccuggacugcauggcugggccacaaugcuccugcugcuuaccuucuguuuuggguggauucucauccccuucuuuucuaugauccugcugaagauucucaucgcuuucgcguaccugugcuccaaauauaacacggauagcaaguuuaaaauucuuaucgagaaggugaagcgcgaguaccagaaaacaaugggcuccaugguuugcgaagugugucaguaugagugcgaaaccgccaaggagcuggaaucucacagaaaaagcuguccuauuggauccugccccuacugucucaauccggcugaggccacaaccucugcccugcaagcucauuucaaggucugcaaacugaccagccgguuucaggacaaccuucgcaagucccucggcgccuacgagccuaagcagggguguuauagaacacugagccuguuccgguacagaucucgcuuuuucgugggauucaauuggugccuccugcuugugcuggaacucaucguuugggcggcuuccgccgagacgcagagccugaacucuggcuggaccgauacagcccacggguccggaaucauucccaugcggaccgaccuggaacuugauuuuagccucccuucuagcgcuuccuauacauacagacgccaacugcagaaucccgccaacgagcaggagaaaaucccuuuccaucugcagauuagcaagcaagucauccacgcugaaauucagcaccucggccauuggauggacgggaccuuuaaucugaaaacggccuuccacuguuauggcucuugcgagaaguacgcguaucccuggcagacagccggauguuuuaucgaaaaagauuacgaguacgaauccggcugggggugcaacccgccugacugccccggagugggcaccggguguaccgcuugcggaguguaucuugauaagcucaagagcgucggcaaagccuucaagaucgugucccugcgguacacaagaaaggcuuguauucaacuggggaccgagcagacaugcaagucuguugacagcaaugacugucuggugacgaccuccgucaaagugugccuuaucggcacaguuucuaaguuucagcccagcgauacccuccuguuccugggaccucucgagcagggcgggcugauuuuuaaacaaugguguacaaccacgugccaguucggagacccgggcgauaucauguccacccccguggggaugaaguguccugaacuuucuggcagcuuucgcaagaaaugcgccuucgcgacaacccccgucugucaguuugacggaaacacacuguccggguauaagcggaugauugccaccaaagauagcuuccagucuuucaaugugacagagccucauaucuccgcuagcucucucgaauggaucgaccccgauuccagccugagagaccacauuaacguuaucgugggccgcgaucugucuuuucaagaccuuuccgagaccccuugccaggucgaucuggccacgacaagcauugacggagcuuggggcuccggggugggauucaaucucgugugcagcgucucucugaccgaauguagcaccuuucucacauccaucaaggccugcgauucugccauguguuacggcagcaccacggcuaaccugcuucgggggcagaauacaguucacauugugggaaaaggcggccauuccgggucuaaguucaugugcugucacgacaccaagugcagcuccacaggacugguggcggccgcuccccaucucgacagagucaccggcuauaaccaggccgauucugacaaaaucuuugaugacggggccccggaguguggaauuagcugcugguucacaaaguccggcgaguggauccugggggugcugaacggaaauuggaugguuguggcuguccuuaucgcccuguuuauuuucagcaucuuucucuucacccuguguugcccucgccggcccucuuacgcgaaagaacacaagccuuga

SEQ ID NO: 13429 - RNA, 3447 nt, Artificial Sequence
  derived and/or modified CDS sequence (opt5) from PUUV(CG17/Baskiria-2001)__AF442614.1__GP
augggcgagcugagccccgugugccucuaccugcuucugcaggggcuccugcuuuguaacaccggagccgcuagaaaucugaacgaacucaagauggagugcccucacacaaucggccuggggcaaggacuggucguuggcuccguggaacucccgucucugcccauucaacagguggagacgcuuaaacuggaaagcuccuguaauuucgaccuccauaccucuacagccgggcagcagagcuuuaccaaguggacaugggagaucaaaggagaucuggcggagaacacccaggcuuccucuaccagcuuccagaccaaguccagcgaagucaaucuucggggccugugccucauuccuacgcuggugguugagaccgccgcccgcaugagaaaaacaaucgcuuguuaugaccugucuugcaaccagaccgugugucaacccacagucuaccucaugggcccuauucagaccugcaucacgacaaaguccugucugcuuagccugggggaucagcggauccaggugaauuaugaaaagaccuacugcguuucuggacaacucguggagggcauuuguuuuaaccccauccacacaauggcccugucccagccuagccauaccuaugacauuaugaccaugaugguccgcugcuuccuugugaucaaaaaggugacaucuggggauuccaugaaaauugagaagaauuuugaaacgcugguccagaaaaacggaugcaccgcuaauaacuuccaaggcuacuauaucugucucauugggagcuccucugagccgcuguacguucccgcccuggacgauuacagaagcgcggaagugcucucccggauggccuuugcuccucacggagaggaccaugauaucgaaaagaaugccgugagcgcuaugcgcaucgccggcaaggucacaggcaaagcgcccucuaccgaguccagcgacacagugcaggggauugccuucucuggaagcccucuguauaccuccacgggcguucuuacaucuaaggaugaccccguguacaucugggcuccggggauuaucauggagggaaaccacagcauuugcgagaaaaagacccugccucucaccuggacaggcuuuaucucccugcccggggaaaucgagaaaaccacacaguguacggucuucugcacccuugccggaccuggcgcugauugugaagccuauagcgaaacaggcauuuuuaauaucucuucccccacaugccugauuaacagagugcagcgguuccgcggggccgagcaacagaucaaguuuguuugucagagaguggacauggacauuacagucuacugcaacggaaugaaaaaggugauccucaccaagacgcuggucaucggccaguguauuuauaccuucacaagcaucuucucucugauucccgggguggcucacucccucgcgguugagcugugcgugccuggacuucauggcugggccaccaugcugcuccugcugacauuuuguuucggguggguccuuaucccgaccauuacgaugauccuccugaaaauucugaucgcuuuugccuaccucugcagcaaguauaauacagauuccaaauuccggauccugauugaaaaggugaaacgcgaguaccaaaagaccaugggcucuaugguuugcgaagugugucaguacgagugcgaaacagccaaggagcuugagagccacagaaaauccuguucuaucggaagcugccccuauugucugaacccuuccgaagcuaccaccagcgcccuccaggcgcauuuuaaggucugcaaacugacaucucgguuccaggagaaucugcgcaagucccuuacgguguacgaacccaugcaaggcuguuauagaacccucagccuguuucgguacagaucucgcuucuuuguggggcugguuuggugcguccuccuggugcuugagcugauugugugggcugccuccgccgagacacagaaccucaaugcuggauggaccgacacagcccacggcagcgggaucauuccuaugaaaaccgaucuggaacuggacuucucucuucccagcuccgcuagcuauacguaccggagacagcuccagaacccggccaaugagcaagaaaagaucccuuuucaucugcagcugucuaagcaggucauccacgcggagauucaacaccucggacauuggauggaugccacauucaaccugaaaaccgcuuuucacuguuauggcuccugcgaaaaguacgccuaccccuggcagaccgcuggguguuucaucgagaaagacuaugaguacgaaacaggcuggggaugcaauccucccgauugcccuggcguggggaccggauguacagccugcggcguuuaucuugacaagcugaaaagcguggggaaggucuucaagauugugucccuccgcuacacgcggaaaguuuguauccagcugggaaccgagcagacaugcaagaccguggauucuaacgacugucugauuacaaccagcgucaaagugugccuuaucggcacgaucuccaaguuucaacccucugauacccuccuguuccuggggccgcuccagcagggcggacugauuuuuaaacagugguguacaaccacaugccaauucggcgacccuggggacaucaugagcacccccacaggaaugaagugucccgaacuuaauggcuccuuucgcaaaaagugcgcguucgccaccacgccuguuugucaguuugaugggaacacaauuucuggauauaagagaaugaucgcuaccaaagacagcuuccaguccuuuaaugugaccgagccgcauauuagcacaucugcccuggaauggaucgaucccgacuccagccuccgggaucacaucaacgucauugugucuagagaccuguccuuccaggaucugagcgagaccccuugccaaaucgaccuugcuacggccucuauugauggcgccuggggguccggcgugggauuuaaucuggucugcacaguuagccucaccgaguguuccgcuuuccugacaagcaucaaggcgugcgacgccgcuauguguuacggcucuaccacagccaaccucgugcgcgggcagaacaccauucacaucgugggaaaaggcgggcauagcggauccaaguuuaugugcugucacgauacgaaaugcucuagcaccggccuggucgccgcugcgccccaucuugaccacgugacaggcuauaaucaggccgauuccgacaagauuuucgacgauggggcuccugaauguggaaugucuugcugguucaagaaaagcggcgaguggauccuggggguucucaacggaaauuggaugguggucgccgugcugguugugcugcuuauccuguccauucuccuguuuacccucuguugcccccggagaccuucuuaccgcaaggaacacaaacccuga

SEQ ID NO: 13430 - RNA, 3447 nt, Artificial Sequence
  derived and/or modified CDS sequence (opt5) from PUUV(CG215/Omsk)__AF442615.1__GP
augggcaagcugagccccgugugccucuaccugcuucugcagugucuccugcuuggggacagaggagaugcccggaaccugaaugagcucaaaauggaaugcccucacaccaucggccuggggcaaggacuggucguuggcuccguggagcucccgcccgugccuauucagcaggucgaaucucugaaacuugagagcuccuguaacuucgaccugcauacaucuacggcugggcagcaauccuuuaccaaauggacaugggaaaucaagaaugaucucgccgagaacacccaggcguccucuaccagcuuccagacaaaauccagcgaggugaaucugcgcggacuuugccugauucccacacucguuguggaaaccgcugccagaacgcggaagaccaucgccuguuaugaccugacaugcaaccagaccgucugucaaccuacaguguaccugaugggccccauucagaccugcguuacgacaaagucuugucuccugggccuuggggaucagcgcauccaggugaauuaugagaaaaccuacugcgucuccggacaacugguggaaggcguguguuuuaacccuauccacacaauggcucucagccagccgucucauaccuaugacgucaugacccugaugguuagaugcuuccuuauuaucaagaaagugacauccggggauagcaugaagauugagaaaaauuuugagacgcuggugcagaagaccggaugcacaggcaacaauuuccaaggguacuauaucugucucauuggaucuuccagcgaaccccuguacgucccuacccuggacgauuaccgguccgccgaggugcucucucgcauggcuuuugcgccccacggcgaagaccaugauaucgagaagaacgccguuagcacaaugagaauugccggcaaagugaccgggcgggcuccuuccacggaagccagcgacacaguccagggaaucgcuuucucuggcagcccccuguauaccagcaccggggugcuuacagccaaggaugacccgguuuacaucugggcgccuggaauuaucauggagggcaaucacucuagcugcgacaaaaagacccugccccucacauggacgggguuuauuucccugccuggagagaucgaaaagaccacacaguguaccguguucugcacacuugccggccccggcgcugauugugaggccuauucugaaaccgggauuuuuaacaucagcucccccacgugccugaucaaucgcguccagagauuccggggagcugagcaacagauuaaguuugugugucagcgcgucgacauggauaucauuguguacugcaacggcaucaaaaagguuauucucaccaagacacuggugaucgggcaguguaucuauaccuucacaagcauuuucucucugaucccuggagucgcccacucccucgccguggaacugugcguuccgggccuucauggguggaccacgaugcugcuccugcugacauuuuguuucggcugggugcuuauucccuuuaucaccaugauucuccugaaaauccugauugcuuucgcguaccucugcagcaaguauaacacagacucuaaauuuagaauccuggucgagaaggugaaaaaggaguaccaaaagaccaugggauccauggugugcgaaguuugucaguacgagugcgaaaccgccaaagagcuugaaagccaccggaaguccuguucuaucggcagcugcccuuauugucugaaucccuccgaggcuacaacgucugcccuccaggcccauuucaaagucugcaagcugaccagccgcuuucaggagaaccugagaaaaucccuuacaguguacgaaccuaugcaaggguguuaucggacccucagccuguucagauaccgcucuaaguuuuucgugggacuggucuggugccuccugcuugugauggagcugauuguuugggcugccuccgcggaaacacagaaucucaacagcggcuggaccgauacggcucacgggucuggaaucauucccaugaagacagaccuggagcuggauuuuucccuuccgagcucugccagcuauaccuaccggagacagcuccagaauccugccaacgagcaagaaaagauccccuuccaucugcagauuuccaaacaggugauccacgcugagauccaacaccugggccauuggauggacgccaccuuuaaucucaaaacagcuuuccacuguuaugggagcugcgaaaaguacgccuacccuuggcagaccgcgggcuguuucauugagaaagauuaugaauacgagacaggauggggcugcaaucccccugacugccccggggucggaacgggcuguaccgccugcgggguguaucuggauaaacuuaagucuguuggaaaaguguuuaagaucgucucccugaaauacacacgcaagguguguauucagcucggcaccgagcagacaugcaaaaccguugacagcaacgacugucugaucacgaccuccgugaaggucugcaugauugggacaaucucuaaauuccaaccgagcgauacccugcuuuuucucggcccucugcagcagggaggccugaucuucaagcagugguguacaaccacaugccaauuuggggaccccggagauauuauguccacccccacgggcaugaaguguccugaacucaacgggucuuuccggaaaaagugcgcuuuugccacaaccccggugugucaguucgacggaaauaccaucagcggcuauaaaagaaugauugcuacaaaggauuccuuucagucuuucaacgugaccgagccccauaucagcgccuccgcgcuggaauggauugacccugauagcucucuucgcgaccacaucaaugucguuguggggcgggaucuguccuuucaggaccucagcgagacgcccugccaaguggaucugaugacaucuaccaucgacggcgccuggggauccggcgucggguucaaccuggugugcacaguuagccuuaccgaauguucuccuuuucugacauccauuaaggcuugcgauagcgccauguguuacggauccaccacggugaaucucgucagaggccagaacaccgugcacaucguugggaagggaggccauagcggcucuaaguucaugugcugucacgacacaaaaugcagcuccaccgggcugguggcugccgcuccccaucucgaccgcgucacaggauauaaccaggccgauucugacaagauuuucgaugacggcgcgccugagugugggaugagcugcugguuuaaaaaguccggagaguggauccugggcgugcuuaaugggaacuggaugguuguggccguccugauugcucuccugauccugucuauucuuauguucacccuguguugcccccggagaccgagcuaccgcaaagaacacaagccuuga

SEQ ID NO: 13431 - RNA, 3447 nt, Artificial Sequence
  derived and/or modified CDS sequence (opt5) from PUUV(CG222/Omsk)__AF442616.1__GP
augggcaagcugagccccgugugccucuaccugcuucugcagugucuccugcuuggggacagaggagaugcccggaaccugaaugagcucaaaauggaaugcccucacaccaucggccuggggcaaggacuggucguuggcuccguggagcucccgcccgugccuauucagcaggucgaaucucugaaacuugagagcuccuguaacuucgaccugcauacaucuacggcugggcagcagagcuuuaccaaauggacaugggaaaucaagaaugaucucgccgagaacacccaagcguccucuaccagcuuccagacaaaauccagcgaggugaaucugcgcggacuuugccugauucccacacucguuguggaaaccgcugccagaacgcggaagaccaucgccuguuaugaccugacaugcaaccagaccgucugucaaccuacaguguaccugaugggccccauucagaccugcguuacgacaaagucuugucuccugggccuuggggaucagcgcauccaggugaauuaugagaaaaccuacugcgucuccggacaacugguggaaggcguguguuuuaacccuauccacacaauggcucucagccagccgucucauaccuaugacgucaugacccugaugguuagaugcuuccuuauuaucaagaaagugacauccggggauagcaugaagauugagaaaaauuuugagacgcuggugcagaagaccggaugcacaggcaacaauuuccaaggguacuauaucugucucauuggaucuuccagcgaaccccuguacgucccuacccuggacgauuaccgguccgccgaggugcucucucgcauggcuuuugcgccccacggcgaagaccaugauaucgagaagaacgccguuagcacaaugagaauugccggcaaagugaccgggcgggcuccuuccacggaagccagcgacacaguccagggaaucgcuuucucuggcagcccccuguauaccuccaccggggugcuuacagccaaggaugacccgguuuacaucugggcgccuggaauuaucauggagggcaaucacucuagcugcgacaaaaagacccugccccucacauggacgggguuuauuucccugccuggagagaucgaaaagaccacacaguguaccguguucugcacacuugccggcccccgcgcugauugugaggccuauucugaaaccggcauuuuuaacaucagcucccccacgugccugaucaauagaguccagcgguuccgcggggcugagcaacagauuaaguuugugugucagagagucgacauggauaucauuguguacugcaacggaaucaaaaagguuauucucaccaagacacuggugaucggccaguguaucuauaccuucacaagcauuuucucucugaucccuggggucgcccacucccucgccguggaacugugcguuccgggacuucauggcuggaccacgaugcugcuccugcugacauuuuguuucgggugggugcuuauucccuuuaucaccaugauucuccugaaaauccugauugcuuucgcguaccucugcagcaaguauaacacagacucuaaauuucggauccuggucgagaaggugaaaaaggaguaccaaaagaccaugggcuccauggugugcgaaguuugucaguacgagugcgaaaccgccaaagagcuugaaagccaccgcaaguccuguucuaucggaagcugcccuuauugucugaaucccuccgaggcuacaacgucugcccuccaggcccauuucaaagucugcaagcugaccagcagauuucaggagaaccugcggaaaucccuuacaguguacgaaccuaugcaaggcuguuauagaacccucagccuguuccgcuaccggucuaaguuuuucguggggcuggucuggugccuccugcuugugauggagcugauuguuugggcugccuccgcggaaacacagaaucucaacagcggauggaccgauacggcucacggcucugggaucauucccaugaagacagaccuggagcuggauuuuucccuuccgagcucugccagcuauaccuacagacgccagcuccagaauccugccaacgagcaagaaaagauccccuuccaucugcagauuuccaaacaggugauccacgcugagauccaacaccugggacauuggauggacgccaccuuuaaucucaaaacagcuuuccacuguuauggcagcugcgaaaaguacgccuacccuuggcagaccgcgggguguuucauugagaaagauuaugaauacgagacaggcuggggaugcaaucccccugacugccccggcgucgggacgggauguaccgccugcggcguguaucuggauaaacuuaagucuguugggaaaguguuuaagaucgucucccugaaauacacacggaagguguguauucagcucggaaccgagcagacaugcaaaaccguugacagcaacgacugucugaucacgaccuccgugaaggucugcaugauuggcacaaucucuaaauuccaaccgagcgauacccugcuuuuucucgggccucugcagcagggcggacugaucuucaagcagugguguacaaccacaugccaauuuggcgaccccggggauauuauguccacccccacgggaaugaaguguccugaacucaacggcucuuucagaaagaagugcgcuuuugccacaaccccggugugucaguucgacgggaauaccaucagcggauauaaacgcaugauugcuacaaaggauuccuuucagucuuucaacgugaccgagccccauaucagcgccuccgcgcuggaauggauugacccugauagcucucuucgggaccacaucaaugucguugugggcagagaucuguccuuucaggaccucagcgagacgcccugccaaguggaucugaugacaucuaccaucgacggggccuggggcuccggagucggcuucaaccuggugugcacaguuagccuuaccgaauguucugcuuuucugacauccauuaaagccugcgauagcgcuauguguuacggguccaccacggugaaucucguccgcggacagaacaccgugcacaucguuggcaaagggggacauagcggcucuaaguucaugugcugucacgacacaaagugcagcuccaccggccugguggccgccgcuccuccccucgaccgggucacaggguauaaccaggcggauucugacaagauuuucgaugacggagccccugaguguggcaugagcugcugguuuaaaaaguccggggaguggauccugggagugcuuaauggcaacuggaugguuguggcuguccugauugcccuccugauccugucuauucuuauguucacccuguguugccccagacgcccgagcuaccggaaagaacauaagccuuga

SEQ ID NO: 13432 - RNA, 3447 nt, Artificial Sequence
  derived and/or modified CDS sequence (opt5) from PUUV(CRF161)__AF367061.1__GP
augggcaagcugagccccgugugccucuaccugcuucugcagugucuccugcuuggggacagaggagaugcccggaaccugaaugagcucaaaauggaaugcccucacaccaucggccuggggcaaggacuggucguuggcuccguggagcucccgcccgugccuauucagcaggucgaaucucugaaacuugagagcuccuguaacuucgaccugcauacaucuacggcugggcagcaauccuuuaccaaauggacaugggaaaucaagaaugaucucguggagaacacccaggccuccucuaccagcuuccagacaaaauccagcgagguuaaucugcgcggacuuugccugauucccacacucguggucgaaaccgcggcuagaacgcggaagaccaucgccuguuaugaccugacaugcaaccagaccgugugucaaccuacaguuuaccugaugggccccauucagaccugcaucacgacaaagucuugucuccugggccuuggggaucagcgcauccaggugaauuaugagaaaaccuacugcgucuccggacaacugguggaaggcguguguuuuaacccuauucacacaauggcccucagccagccgucucauaccuaugacgucaugacccugaugguuagaugcuuccuuaucauuaagaaagugacauccggggauagcaugaagaucgagaaaaauuuugagacgcuggugcagaagaccggaugcacaggcaacaauuuccaaggguacuauauuugucucaucggaucuuccagcgaaccccuguacgucccuacccuggacgauuaccgguccgcugaggugcucucucgcauggccuuugcuccccacggcgaagaccaugauauugagaagaacgccguuagcacaaugagaaucgcgggcaaaguggccgggcgggcuccuuccaccgaagccagcgacacgguccagggaaucgcuuucucuggcagcccccuguauacaagcaccggggugcuuaccgccaaggaugacccgguuuacauuugggcgccuggaaucauuauggagggcaaucacucuagcugcgacaaaaagacacugccccucaccuggacaggguuuaucucccugccuggagagauucagaaaacgacccaguguacaguguucugcacccuugccggcccccgcgcugauugucaagccuauucugaaacaggcaucuuuaacaucagcuccccuaccugccugauuaauagaguccagcgguuccgcggggcugagcagcagaucaaguuugugugucaaagagucgacauggauauuaucguguacugcaacggaauuaaaaagguuauccucacgaagacccuggugaucggccaguguauuuauacauucaccagcaucuucucucugauucccggggucgcccacucccucgccguggaacugugcguuccgggacuucauggcuggacaaccaugcugcuccugcugacguuuuguuucgggugggugcuuauccccuuuauuacaaugauccuccugaaaauucugaucgcuuucgcguaccucugcagcaaguauaacaccgacucuaaauuucggauccuggucgagaaggugaaaaaggaauaccagaagacaaugggcuccauggugugcgagguuugucaguacgagugcgaaaccgccaaagagcuugaaagccaccgcaaguccuguucuauuggaagcugcccuuauugucugaaucccuccgaggcuaccacaucugcccuccaagcccauuucaaagucugcaagcugacgagcagauuucaggaaaaccugcggaaaucccuuaccguguacgagccuaugcagggcuguuauagaacacucagccuguuccgcuaccggucuaaguuuuucguggggcuggucuggugccuccugcuugugauggagcugaucguuugggcugccuccgcggaaacccagaaucucaacagcggauggacagauaccgcucacggcucugggauuauccccaugaagacggaccuggagcuggauuuuucccuuccgagcucugccagcuauacauacagacgccaacuccagaauccugccaacgaacaggagaaaauucccuuccaucugcaaaucuccaaacaggugauccacgcugagauucagcaccugggacauuggauggacgccaccuuuaaucucaagaccgcuuuccacuguuauggcagcugcgaaaaguacgccuacccuuggcagacagcgggguguuucaucgagaaagauuaugaauacgagaccggcuggggaugcaaucccccugacugccccggcgucgggacaggauguacggccugcggcguguaucuggauaaacuuaagucuguugggaagguguuuaagauugucucccugaaauacacccggaagguguguauccaacucggaacagaacagaccugcaaaacaguugacagcaacgacugucugauuaccacguccgugaaggucugcaugaucggcaccaucucuaaauuccagccgagcgauacacugcuuauucucgggccucugcagcaaggcggacugaucuuuaagcagugguguaccacaaccugccaguucggcgaccccggggauauuauguccacacccaccggaaugaaguguccugagcucaacggcucuuuuagaaagaagugcgcuuucgccacgacaccggugugucaguuugacgggaauaccaucagcggauauaaacgcaugauugcuaccaaggauuccuuccaaucuuuuaacgugacagagccccauaucagcgccuccgcgcuggaauggaucgacccugauagcucucuucgggaccacauuaaugucguugugggcagagaucuguccuuccaggaccucagcgagacccccugccagguggaucugaugacgucuacaaucgacggggccuggggcuccggagucggcuuuaaccuggugugcaccguuagccuuacagaauguucugcuuuccugaccuccauuaaagccugcgauagcgcuauguguuacggguccacaaccgccaaucucgugaagggacaaaacacgguccacauggugggcaaagggggacauagcggcucuaaguuuaugugcugucacgacaccaagugcagcuccacaggccugguugccgcugcgccucaucucgaccgcgugaccggguauaaccaggccgauucugacaaaaucuucgaugacggagcucccgaguguggcaugagcugcugguucaagaaauccggggaauggauucugggaguccuuaauggcaacuggauggugguugccgugcugaucgcccuccugauucugucuauccuuauguuuacacuguguugcccucggagacccagcuaccgcaaggagcacaagccguga

SEQ ID NO: 13433 - RNA, 3447 nt, Artificial Sequence
  derived and/or modified CDS sequence (opt5) from PUUV(CRF308/Omsk)__AF442617.1__GP
augggcaagcugagccccgugugccucuaccugcuucugcagugucuccugcuuggggacagaggagaugcccggaaccugaaugagcucaaaauggaaugcccucacaccaucggccuggggcaaggacuggucguuggcuccguggagcucccgcccgugccuauucagcaggucgaaucucugaaacuugagagcuccuguaacuucgaccugcauacaucuacggcugggcagcaauccuuuaccaaauggacaugggaaaucaagaaugaucucgccgagaacacccaggcguccucuaccagcuuccagacaaaauccagcgaggugaaucugcgcggacuuugccugauucccacacucguuguggaaaccgcugccagaacgcggaagaccaucgccuguuaugaccugacaugcaaccagaccgucugucaaccuacaguguaccugaugggccccauucagaccugcaucacgacaaagucuugucuccugggccuuggggaucagcgcauccagguuaauuaugagaaaaccuacugcguguccggacaacuggucgaaggcguguguuuuaacccuauucacacaauggcucucagccagccgucucauaccuaugacgugaugacccugauggucagaugcuuccuuaucauuaagaaaguuacauccggggauagcaugaagaucgagaaaaauuuugagacgcuggugcagaagaccggaugcacaggcaacaauuuccaaggguacuauauuugucucaucggaucuuccagcgaaccccuguacgugccuacccuggacgauuaccgguccgccgagguccucucucgcauggcuuuugcgccccacggcgaagaccaugauauugagaagaacgccgugagcacaaugagaaucgccggcaaaguugcugggcgggccccuuccaccgaagcuagcgacacggugcagggaaucgccuucucuggcagcccccuguauacaagcaccgggguccuuaccgcgaaggaugacccgguguacauuugggccccuggaaucauuauggagggcaaucacucuagcugcgacaaaaagacacugccccucaccuggacaggguuuaucucccugccuggagagauugaaaagacgacccaguguacaguuuucugcacccuugcuggccccggcgccgauugugaggcuuauucugaaacagggaucuuuaacaucagcuccccuaccugccugauuaaucgcgugcagagauuccggggagccgagcaacagaucaaguuugucugucagcgcguggacauggauauuaucgucuacugcaacggcauuaaaaaggugauccucacgaagacccugguuaucgggcaguguauuuauacauucaccagcaucuucucucugauucccggaaucgcccacucccucgcuguggaacugugcgucccgggccuucauggguggacaaccaugcugcuccugcugacguuuuguuucggcugggugcuuauucccuuuaucacaaugauucuccugaaaauccugaucgcguucgccuaccucugcagcaaguauaacaccgacucuaaauuucggauucugguugagaaggugaaaaaggaguaccaaaagacaaugggauccauggucugcgaagugugucaguacgagugcgaaaccgcuaaagagcuugaaagccacagaaaguccuguucuaucggcagcugcccuuauugucugaaucccuccgaggccaccacaucugcccuccaggcucauuucaaagugugcaagcugacgagccgcuuucaggagaaccugagaaaaucccuuaccguuuacgaaccuaugcaaggguguuaucggacacucagccuguucagauaccgcucuaaguuuuucgucggacugguguggugccuccugcuugugauggagcugauugucugggccgcguccgcugaaacccagaaucucaacagcggcuggacagauaccgcccacgggucuggaaucauucccaugaagacggaccuggagcuggauuuuucccuuccgagcucugccagcuauacauaccggagacagcuccagaauccugcuaacgagcaagaaaagauccccuuccaucugcagaucuccaaacaggugauucacgccgagauccaacaccugggccauuggauggacgcuaccuuuaaucucaaaaccgccuuccacuguuaugggagcugcgaaaaguacgcguacccuuggcagacagccggcuguuucauugagaaagauuaugaauacgagaccggauggggcugcaaucccccugacugccccgggguuggaacaggcuguacggcuugcgggguguaucuggauaaacuuaagucugucggaaaaguguuuaagaucguuucccugaaauacacccgcaagguguguauucagcucggcacagagcagaccugcaaaacagucgacagcaacgacugucugaucaccacguccgugaagguuugcaugaucgggaccauuucuaaauuccaaccgagcgauacacugcuuuuucucggcccucugcagcagggaggccugaucuucaagcagugguguaccacaaccugccaauuuggggaccccggagauauuauguccacacccaccggcaugaaguguccugaacucaacgggucuuuccggaaaaagugcgccuuugcuacgacaccggugugucaguucgacggaaauaccaucagcggcuauaaaagaaugauugccaccaaggauuccuuucagucuuucaacgucacagagccccauaucagcgcguccgcccuggaauggaucgacccugauagcucucuucgcgaccacauuaaugugguggucgggcgggaucuguccuuucaggaccucagcgagacccccugccaaguugaucugaugacgucuacaaucgacggcgcuuggggauccggcgugggguucaaccuggugugcaccgucagccuuacagaauguucugccuuucugaccuccauuaaggcuugcgauagcgccauguguuacggauccacaaccgccaaucucgugagaggccagaacacgguucacaucguggggaagggaggccauagcggcucuaaguucaugugcugucacgacaccaaaugcagcuccacagggcuggucgcugcggccccucaucucgaccgcgugaccggauauaaccaggcugauucugacaagauuuucgaugacggcgcccccgagugugggaugagcugcugguuuaaaaaguccggagaguggauccugggcguucuuaaugggaacuggaugguggucgccgugcugauugcucuccugauccugucuauccuuauguucacacuguguugcccucggagacccagcuaccgcaaagaacacaagccguga

SEQ ID NO: 13434 - RNA, 3447 nt, Artificial Sequence
  derived and/or modified CDS sequence (opt5) from PUUV(Mu/07/1219)__KJ994777.1__GP
auggagaagaucauucccgugugccuguaccucccuuuccugugucuucugcucuggagcagaggcgacacccggaaccugaaugaacuuaaaauggagugcccgcacacaaucgggcugggacagggccucgucauuggguccaucgaacugcccccuguuccccugauucaaguggagucucucaagcuggaaagcuccuguaacuuugaucuucauacgucuaccagcucccagcaggccuucacaaaauggaccugggaggugaagucugaccuggcugagaauacacaggccagcuccaccagcuuucaaacaaaaucuuccgaagucaaccuccgcggacugugccuugugccuccccugguuaucgagaccgcggcuagaacgcggaagaccaucgccuguuucgaucucagcugcaaucagacaaccugucagccuacaguguuucugaugggcccgauucagaccugcaucacgacaaagucuugucugcucgggcugggagaccaacgcauucaggucaacuaugaaaagaccuacugcguguccggccagcuuaucgagggcauuuguuucaaucccguucacacaauggcccugagccagccuucucauaccuaugauaucgugaccgucauggugagaugcuuucucauugugaagaaagucacaacgggggacuccaugaagaucgagaaauccuucgaaacccugguucaaaagacaggaugcaccgauaacggcuuucagggguacuaugugugucuuaucggaagcucuagcgagccccuguacauuccuacacucgacgauuaucgguccgcugaagugcugagccgcauggccuucgcuccccacggcgaggaccaugauaucgaaaagaaugccauuucugcgaugagaaucgucgggaaagugaccggaaaggccccguccacggagagcucugacacaguucagggcauugcuuuuagcggcaacccucuguacaccuccaccggggugcucacagccaaagaugaccccgucuacgugugggcuccuggaaucaugauggagggcaaucacucuguuugcgaaaagaaaacccugccccuuacauggacgggguucaucccccugccuggagagauugaaaagaccacacaauguaccguguuuugcacacucgccggcccgggggcggacugugaggccuauagcgaaaccggaaucuucaacauuuccagccccacgugccugaucaaucggguccagcgcuucagaggcgcugagcagcagauuaaauuuaucugucaacggguggauauggacaucaccgucuacugcaacggccuuaagaaggugauucugacaaaaacccucguuaucgggcaguguauuuauacauucaccucuaucuuuucccugauuccuggaguggcccacagccuggcugucgagcucugcgugcccggccugcaugggugggccacgaugcuucugcuccugacauucuguuuuggauggauccugauuccuuucuuugccaugauccuucucaagguucugaucgcucuggcguaccucugcucuaaauauaauaccgauuccaaguucaaagugcugauugaaaaggucaagaaagaguaccagaagacaaugggcagcauggugugcgaagugugucaguaugagugcgaaaccgccaaagagcuugagucccaccgcaagucuugucccauggggagcugcccguacugucugaacccugcugaagccaccacauccgcccuccaagcucauuuuaaaguuugcaagcugacgucuagauuccaggacaaccugagaaagagccuuggcgccuacgagcccaaacagggauguuaucgcacccucucccuguuuagauaccggagcagauucuuugucggcuucaucuggugccugcuccuggugcuugaacugauugugugggcggcuucugccgagacacagaaucucaacuccggguggaccgauacagcccacggaagcggcgucaucccuaugcgcaccgaccuggagcuggauuucucucuucccuccagcgcuucuuauacguaccggagacaacuccagaauccugccaacgaacaggagaagauucccuuucaccuucagaucagcaaacaagugauccaugcugaaauucagcaccuggggcauuggauggacggaacauucaaucucaagaccgccuuucacuguuauggcuccugcgagaaauacgcguauccguggcagaccgccggguguuucguugaaaaggauuacgaguacgagagcggcuggggaugcaacccugcugacugccccggcguggggacaggauguaccgccugcggcgucuaucuggauaagcugaaaucuguggggaaggcuuuuaaaaucguuucccugcgcuacacacggaaggccuguauucaacucggaacggaacagaccugcaaaaauguggacagcaacgacugucuggucacaaccuccgugaagguuugccugaucggcacagugucuaaauuccagcccagcgauacccuucucuuucuggggccucuggagcagggcggacucauuuucaagcaaugguguacgaccacaugccaguuuggcgacccgggggauaucauguccacccccgucggaaugaaguguccugaacugucuggcagcuuccggaaaaagugcgcguuugccacaacccccgugugucaguucgacgggaauacaaucuccggauauaaacgcaugauugcuaccaaggauucuuuucagagcuucaacgugacggagccucauaucuccgccagcucucuugaauggauugaccccgauuccagccugcgggaccacaucaaugucauuguuggcagagaucucucuuuccaagaccuguccgagacaccuugccagguggaucugaccaccacaagcaucgacggggcuuggggcucuggagugggcuuuaaccuuaucugcuccgucagccugaccgaguguuccacguuccucacaagcauuaaagccugcgauucugccauguguuacgggagcaccacagcuaaucuggugcgcggacagaacaccguucacaucgugggcaaagggggacauuccggcucuaaguuuaugugcugucacgacacaaaaugcagcuccaccggccucgucgcggccgcuccccaucuggaccgggugacgggguauaaucaggccgauucugacaagauuuucgaugacggagccccggaauguggcaucagcugcugguuuaccaaauccggggaguggauucuuggaguucugaacggcaacuggaugguggucgcugugcucguugcccuguucauccugucuauuuuucuuuucacacuguguugcccuagacgccccagcuacgcgaaggaacacaaaccuuga

SEQ ID NO: 13435 - RNA, 3447 nt, Artificial Sequence
  derived and/or modified CDS sequence (opt5) from PUUV(Puu/Kazan)__Z84205.1__GP
augggcaagcugagccccgugugccucuaccugcuucugcaggggcuccugcuuuucaacaccggaacagccagaaaucugaacgagcucaaaauggaauguccucacacgaucggccuggggcaaggacuggucguuggcuccguggagcucccgcccgugccuauucagcaggucgaaacccugaagcuggagucuagcugcaauuuugaccugcauacauccaccgcugggcagcaagccuucacaaaauggaccugggaaaucaagggagaucucgcggagaacacacaggcuucuagcaccuccuuucagacgaaaucuagcgaggugaaucugcggggccuuugucugauucccacccucguuaucgaaacagccgcccgcaugagaaagaccauugcuugcuaugaccuguccuguaaccagacagugugccaaccuaccgucuaccugaugggccccauccagacguguaucacaaccaagagcugccuccuggggcuuggagaucagcggauucaggugaauuaugagaaaacauacuguguuucuggccaacugguggaaggggucugcuucaacccuauccacaccauggcccucucccagccgagccauaccuaugacauugugacaaugauggugcgcuguuuucuggucaucaagaaaguuacgucuggagauuccaugaagauugagaaaaauuucgagacccuugugcagaagaacggcugcacagcuaauagcuuucaaggguacuauaucugccugauuggaucuuccagcgaaccccucuacgugccuacccuggacgauuacagauccgccgagguccugucucggauggcguucgcuccccacggcgaagaccaugauguggagaagaacgccaucagcgcccuccgcaucgcuggcaaaguuacagggaaggccccuuccaccgaaagcucugacacggugcagggagucgcguuuuccggcagcccccuguauacaucuaccggggugcuuaccgccaaagaugacccgguuuacauuugggcuccuggaaucauuauggagggcaaucacagcgugugugagaagaaaacacugccccucaccuggacaggguucaucucccugccuggagaaauugagaagacgacccagugcacagucuuuuguacccuugccggccccggcgcugauugcgaagccuauucugagacagggaucuucaacaucagcucccccaccugucugauuaauagagugcagcgguuucgcggagccgaacaacagaucaaauucgucugccagagaguggacauggacauuacgguuuacuguaacggcgugaagaaggucauccucaccaaaacacuggugauugggcagugcaucuauaccuucacaagcaucuuuucucugauuccuggaguugcucacucccucgcgguggagcugugugucccgggccuucaugggugggccaccaugcugcuccugcugacguucugcuuuggcugggugcuuauccccacaauuaccaugauccuccugaagauucugaucgcuuucgccuaccucuguagcaaauauaacacagauucuaaguuucggauucugaucgagaaagugaagaaggaauaccaaaagaccaugggauccaugguuugcgaggucugccaguacgaaugugagaccgccaaggaacuugagagccaccgcaaauccugcucuaucggcagcuguccuuauugccugaaucccuccgaggcuacaacgucugcccuccaggcgcauuucaagguguguaaacugaccagccggauucaggaaaaccugagaaagucccuuacaguguacgagccuaugcaagggugcuaucgcacccucagccuguuuagauaccggucuagauucuuugucggacuggugugguguguucuccuggugcuugaacugaucgucugggcugccuccgccgagacacagaaucucaacgcuggcuggaccgacacggcccacgggagcggaauuauccccaugaagacagaucuggagcuggacuucucucuuccguccagcgcuucuuauaccuaccgccggcagcuccagaauccugccaacgaacaagagaauauucccuuucaccuucagaucagcaaacaggugauccaugcggaaauucaacaccugggccauuggauggaugccaccuucaaccucaagacagcuuuucacugcuauggguccugugagaaauacgccuacccuuggcagaccgcuggcugcuucguugaaaaggacuaugaguacgagacaggauggggcuguaaucccccugauugccccggggugggaacgggcugcaccgccuguggggcguaucuggacaaacuuaagagcgucggaaagguguucaaaaucguuucucugagauacacacgcaaggugugcauucagcucggcaccgaacagacauguaaaaccgucgauuccaacgacugccugaucacgaccagcgugaaggugugucugauugggacaaucuccaaauuucaaccgucugauacccuucucuuccugggcccucugcagcagggaggccucaucuuuaagcaguggugcacaaccacaugucaauucggggaccccggagacauuaugagcacccccacgggcaugaaaugcccugaucugaauggguccuuucggaagaagugugccuucgcuacaaccccggucugccaguuugacggaaacaccaucucuggcuauaaaagaaugauugccacaaaggauagcuuccaguccuuuaauguuaccgagccccauaucucugcuagcgcccuugaauggauugacccugauuccagccugcgcgaccacaucaacgugaucgugucucgggaucucuccuuccaggaccugagcgagacgcccugucaaauugaucugucuacagccuccaucgacggggcuuggggcagcggagucggcuuuaaucuugugugcaccguuucucugacagaaugcuccgcguuccucaccagcauuaaagccugugaugcugccaugugcuacggguccacaaccgccaaccuggugagaggacagaacacgauccacauugucggcaaagggggacauagcggcucuaaauuuauguguugccacgacaccaaguguagcacaaccggccucguggcugccgcgccucaucuggaucgcguuacaggguauaaucaggcugacuccgacaagaucuucgaugacggagcccccgagugcggcaugucuuguugguucaaaaagagcggggaguggauucuuggagugcugaacggcaauuggauggucguggccguucucaucgcucugcugauccuuuccauucugcucuuuacccugugcuguccucggagacccucuuaccgcaaagaacacaagccguga

SEQ ID NO: 13436 - RNA, 3447 nt, Artificial Sequence
  derived and/or modified CDS sequence (opt5) from PUUV(PUUV/Ardennes/Mg156/2011)__KT247603.1__GP
augggcaagaucauucccgugugccuguaccuccuguuccuuugucugcuccugugggacagaggggauacccggaaccuuaaugagcugaaaauggaaugcccucacacaaucggacucggccaggggcuggucauuggaagcguugagcugccgcccgugccucucacgcaaguggaaucccugaaacuugagucuagcuguaacuuugaccugcauaccuccacaucuagccagcaguccuucaccaaauggacaugggaaaugaaggucgaucucgccgagaauacccaggcuucuagcacauccuuucaaaccaaaagcucugagaucaaccugcgcggccuuugccuggugcccccucucguuauugaaacggccgcgagaacccggaagacaaucgcuuguuucgaccuguccugcaaucagaccgccugucagcccacaguguuucugaucgggccuauucagaccugcaucacgacaaagagcugucuccugggacuuggcgaucaacgcauucaggucaacuaugagaaaaccuacugcgugucuggccagcugguugaagggaucuguuucaauccggugcacacaauggcccucucccagcccagccauaccuaugacauugucaccgugauggugagaugcuuucugaucgucaagaaaguuucuacaggagauuccaugaaacuugagaaauccuucgagacgcuggugcaaaagaccggcugcacagggaacggauuucagggcuacuaugugugucucauuggguccucuagcgaaccucuguacauccccacccuggacgauuaucgguccgcugagguccucagccgcauggccuucgcuccucacggagaagaccaugauaucgagaagaaugccauuucugcgaugagaaucgugggcaaaguuacaggcaaggcccccuccaccgaaagcucugacacggugcaggggauugcuuuuagcggaaacccgcuguacacauccaccggcguccuuaccgccaaagaugacccuaucuacauuugggcucccgggaucaucauggagggaaaucacucugugugcgacaagaaaacacugccucucaccuggacaggcuucauuccccugcccggggagaucgaaaagacgacccaauguacaguguuuugcacccuugccggaccuggcgcggauugugaggccuauagcgaaacaggcauuuucaacaucuccagcccgaccugccugauuaaucggguucagcgcuucagaggggcugagcagcagaucaaauuuaucugucaacgggucgacauggauauuacgguguacugcaacggacucaagaaggucauccugaccaaaacacuggugauuggccaguguaucuauaccuucacaucuauuuuuagccucauccccgggguugcccacagccuggcuguggaacuuugcgucccuggacugcauggcugggccaccaugcuccugcugcuuacguucuguuuuggguggauucucauccccuucuuuucuaugauccugcugaagauucucaucgccuucgcuuaccugugcuccaaauauaauacagacagcaaguuuaaaauucuuaucgagaaggugaagaaagaguaccagaagaccaugggcuccaugguuugcgaagugugucaguaugagugcgaaacagcgaaagagcuggaaucucaccgcaagagcuguccuaugggauccugccccuacugucucaacccggccgaggcuaccaccucugcccugcaagcccauuucaaagucugcaagcugacaagcagauuucaggauaaccuucggaagucccucggcgcuuacgagccuaaacagggguguuaucgcacgcugagccuguucagauaccggucuagauuuuucgugggauucauuuggugcuuucuccuggugcuugaacugaucguuugggccgcguccgcugagacccagaaucucaacagcggcuggacagacaccgcccacgggucuggaaucauucccaugcgcacagaucuggaacuggacuucucccuuccuagcucugccagcuauaccuaccggagacaacuccagaaucccgcuaacgagcaggagaagaucccuuuucaucugcagauuuccaaacaagucauccacgccgaaauucagcaccugggccauuggauggaugggacguucaaucucaagacagcuuuucacuguuauggcagcugcgagaaauacgccuaucccuggcagaccgcgggauguuucguggaaaaggacuacgaguacgaaucuggcugggggugcaacccgccugauugccccggagugggcaccggguguacagccugcggagucuaucuggacaaacuuaaguccgugggcaaggcuuuuaaaaucguuagccugcgcuacacccggaaggccuguauccaacucgggacagagcagacgugcaaauccguggacucuaaugauugucuggucaccacaagcgugaagguuugccugauuggcaccguguccaaauuccagcccucugacacacuucucuuucugggaccucuggagcagggcgggcucaucuucaagcaaugguguaccacgaccugccaguuuggagauccgggcgacauuaugagcacacccgucgggaugaaguguccugaacuguccggaucuuucagaaagaagugcgcuuuugccaccacacccgugugucaguucgauggcaacacccuuagcggguauaaacgcaugaucgcgacaaaggacuccuuccagagcuuuaauguuaccgagccucauauuucugccuccagccuggaauggaucgaucccgacucuucccuccgggaucacaucaacgugauugucggcagagaccugagcuuccaagaucugucugagacgccuugccagguggaccuugcuacauccagcaucgauggagccuggggcuccggggugggauuuaaucuggucugcagcguuucucucaccgaauguagcaccuuccugacauccauuaaggcuugcgacucugccauguguuacggcagcaccacggccaaccuccugcgcgggcagaauacagugcacaucgugggaaagggcggccauuccgggucuaaguuuaugugcugucacgacaccaaaugcagcuccacaggacuugucgcugcggcuccccaucuggaucgggugaccggcuauaaccaggccgacucugauaagauuuucgacgauggggccccggaguguggaaucagcugcugguuuacaaaauccggcgaguggauucucgggguucugaauggaaacuggaugguggucgccgugcugguugcucuuuucauccugagcaucuuucucuucacccuguguugcccuagacgccccucuuacgccaaggaacacaaaccuuga

SEQ ID NO: 13437 - RNA, 3447 nt, Artificial Sequence
  derived and/or modified CDS sequence (opt5) from PUUV(PUUV/Ardennes/Mg75/2011)__KT247602.1__GP
augggcaagaucauucccgugugccuguaccuccuguuccuuugucugcuccugugggacagaggggauacccggaaccuuaaugagcugaaaauggaaugcccucacacaaucggacucggccaggggcuggucauuggaagcguugagcugccgcccgugccucucacgcaaguggaaucccugaaacuugagucuagcuguaacuuugaccugcauaccuccacaucuagccagcaguccuucaccaaauggacaugggaaaugaaggucgaucucgccgagaauacccaggcuucuagcacauccuuucaaaccaaaagcucugagaucaaccugcgcggccuuugccuggugcccccucucguuauugaaacggccgcgagaacccggaagacaaucgcuuguuucgaccuguccugcaaucagaccgccugucagcccacaguguuucugaucgggccuauucagaccugcaucacgacaaagagcugucuccugggacuuggcgaucaacgcauucaggucaacuaugagaaaaccuacugcgugucuggccagcugguugaagggaucuguuucaauccggugcacacaauggcccucucccagcccagccauaccuaugacauugucaccgugauggugagaugcuuucugaucgucaagaaaguuucuacaggagauuccaugaaacuugagaaauccuucgagacgcuggugcaaaagaccggcugcacagggaacggauuucagggcuacuaugugugucucauuggguccucuagcgaaccucuguacauccccacccuggacgauuaucgguccgcugagguccucagccgcauggccuucgcuccucacggagaagaccaugauaucgagaagaaugccauuucugcgaugagaaucgugggcaaaguuacaggcaaggcccccuccaccgaaagcucugacacggugcaggggauugcuuuuagcggaaacccgcuguacacauccaccggcguccuuaccgccaaagaugacccuaucuacauuugggcucccgggaucaucauggagggaaaucacucugugugcgacaagaaaacacugccucucaccuggacaggcuucauuccccugcccggggagaucgaaaagacgacccaauguacaguguuuugcacccuugccggaccuggcgcggauugugaggccuauagcgaaacaggcauuuucaacaucuccagcccgaccugccugauuaaucggguucagcgcuucagaggggcugagcagcagaucaaauuuaucugucaacgggucgacauggauauuacgguguacugcaacggacucaagaaggucauccugaccaaaacacuggugauuggccaguguaucuauaccuucacaucuauuuuuagccucauccccgggguugcccacagccuggcuguggaacuuugcgucccuggacugcauggcugggccaccaugcuccugcugcuuacguucuguuuuggguggauucucauccccuucuuuucuaugauccugcugaagauucucaucgccuucgcuuaccugugcuccaaauauaauacagacagcaaguuuaaaauucuuaucgagaaggugaagaaagaguaccagaagaccaugggcuccaugguuugcgaagugugucaguaugagugcgaaacagcgaaagagcuggaaucucaccgcaagagcuguccuaugggauccugccccuacugucucaacccggccgaggcuaccaccucugcccugcaagcccauuucaaagucugcaagcugacaagcagauuucaggauaaccuucggaagucccucggcgcuuacgagccuaaacagggguguuaucgcacgcugagccuguucagauaccggucuagauuuuucgugggauucauuuggugcuuucuccuggugcuugaacugaucguuugggccgcguccgcugagacccagaaucucaacagcggcuggacagacaccgcccacgggucuggaaucauucccaugcgcacagaucuggaacuggacuucucccuuccuagcucugccagcuauaccuaccggagacaacuccagaaucccgcuaacgagcaggagaagaucccuuuucaucugcagauuuccaaacaagucauccacgccgaaauucagcaccugggccauuggauggaugggacguucaaucucaagacagcuuuucacuguuauggcagcugcgagaaauacgccuaucccuggcagaccgcgggauguuucguggaaaaggacuacgaguacgaaucuggcugggggugcaacccgccugauugccccggagugggcaccggguguacagccugcggagucuaucuggacaaacuuaaguccgugggcaaggcuuuuaaaaucguuagccugcgcuacacccggaaggccuguauccaacucgggacagagcagacgugcaaauccguggacucuaaugauugucuggucaccacaagcgugaagguuugccugauuggcaccguguccaaauuccagcccucugacacacuucucuuucugggaccucuggagcagggcgggcucaucuucaagcaaugguguaccacgaccugccauuuuggagauccgggcgacauuaugagcacacccgucuccaugaaguguccugaacugucugggagcuucagaaagaagugcgcuuuugccaccacacccgugugucaguucgauggaaacacccuuuccggcuauaaacgcaugaucgcgacaaaggacagcuuccagucuuuuaauguuaccgagccucacauuuccgccagcucucuggaauggaucgaucccgacuccagccuccgggaucacaucaacgugauugucgggagagaccugucuuuccaggaucuguccgagacgccuugccaaguggaccuugcuacaagcuccaucgauggcgccuggggaagcggcgugggguuuaaucuggucugcucuguuagccucaccgaauguuccaccuuccugacaucuauuaaggcuugcgacagcgccauguguuacggauccaccacggccaaccuccugcgcggccagaauacagugcauaucguggggaagggaggccacucuggcagcaaguuuaugugcugucaugacaccaaaugcuccucuacagggcuugucgcugcggcuccccaccuggaucgggugaccggauauaaccaggccgacagcgauaagauuuucgacgauggcgccccggagugugggaucuccugcugguuuacaaaaagcggagaguggauucucggcguucugaaugggaacuggaugguggucgccgugcugguugcucuuuucauccugucuaucuuucucuucacccuguguugcccuagacgccccuccuacgccaaggaacacaaaccuuga

SEQ ID NO: 13438 - RNA, 3447 nt, Artificial Sequence
  derived and/or modified CDS sequence (opt5) from PUUV(PUUV/Jura/Mg2/2010)__KT247598.1__GP
augggcaagaucauucccgugugccuguaccuccuguuccuuugucugcuccuguggaacagaggggacacccggaaucuuaacgagcugaaaauggaaugcccucacacaaucggacucggccaggggcuggucauuggaagcguugagcugccgcccgugccucucacgcaaguggaaucccugaaacuugagucuagcuguaauuuugaucugcauaccuccacaucuagccagcaguccuucaccaaguggacaugggaaaugaagucugaccucgccgagaacacccaggcuagcuccaccagcuuucaaacaaaaucuuccgagaucaaucugcgcggccuuugccuggugcccccucucgucauugaaacggccgcgagaacccggaagacaaucgcuuguuucgaucugagcugcaaccagaccgccugucagcccacaguuuuucugaucgggccuauucagaccugccucacgacaaagucuugucugcuuggacugggcgaccaacgcauccaggugaauuaugagaaaaccuacugcgucuccggccagcucguggaagggguuuguuucaacccgauucacacaauggcccugagccagcccucucauaccuaugauaucgugaccgucauggugagaugcuuucuuauugugaagaaagucuccacaggagacagcaugaagaucgagaaauccuucgagacgcugguucaaaagaccggcugcacagggaauggauuucagggcuacuaugugugucucauugggucuagcuccgaaccucuguacauccccacccuggaugacuaucggagcgcugaggugcucucucgcauggccuucgcuccucacggagaagaucaugacaucgagaagaacgccauuuccgcgaugagaaucgucggcaaagugacaggcaaggcccccagcaccgaaucuagcgauacgguucaggggauugcuuuuuccggaaauccgcuguacacaucuaccggcgugcuuaccgccaaagacgauccuaucuacauuugggcucccgggaucaucauggagggaaaccacagcgucugcgagaagaaaacacugccucucaccuggacaggcuucauuccccugcccggggaaaucgagaagacgacccaauguacaguguuuugcacccuugccggaccuggcgcggacugugaagccuauuccgagacaggcauuuucaauaucagcucuccgaccugccugauuaaccggguucagcgcuucagaggggcugaacagcagaucaaauuuaucugucaacggguggacauggauauuacggucuacugcaauggacucaagaaggugauccugaccaaaacacuggucauuggccaguguaucuauaccuucacauccauuuuuagccucauccccgggguggcccacucucuggcuguugagcuuugcgugccuggacugcauggcugggccaccaugcuccugcugcuuacguucuguuuuggguggauucucauccccuucacagccaugcugcugcucaagauccugauugcuuuugcguaccuuugcuccaaauauaacaccgacagcaaguucaaaauccugauugagaaggucaagaaagaauaccagaagacaaugggcuccauggugugcgagguuugucaguaugaaugcgagaccgccaaagaacucgagucucaccgcaagagcuguccuaugggauccugccccuacugucugaacccggcugaggccaccacaucugcccugcaagcucauuuuaaagugugcaaacuuacgagcagauuccaggauaaucuccggaagucccugggcgccuacgaaccuaagcagggguguuaucgcacccugagccucuuuagauaccggucuagauucuuugucggacugguguggugcuuccuucuggugcucgagcugaucauuugggcggcuuccgccgaaacacagaaccugaauagcggcuggaccgacacagcccacgggucuggaguuauccccaugcgcaccgaucuugagcucgacuucucccugccuagcucugcuagcuauacguaccggagacaacugcagaaccccgccaaugagcaggaaaagaucccuuuucaccuccagauuuccaaacaagucauccaugcugagauucagcaccugggccauuggauggaugggacauucaaccuuaagaccgccuuucacuguuauggcagcugcgaaaaauacgcguaucccuggcagaccgccggauguuucguggagaaggacuacgaauacgagucuggcugggggugcaauccgccugauugccccggagugggcacaggguguaccgcuugcggagucuaucuggacaagcucaaauccgugggcaaggccuuucgcaucguuagccugaaauacacacggaaggcuuguauucaacuggggacggagcagaccugcaaauccguggauucuaacgacugucuugucacaaccagcgugaagguuugccucaucggcacaguguccaaauuccagcccucugacacccugcuguuucucggaccucuggaacagggcgggcuuaucuucaagcaaugguguacgaccacaugccaguuuggagauccgagagacauuaugagcacccccgucggcaugcgcuguccugagcuguccgggucuuuccggaagaaaugcgccuuugcgacaacccccgugugucaguucgauggaaauacaaucagcggcuauaagagaaugauugccaccaaagacuccuuucagagcuucaacguuacggaaccucauaucucugcuuccagccucgaguggauugaucccgacucuucccugcgcgaucacaucaaugugaucgucgggcgggaccugagcuuccaagaucuuucugaaacaccuugccagguggaccugaccaccacauccauugauggcgccuggggaagcggcgugggguuuaaccucaucugcuccgucagccugaccgaguguucuacguuccucacaagcauuaaggcuugcgacuccgccauguguuacggaucuaccacagccaaucugaugagaggccagaacaccauccacauuguugggaaaggaggccauagcggcuccaaguuuaugugcugucacgauacaaagugcucuagcaccgggcuuguggcugcggcuccccaucuggaccgcgugacgggauauaaucaggccgacuccgauaaaaucuucgacgauggcgccccggagugugggauuucuugcugguuuaccaagagcggagaauggauccucggcguccugaacgggaacuggauggugguugccgugcuggucgugcuuuucauccuguccauuuuucucuucacacuguguugcccucggagacccagcuacgcuaaagagcacaagccuuga

SEQ ID NO: 13439 - RNA, 3447 nt, Artificial Sequence
  derived and/or modified CDS sequence (opt5) from PUUV(PUUV/Jura/Mg214/2010)__KT247599.1__GP
augggcaagaucauucccgugugccuguaccuccuguuccuuugucugcuccuguggaacagaggggacacccggaaucuuaacgagcugaaaauggaaugcccucacacaaucggacucggccaggggcuggucauuggaagcguugagcugccgcccgugccucucacgcaaguggaaucccugaagcuggagucuagcuguaauuuugaucugcauaccuccacaucuagccagcaguccuucaccaaauggacaugggaaaugaagucugaccucgccgagaacacccaggcuagcuccaccagcuuucaaacaaaaucuuccgagaucaaucugcgcggccuuugccuggugcccccucucgucauugaaacggccgcgagaacccggaagacaaucgcuuguuucgaucugagcugcaaccagaccgccugucagcccacaguuuuucugaucgggccuauucagaccugccucacgacaaagucuugucugcuuggacugggcgaccaacgcauccaggugaauuaugagaaaaccuacugcgucuccggccagcucguggaagggguuuguuucaacccgauucacacaauggcccugagccagcccucucauaccuaugauaucgugaccgucauggugagaugcuuucuuauugugaagaaagucuccacaggagacagcaugaagaucgagaaauccuucgagacgcugguucaaaagaccggcugcacagggaauggauuucagggcuacuaugugugucucauugggucuagcuccgaaccucuguacauccccacccuggaugacuaucggagcgcugaggugcucucucgcauggcccuggcuccucacggagaagaucaugacaucgagaagaacgccauuuccgcgaugagaaucgucggcaaagugacaggcaaggcccccagcaccgaaucuagcgauacgguucaggggauugcuuucuccggaaauccgcuuuacacaucuaccggcgugcugaccgccaaagacgauccuaucuacauuugggcucccgggaucaucauggagggaaaccacagcgucugcgagaagaaaacacucccucugaccuggacaggcuuuauuccccuucccggggaaaucgagaagacgacccaauguacaguguucugcacccuggccggaccuggcgcggacugugaagccuauuccgagacaggcauuuuuaauaucagcucuccgaccugccucauuaaccggguucagcgcuucagaggggcugaacagcagaucaaauucaucugucaacggguggacauggauauuacggucuacugcaauggacugaagaaggugauccugaccaaaacacucgucauuggccaguguaucuauaccuuuacauccauuuucagccugauccccgggguggcccacucucuugcuguugagcugugcgugccuggacuccauggcugggccaccaugcugcugcuucucacguuuuguuucggguggauucugauccccuuuacagccaugcugcuccugaagauccuuauugcuuucgcguaccugugcuccaaauauaacaccgacagcaaguuuaaaauccucauugagaaggucaagaaagaauaccacaaguccaugggcucuauggugugcgagguuugucaguaugaaugcgagacagccaaagaacuggagagccaucgcaaguccuguccuaugggaucuugccccuacugucugaacccggcugaggccaccaccagcgcccuucaggcucacuucaaagugugcaagcucacauccagauuucaagauaaucugcgcaagagccugggcgccuacgaaccuaaacagggguguuaucggacgcucucucuguucagauaccgguccagauuuuucgucggacuuguguggugcuuucugcucgugcuggagcugaucauuugggcggcuagcgccgaaacccagaaccuuaauucuggcuggacagacaccgcccacggguccggaguuauccccaugcgcacagaucucgagcuggacuucagccugccuucuagcgcuuccuauaccuaccggagacagcuccaaaaccccgccaaugagcaggaaaagaucccuuuccaucugcagauuagcaaacaggucauccacgcugagauucaacaucuuggccacuggauggaugggacguuuaaccugaagacagccuuccauuguuauggcucuugcgaaaaauacgcguaucccuggcagaccgccggauguuuuguggagaaggacuacgaauacgaguccggcugggggugcaauccgccugauugccccggagugggcaccggguguacagcuugcggagucuaucucgacaagcugaaaagcgugggcaaggccuuccgcaucguuucccugaaauacacccggaaggcuuguauucagcuugggacagagcaaacgugcaaaucuguggauagcaacgacugucucgucaccacauccgugaagguuugccugaucggcaccgugucuaaauuucagcccagcgacacacuucucuuccugggaccucuugaacagggcgggcugaucuuuaagcagugguguaccacgaccugccaauucggagauccgggcgacauuauguccacacccgucgggaugagauguccugagcucucuggcagcuuucgcaagaaaugcgccuucgcgaccacacccgugugucaguuugauggaaauaccaucuccggguauaagcggaugauugccacaaaagacagcuuccagucuuuuaacguuaccgaaccucacaucuccgcuagcucucuggaguggauugaucccgacuccagccugagagaucacaucaaugugaucgucggccgcgaccuuucuuuccaggaucuguccgaaacgccuugccaaguggaccucacaaccaccagcauugauggagccuggggcuccggggugggauucaaccugaucugcagcgucucucucacagaguguagcaccuuucugacguccauuaaggcuugcgacucugccauguguuacggcagcacaaccgccaaucuuaugcgggggcagaacacaauccauauuguuggaaaaggcggccacuccgggucuaaguucaugugcugucaugauaccaagugcagcuccacaggacugguggcugcggcuccccaccucgacagagugaccggcuauaaucaggccgacucugauaaaaucuuugacgauggggccccggaguguggaauuagcugcugguucacgaaguccggcgaauggauccuggggguccugaacggaaacuggauggugguugccgugcuugucgugcuguuuauccucagcauuuuccuguuuacccucuguugcccucgccggcccucuuacgcuaaagagcacaagccuuga

SEQ ID NO: 13440 - RNA, 3447 nt, Artificial Sequence
  derived and/or modified CDS sequence (opt5) from PUUV(PUUV/Orleans/Mg23/2010)__KT247600.1__GP
augggcaagaucauucccgugugccuguaccuccuguucagaugucuucugcucugggaccgggggaacgcccgcaaucugaacgagcuuaaaauggaaugcccucacaccaucggacugggccaggggcucgucauuggaagcguugagcugccgcccgugccucugacacaaaucgaaucccucaagcuggagucuagcuguaauuuugaucuucauacguccaccucuagccagcaguccuucacaaaauggaccugggaaauuaagucugaccuggcugagaacacacaggccagcuccaccagcuuucaaacaaaaucuuccgaggugaaucucagaggccugugccuugugcccccucuggucaucgaaaccgcggcucggacgcgcaagaccaucgccuguuucgaucucagcugcaaccagacagccugucagcccaccguuuuucugauugggccuauccagacaugcauuaccacgaagucuugucugcucggacugggcgaccaaagaauccaggugaauuaugagaaaacauacugcgucuccggccagcuuauugaagggaucuguuucaacccggugcacaccauggcucugagccagcccucucauacauaugauguugugaccgucauggugcggugcuuucucauugugaagaaagucuccaccggagacagcaugaagaucgagaaauccuucgagacacugguucaaaagacgggcugcaccgggaauggauuucagggcuacuaugugugucuuaucgggucuagcuccgaaccucuguacauucccacacucgaugacuaucgcagcgccgaggugcugucuagaauggcuuucgccccucacggagaagaucaugacaucgagaagaacgcgauuuccgccaugcggaucgucggcaaagugaccggcaaggcucccagcacagaagccucugauaccguucaggggauugcuuuuagcggaaauccgcuguacacguccacaggcgugcucaccgccaaagacgauccuaucuacaucugggcgcccgggauuaucauggagggaaaccacucugucugcgagaagaaaacccugccucuuacauggaccggcuucauuccccugcccggggaaaucgagaagacaacgcaauguaccguguuuugcacacucgccggaccuggcgcugacugugaagccuauagcgagaccggcauuuucaauaucuccagcccgacaugccugaucaaccgcguucagagauucagaggggcugaacagcagauuaaauuuaucugucaacgcguggacauggauauuaccgucuacugcaauggacuuaagaaggugauccugacgaaaaccuucauuaucggccaguguauuuauacauuuaccucuaucuucucccucauccccggggucgcccacagccuggccguggagcugugcguuccuggacuccauggcugggcuacaaugcugcuucugcucaccuuuuguuucgggugggugcugauucccuuuuucucuaugauccugcuuaagauucucaucgcguuugccuaccugugcuccaaauauaacacggacagcaaguuccggauucugaucgagaaagucaagcgggaauaccagaagacaaugggcuccauggugugcgagguuugucaguaugaaugcgagaccgcuaaagaacucgagucucaccgcaagagcuguccuaugggauccugccccuacugucugaacccggccgaggccacaaccucugcgcuucaagcccauuuuaaagugugcaagcugaccagcagauuccaggauaaucuccggaaaucccugggcgcguacgaaccuaagcagggguguuauagaacacugagccuuuuucgcuaccggucuagauucuucgucggauuuaucuggugcuuccuccuggugcuggagcucauuaucugggcugccuccgccgaaacgcagaaccugaauagcggcuggaccgacacagcucacgggucuggagugauucccaugcgcaccgaucuugagcuggacuuuucccucccuagcucugccagcuauacauaccggagacaacugcagaaccccgcuaaugagcaggaaaagaucccuuuccaucugcagauuuccaaacaaguuauccacgccgagauccagcaccuuggccauuggauggaugggaccuuuaaccucaagacggcguuccacuguuauggcagcugcgaaaaauacgccuaucccuggcagacagcuggauguuuuauugagaaggacuacgaauacgagucuggcugggggugcaauccgccugauugccccggagucggcaccggguguaccgccugcggaguguaucuggacaaacugaaguccgugggcaaggcuuucaaaaucgucagccuccgcuacacacggaaggccuguauucaacuggggaccgagcagacaugcaaauccguggauucuaacgacugucuuguuacgaccagcgugaaggucugccugaucggcacaguguccaaauuucagcccucugacacccuccuguuccugggaccucuugaacagggcgggcucauuuuuaagcaaugguguacaaccacgugccauuucggagauccgggcgacaucaugagcacccccgcggggaugaaauguccugagcuguccggaucuuuuacaaagaagugcgccuucgcucccaccccuguuugucaguucgauggcgacacaaccagcggguauaaaaagaugaucgccacaaaagauuccuuucagagcuucaaugugaccgaaccccacauuucugcuuccagccuggaguggaucgacccugauagaucucuccgcgaccacauuaacgucaucgugggccgggaucuguccuuucaggaccuuagcgaaacgcccugccaaguugaucugacaaccaccucuauugacggagccuggggcuccggggugggauucaaucucaucugcagcgucucccugacagaguguagcaccuuucugacgucuauuaaggccugcgauagcgcuauguguuacggcuccacaaccgcgaaccuucugagagggcagaauacagugcauaucgugggaaaaggcggccacucugggagcaaguucaugugcugucaugacaccaagugcuccucuacaggacucgucgccgcugccccgcaccuggaccgcguuaccggcuauaaccaggccgauagcgacaaaaucuuugaugacggggcuccugaguguggaauuuccugcuggcucacgaagucuggcgaauggauccugggggugcuuaauggaaacuggaugguggucgccgugcugguugcucucuucauuuuuagcaucuuccuguuuacccuguguugcccccggagaccuuccuacgcuaaagagcacaagcccuga

SEQ ID NO: 13441 - RNA, 3447 nt, Artificial Sequence
  derived and/or modified CDS sequence (opt5) from PUUV(PUUV/Orleans/Mg29/2010)__KT247601.1__GP
augggcaagaucauucccgugugccuguaccuccuguucagaugucuucugcucugggaccgggggaacgcccgcaaucugaacgagcuuaaaauggaaugcccucacaccaucggacugggccaggggcucgucauuggaagcguugagcugccgcccgugccucugacacaaaucgaaucccucaagcuggagucuagcuguaauuuugaucuucauacguccaccucuagccagcaguccuucacaaaauggaccugggaaauuaagucugaccuggcugagaacacacaggccagcuccaccagcuuucaaacaaaaucuuccgaggugaaucucagaggccugugccuugugcccccucuggucaucgaaaccgcggcucggacgcgcaagaccaucgccuguuucgaucucagcugcaaccagacagccugucagcccaccguuuuucugauugggccuauccagacaugcauuaccacgaagucuugucugcucggacugggcgaccaaagaauccaggugaauuaugagaaaacauacugcgucuccggccagcuuguggaagggguuuguuucaacccgauucacaccauggcucugagccagcccucucauacauaugauaucgugaccgucauggugcggugcuuucucauugugaagaaagucuccaccggagacagcaugaagaucgagaaauccuucgagacacugguucaaaagacgggcugcaccgggaauggauuucagggcuacuaugugugucuuaucgggucuagcuccgaaccucuguacauucccacacucgaugacuaucgcagcgccgaggugcugucuagaauggcuuucgccccucacggagaagaucaugacaucgagaagaacgcgauuuccgccaugcggaucgucggcaaagugaccggcaaggcucccagcacagaagccucugauaccguucaggggauugcuuuuagcggaaauccgcuguacacguccacaggcgugcucaccgccaaagacgauccuaucuacaucugggcgcccgggauuaucauggagggaaaccacucugucugcgagaagaaaacccugccucuuacauggaccggcuucauuccccugcccggggaaaucgagaagacaacgcaauguaccguguuuugcacacucgccggaccuggcgcugacugugaagccuauagcgagaccggcauuuucaauaucuccagcccgacaugccugaucaaccgcguucagagauucagaggggcugaacagcagauuaaauuuaucugucaacgcguggacauggauauuaccgucuacugcaauggacuuaagaaggugauccugacgaaaaccuucauuaucggccaguguauuuauacauuuaccucuaucuucucccucauccccggggucgcccacagccuggccguggagcugugcguuccuggacuccauggcugggcuacaaugcugcuucugcucaccuuuuguuucgggugggugcugauucccuuuuucucuaugauccugcuuaagauucucaucgcguuugccuaccugugcuccaaauauaacacggacagcaaguuccggauucugaucgagaaagucaagcgggaauaccagaagacaaugggcuccauggugugcgagguuugucaguaugaaugcgagaccgcuaaagaacucgagucucaccgcaagagcuguccuaugggauccugccccuacugucugaacccggccgaggccacaaccucugcgcuucaagcccauuuuaaagugugcaagcugaccagcagauuccaggauaaucuccggaaaucccugggcgcguacgaaccuaagcagggguguuauagaacacugagccuuuuucgcuaccggucuagauucuucgucggauuuaucuggugcuuccuccuggugcuggagcucauuaucugggcugccuccgccgaaacgcagaaccugaauagcggcuggaccgacacagcucacgggucuggagugauucccaugcgcaccgaucuugagcuggacuuuucccucccuagcucugccagcuauacauaccggagacaacugcagaaccccgcuaaugagcaggaaaagaucccuuuccaucugcagauuuccaaacaaguuauccacgccgagauccagcaccuuggccauuggauggaugggaccuuuaaccucaagacggcguuccacuguuauggcagcugcgaaaaauacgccuaucccuggcagacagcuggauguuuuauugagaaggacuacgaauacgagucuggcugggggugcaauccgccugauugccccggagucggcaccggguguaccgccugcggaguguaucuggacaaacugaaguccgugggcaaggcuuucaaaaucgucagccuccgcuacacacggaaggccuguauucaacuggggaccgagcagacaugcaaauccguggauucuaacgacugucuuguuacgaccagcgugaaggucugccugaucggcacaguguccaaauuucagcccucugacacccuccuguuccugggaccucuugaacagggcgggcucauuuuuaagcaaugguguacaaccacgugccauuucggagauccgggcgacaucaugagcacccccgcggggaugaaauguccugagcuguccggaucuuuuagaaagaagugcgccuucgcucccacaccuguuugucacuucgauggcaaaaccaucagcggguauaagcgcaugauugccacaaaagacuccuuucagagcuucaaugugaccgaaccccacaucucugcuuccagccuggaguggauugauccugacucuucccuccgggaucauaucaacgucauugugggcagagaccugagcuuucaggaucuuucugaaacacccugccagguugaccugaccacgacauccaucgauggagccuggggcagcggggugggauucaaucucauuugcuccgucagccugaccgaguguucuaccuuucugacaagcaucaaggccugcgacuccgcuauguguuacggcucuaccacggcgaaccuucugcgcgggcaaaauacagugcacaucgugggaaaaggcggccauagcggguccaaguucaugugcugucacgauaccaagugcucuagcacaggacucgucgccgcugccccgcaccuggaccggguuaccggcuauaaccaggccgacuccgauaaaauuuuugacgauggggcuccugaguguggaaucucuugcuggcucacaaagagcggcgaauggauucugggggugcuuaauggaaacuggaugguggucgccgugcugguugcucucuucaucuuuuccauuuuccuguuuacccuguguugccccagacggccuagcuacgcuaaagagcauaagcccuga

SEQ ID NO: 13442 - RNA, 3447 nt, Artificial Sequence
  derived and/or modified CDS sequence (opt5) from PUUV(Vranica)__U14136.1__GP
augggcaagcugagccccgugugccucuaccuguuccuucagugucugcuccuguggaacagaggguccgcccggaaucuuaacgagcugaaaauggaaugcccucacaccaucggacucggccaagggcuggucauuggaucuguugagcugccgcccgugccuauccaacagguggaaagccucaagcuggaguccucuuguaauuuugaccuucauacaagcacggcuacccagcaauccuucacaaaauggaccugggaaaugaaggaugaccuggccgagaacacacaggcgucuagcaccuccuuucagacaaaaagcucugaggucaaucuccgcggccugugccuuauucccccucuggugguugaaaccgcuuccagaacgcggaagaccaucgccuguuucgauauuagcugcaaccagacagugugucaacccaccgucuaucucguggggccuauccagacaugcaucaccacgaagucuugucugcugggacucggcgaccagcgcauucagguuaauuacgagaaaacauauugcguguccggccaacugaucgaaggggucuguuuuaacccggugcacaccagagcccuuagccagcccucucauacauacgauauugugaccaugaugguccggugcuuccugguugugaagaaagugaccuccggagacagcaugaagaucgagaaaaauuuugagacacucguccagaagacggauugcaacgcuaauggcuuccaaggguauuacauuugucuggugggauccucuagcgaaccucuuuauguucccacccuggacgauuaccgcuccgccgaggugcucagcagaauggcuuuugccccucacggcgaagaccaugaugucgagcggaacgcggugucugcccugcgcaucguugggaaggugacaggaaaagcucccuccaccgaagccagcgacacaguccagggcauugcuuucucuggcagcccgcuguacaccuccacgggggugcucacagccaaggauaauccugucuauaucuggucucccggaaucauuauggagggcaaccacagcgugugcgagaaaaagacccugccucuuaccuggacaggguuuaucccccugcccggagaaauugagaaaaccccucaguguacaguuuucugcacgcucgcgggcccgggggccgacugugaggcuuacuccgaaaccggaaucuuuaauauuagcucucccacaugccugcuuaacagagugcagcgguuccgcggcgccgaacaacagaucaaguucgucugucagagaguggacauggauaucaccguuuauugcaacggcaugaaaaaggugauucugacaaagacccucgucaucgggcaguguauuuacacguuuaccuccaucuucagccugauuccuggaaucgcucacucucuggccguggagcucugcgugcccggccugcaugggugggccacaguucuucugcuccugaccuuuuguuucggauggauccugauuccuuuuaucgcuaugauucuucucaaaauccugauugcguucgccuaucugugcuccaaguacaauacagacagcaaauuuaagauccucauugagaaagucaagaaggaauaucagaaaaccaugggcuccauggugugcgaggugugucaguacgaaugcgagacggcuaaggaacuggagucucaccggaaaagcugucccaucggguccugcccguacugucuuaacccuucugaggccacaaccagcgcccugcaggcucauuucaaggucugcaaacucacaucccgcuuucaggauaaucugagaaagagccuggccgcguaugaacccaagcaaggcuguuaccggacccuuucucucuucagauaucgcucccgguuuuucgugggauuuaucuggugcauucugcugguucucgagcuggugaucugggcugccagcgccgaaacccagaaccuuaauucuggcuggacagacacggcucacggguccggagucgugccuaugagaaccgaucuggagcucgacuucagccugcccucuagcgccuccuacacauaucgccggcagcugcagaacccugcuaaugagcacgagaaaauucccuuccaucuucaaaucagcaagcagguuauucacgccgaaauccagcaucucggccacuggauggaugcgaccuuuaaccugaaaacagccuuccauuguuacgggcugugcgaaaaguaugcuuacccguggcaaaccgccggaugcuuuuucgagaaagacuacgaauuugagucuggcuggggguguaauccucccgauugccccggcaucggaacgggcuguacagcuugcgggguguaucucgacaagcugaaguccgucggaaaaguguucaagauuaucagccuuagauacacccgcaaagccuguauucagcugggcaccgagcagacaugcaaguccguugauucuaacgacugucucgugaccacaagcaucaaagucugccugauugggacgguguccaaguuucagccuucugacacccugcuuuuccucggaccgcuggaacaaggcgggcugaucuuuaaacagugguguacaaccacaugccaguucggcgaucccggagacaucaugagcacccucacgggcaugaaguguccugagcugaauggguccuuucggaagaaaugcgcguucgccaccacacccgugugucaguuugauggaaacaccauuucuggcuauaagagaaugauggcuacaaaagacagcuuccaauccuucaaugucaccgaaccucacaucagcacaucugcccuugaguggauugaucccgacuccagccugcgcgaucacaucaacguuguggugucucgggaccucuccuuucaggaucugagcgaaaccccuugccaggucgaccugacgacaucuuccauugauggggcuuggggaagcggcgugggguucaaucuuguuugcaccgugucccugaccgagugucccacauuucucaccagcaucaaggccugcgacucugccauguguuacggcagcacgacaaccaaccuggucagaggacagaacacagugcauaucguuggcaaagggggacacuccggcucuaaguucaugugcugucaugauaccaagugcagcuccacagggcucauugcugcggccccgcaccuggaccgcgugaccggauuuaaucaagcugacucugauaaaaucuucgacgauggcgccccuggcugugggaugagcugcugguuuaagaaauccggagaguggauucuuggcguccugaacgggaauuggcucgugguugccgugcugaucgcucuguucauucuuucuaucuuucuguucacgcucuguugcccccggagaccuaccuauacaaaggaacacaaacccuga

SEQ ID NO: 13443 - RNA, 3447 nt, Artificial Sequence
  derived and/or modified CDS sequence (opt5) from PUUV(CG1820/POR)__KT885051.1__GP
augggcgagcugagccccgugugccucuaccugcuucugcaggggcuccugcuuuguaacaccggagccgcuagaaaucugaacgaacucaagauggagugcccucacacaauccggcugggccaagggcuggucguuggauccguggaacucccgucucugcccauucaacagguggagacgcuuaaacuggaaagcuccuguaauuucgaccuccauaccucuacagccggccagcagagcuuuaccaaguggacaugggagaucaaaggggaucuggcggagaacacccaggcuuccucuaccagcuuccagaccaaguccagcgaagucaaucuucgcggacugugccucauuccuacgcuggugguugagaccgccgccagaaugcggaaaacaaucgcuuguuaugaccugucuugcaaccagaccgugugucaacccacagucuaccucaugggcccuauucagaccugcaucacgacaaaguccugucugcuuagccugggcgaucagcgcauccaggugaauuaugaaaagaccuacugcguuucugggcaacucguggagggaauuuguuuuaaccccauccacacaauggcccugucccagccuagccauaccuaugacauuaugaccaugauggucagaugcuuccuugugaucaaaaaggugacaucuggcgauuccaugaaaauugagaagaauuuugaaacgcugguccagaaaaacgggugcaccgcuaauaacuuccaaggauacuauaucugucucauuggcagcuccucugagccgcuguacguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguauaccuccacgggaguucuuacaucuaaggaugaccccguguacaucugggcuccgggcauuaucauggaggggaaccacagcauuugcgagaaaaagacccugccucucaccuggacaggauuuaucucccugcccggcgaaaucgagaaaaccacacaguguacggucuucugcacccuugccgggccuggagcugauugugaagccuauagcgaaacaggcauuuuuaauaucucuucccccacaugccugauuaaccgggugcagcgcuucagaggcagcgagcaacagaucaaguuuguuugucagcggguggacauggacauuacagucuacugcaacgggaugaaaaaggugauccucaccaagacgcuggucaucggacaguguauuuauaccuucacaucuaucuucucccugauucccggcguggcccacagccucgcuguugagcugugcgugccugggcuucauggaugggcgaccaugcugcuccugcugacauuuuguuucggcuggguccuuaucccgaccauuacgaugauccuccugaaaauucugaucgccuuugcuuaccucugcuccaaguauaauacagauucuaaauuccgcauccugauugaaaaggugaaaagagaguaccaaaagaccauggggagcaugguuugcgaagugugucaguacgagugcgaaacagccaaggagcuugagucccaccggaaaucuuguagcaucggcuccugccccuauugucugaacccuagcgaagccaccaccucugcucuccaggcccauuuuaaggucugcaaacugacaucccgcuuccaggagaaucugagaaagagccuuacgguguacgaacccaugcaaggauguuaucggacccucucucuguuuagauaccgcucccgguucuuugugggccugguuuggugcguccuccuggugcuugagcugauugugugggcggcuagcgccgagacacagaaccucaaugccggguggaccgacacagcucacggaucuggcaucauuccuaugaaaaccgaucuggaacuggacuucagccuucccuccagcgccucuuauacguacagacgccagcuccagaacccggcuaaugagcaagaaaagaucccuuuucaucugcagcuguccaagcaggucauccacgccgagauucaacaccucgggcauuggauggaugcgacauucaaccugaaaaccgccuuucacuguuauggaagcugcgaaaaguacgcuuaccccuggcagaccgccggcuguuucaucgagaaagacuaugaguacgaaacaggguggggcugcaauccucccgauugcccuggagugggcaccggguguacagcuugcggaguuuaucuugacaagcugaaauccgugggcaaggucuucaagauugugucucuccgguacacgagaaaaguuuguauccagcuggggaccgagcagacaugcaagaccguggauagcaacgacugucugauuacaaccuccgucaaagugugccuuaucggaacgaucucuaaguuucaacccagcgauacccuccuguuccugggcccgcuccagcaagggggccugauuuuuaaacagugguguacaaccacaugccaguucggagacccuggcgacaucauguccacccccacagggaugaagugucccgaacuuaauggaucuuuucgcaaaaagugcgccuucgcgaccacgccuguuugucaguuugauggcaacacaauuagcggguauaagcggaugaucgccaccaaagacuccuuccagagcuuuaaugugaccgagccgcauauuucuacauccgcucuggaauggaucgaucccgacagcucucucagagaucacaucaacgucauugugucccgcgaccugagcuuccaggaucugucugagaccccuugccaaaucgaccuugccacggcuuccauugauggagccuggggcagcggggugggcuuuaaucuggucugcacaguuucccucaccgaguguagcgccuuccugacaucuaucaaggcuugcgacgcggccauguguuacggaagcaccacagcuaaccucgugcggggccagaacaccauucacaucguggggaaaggaggccauuccgggucuaaguuuaugugcugucacgauacgaaaugcagcuccaccggacuggucgccgccgcuccccaucuugacagagugacaggcuauaaucaggccgauucugacaagauuuucgacgauggcgcgccugaaugugggaugagcugcugguucaagaaauccggagaguggauccugggcguucucaacgggaauuggaugguggucgcugugcugguugugcugcuuauccugucuauucuccuguuuacccucuguugcccccgccggccuagcuacagaaaggaacacaaacccuga

SEQ ID NO: 13444 - RNA, 3447 nt, Artificial Sequence
  derived and/or modified CDS sequence (opt5) from PUUV(DTK/Ufa-97)__AB297666.2__GP
augggcgagcugagccccgugugccucuaccugcuucugcaggggcuccugcuuuguaacaccggagccgcuagaaaucugaacgaacucaagauggagugcccucacacaguccggcugggccaagggcugguugugggauccguggaacucccgucucugcccauccagcaggucgagacgcuuaaacuggaaagcuccuguaauuucgaccuccauaccucuacagccggccagcagagcuuuaccaaguggacaugggagauuaaaggggaucuggcggagaacacccaggcuuccucuaccagcuuccagaccaaguccagcgaagugaaucuucgcggacugugccucaucccuacgcugguuguggagaccgccgccagaaugcggaaaacaauugcuuguuaugaccugucuugcaaccagaccgucugucaacccacaguguaccucaugggcccuauccagaccugcauuacgacaaaguccugucugcuuagccugggcgaucagcgcauccagguuaauuaugaaaagaccuacugcgugucugggcaacucgucgagggaaucuguuuuaaccccauucacacaauggcccugucccagccuagccauaccuaugacaucaugaccaugauggugagaugcuuccuugugauuaaaaaggucacaucuggcgauuccaugaaaaucgagaagaauuuugaaacgcugguucagaaaaacgggugcaccgcuaauaacuuccaaggauacuauauuugucucaucggcagcuccucugagccgcuguacgugcccgcccuggacgauuaccggagcgcggaagugcucucccgcauggccuuugcuccucacggggaggaccaugauauugaaaagaaugccgucagcgcuaugagaaucgccggaaaggugacaggcaaagcgcccucuaccgaguccagcgacacaguucagggcaucgccuucucugggagcccucuguauaccuccacgggagugcuuacaucuaaggaugaccccgucuacauuugggcuccgggcaucauuauggaggggaaccacagcaucugcgaaaagaagacccugccucucaccuggacaggauuuauuucccugcccggcgagaucgagaaaaccacacaguguacgguguucugcacccuugccgggccuggagcugauugugaagccuauagcgaaacaggcaucuuuaauauuucuucccccacaugccugaucaaccggguucagcgcuucagaggcagcgagcaacagauuaaguuugugugucagcgggucgacauggacaucacaguguacugcaacgggaugaaaaaggucauucucaccaagacgcuggugaucggacaguguaucuauaccuucacaucuauuuucucccugauccccggcguugcccacagccucgcuguggagcugugcgucccugggcuucauggaugggcgaccaugcugcuccugcugacauuuuguuucggcugggugcuuauuccgaccaucacgaugauucuccugaaaauccugauugccuuugcuuaccucugcuccaaguauaauacagauucuaaauuccgcauccugaucgaaaagguuaaaagagaguaccaaaagaccauggggagcauggugugcgaagucugucaguacgagugcgaaacagccaaggagcuugagucccaccggaaaucuuguagcauuggcuccugccccuauugucugaacccuagcgaagccaccaccucugcucuccaggcccauuuuaaggugugcaaacugacaucccgcuuccaggagaaucugagaaagagccuuacgguguacgaacccaugcaaggauguuaucggacccucucucuguuuagauaccgcucccgguucuuuguuggccuggucuggugcgugcuccuggugcuugagcugaucgucugggcggcuagcgccgagacacagaaccucaaugccggguggaccgacacagcucacggaucuggcauuaucccuaugaaaaccgaucuggaacuggacuucagccuucccuccagcgccucuuauacguacagacgccagcuccagaacccggcuaaugagcaagaaaagauuccuuuucaucugcagcuguccaaacaggugauccacgccgagauccaacaccucgggcauuggauggaugcgacauucaaccugaaaaccgccuuucacuguuauggaagcugcgaaaaguacgcuuaccccuggcagaccgccggcuguuucauugagaaagacuaugaguacgaaacaggguggggcugcaauccucccgauugcccuggaguuggcaccggguguacagcuugcggaguguaucuugacaagcugaaauccgucggcaagguguucaagaucguuucucuccgguacacgagaaaaguguguauucagcuggggaccgagcagacaugcaagaccgucgauagcaacgacugucugaucacaaccuccgugaaaguuugccuuauuggaacgaucucuaaguuucaacccagcgauacccuccuguuccugggcccgcuccagcaagggggccugaucuuuaaacagugguguacaaccacaugccaauucggagacccuggcgacauuauguccacccccacagggaugaagugucccgaacuuaauggaucuuuucgcaaaaagugcgccuucgcgaccacgccugugugucaguuugauggcaacacaaucagcggguauaagcggaugauugccaccaaagacuccuuccagagcuuuaaugucaccgagccgcauaucucuacauccgcucuggaauggauugaucccgacagcucucucagagaucacaucaacgugaucgugucccgcgaccugagcuuccaggaucugucugagaccccuugccaaauugaccuugccacggcuuccaucgauggagccuggggcagcggggucggcuuuaaucugguuugcacagugucccucaccgaguguagcgccuuccugacaucuauuaaggcuugcgacgcggccauguguuacggaagcaccacagcuaaccucgugcggggccagaacaccauccacauugucgggaaaggaggccauuccgggucuaaguuuaugugcugucacgauacgaaaugcagcuccaccggacugguggccgccgcuccccaucuugacagaguuacaggcuauaaucaggccgauucugacaagaucuucgacgauggcgcgccugaaugugggaugagcugcugguucaagaaauccggagaguggauucugggcgugcucaacgggaauuggauggucguggcuguucuggugguccugcuuauccugucuauccuccuguuuacccucuguugcccccgccggccuagcuacagaaaggaacacaaacccuga

SEQ ID NO: 13445 - RNA, 3447 nt, Artificial Sequence
  derived and/or modified CDS sequence (opt5) from PUUV(PUU/Cg-Erft)__AJ238778.1__GP
augggcaagaucauucccgugugccuguaccuccuguuccuuugucugcuccuguggaacagaggggacgcccggaaucuuaacgagcugaaaaucgaaugcccucacaccauuggacucggccaggggcuggucaucggaagcguugagcugccgcccgugccucucacacaaguggaaucccugaagcuggagucuagcuguaauuuugaucugcauacguccaccucuagccagcagcccuucacaaaauggaccugggaaaugaaguccgaccucgcugagaacacacaggccucuagcaccuccuuucaaacaaaaagcucugagauuaaucugcgcggccuuugccuggucccuccccucgugaucgaaaccgcggcuagaacgcggaagaccaucgccuguuucgaucuguccugcaaccagacagccugucagccuaccguuuuucugauugggccgauccagacaugcauuaccacaaagagcugucuccugggacuuggcgaccaacgcauccaggugaauuaugagaaaacguacugcgucucuggccagcugguggaagggguuuguuucaaccccgugcacaccauggcucucucccagccuagccauacauaugauauugucaccgugauggugagaugcuuucugaucgccaagaaagucucuaccggagacuccaugaaacuugagaaguccuucgagacacugguucaaaagacgagcugcaccggcaauggguuucagggauacuauauuugucucgugggcucuagcuccgaaccccuguacaucccuacacuggaugacuaucggagcgcugaggugcucucucgcauggccuucgcgccccacggggaagaucaugacgucgagaagaacgccaucuccgcuaugagaauuaucggaaaagugaccggcaaggccccgagcacagaaucuagcgauaccauucagggcguugcuuuuuccgggaauccucuguacacgucuacaggagugcuuaccgccaaagacgaucccgucuacaucugggcgccuggcauuaucauggaggggaaccacagcgugugcgacaagaaaacccugccccucacauggaccggauucaucccccugccuggcgagauugaaaagacaacgcaauguaccguguuuugcacacuugccgggccgggagcugacugugaggccuauuccgaaaccggcaucuucaauauuagcucucccacaugccugaucaaccggguucagcgcuucagaggcgcugagcagcagauuaaauuuaucugucaacgggucgauauggacaucaccguguacugcaaugggcucaagaaggucauucugacgaaaacccugaucauuggacaguguaucuauacauucaccuccauuuuuagccucaucccuggcguggcccacucucuggccguugaacuuugcgugcccgggcugcauggaugggcuacaaugcuccugcugcuuaccuucuguuuuggcuggauucucaucccuuucuuuuccaugauccugcugaagauucucaucgcguucgccuaccugugcagcaaauauaacacggauuccaaguuuaaaauucuuaucgagaaggucaagaaagaguaccagaagacaauggggucuauggugugcgaaguuugucacuaugagugcgaaaccgcuaaagagcuggaaagccaucgcaaguccugucccaugggcucuugcccguacugucucaacccugccgaggccacaaccagcgcucugcaggcccacuucaaagugugcaagcugaccuccagauuucaagacaaucuuagaaagagccucggagcguacgagcccaaacagggcuguuaucgcacacugucucuguucagauaccgguccagauuuuucgucggguucauuuggugccuccugcuugugcuggaacucaucgugugggcugccagcgccgagacgcagaaccuuaauucuggauggaccgauacagcucacggcuccgggaucauuccuaugcgcaccgaccuggaacuugauuuuagccuccccucuagcgccuccuauacauaccggagacagcugcaaaacccugcuaaugagcaggagaagauccccuuccaucugcagauuagcaaacagguuauccacgccgaaauucaacaucucggacacuggauggacggcaccuuuaaccugaagacggcguuccauuguuaugggucuugcgagaaauacgccuauccguggcagacagcuggcuguuuuaucgaaaaggauuacgaguacgaauccggauggggcugcaauccucccgacugccccggggucggaaccggcuguaccgccugcgggguguaucuugauaagcugaaaagcgugggaaaggcuuucaaaaucgucucccuccgcuacacacggaaggccuguauucagcugggcaccgagcaaacaugcaaaucuguggacagcaacgacugucugguuacgaccuccgugaaggucugccuuaucgggacagugucuaaauuucagccuagcgauacccuccuguuccugggcccgcucgagcagggaggccugauuuuuaagcagugguguacaaccacgugccaauucggggaccccggagauaucauguccaccccuguuggcaugaagugucccgaacuuaaugggucuuuucggaaaaagugcgcguucgccacaaccccugugugucaguuugacggaaacacacugagcggcuauaaacgcaugauugcuaccaaggauuccuuccagagcuucaaugucacagagccccacaucucugccuccagccucgaauggaucgacccugauucuucccugcgggaccacauuaacgugaucguugggagagaucugagcuuucaggaccuuucugagacccccugccaaguggaucuggcuacgacauccauugacggcgccuggggaagcggcgucggguucaaucucgugugcuccgugagccugaccgaauguucuaccuuucucacaagcaucaaagccugcgauuccgcuauguguuacggaucuaccacggcgaaccugcuucgcggccagaauacaguccauauuguugggaagggaggccacagcggcuccaaguucaugugcugucaugacaccaaaugcucuagcacagggcugguggccgcugccccgcaccucgaccgggugaccggauauaaccaggccgauuccgacaagaucuuugaugacggcgcuccugagugugggauuucuugcugguucacaaaaagcggagaguggauccugggcguccugaacgggaauuggauggugguugccgugcuugucgcgcuguuuauccucuccauuuuccuguuuacccucuguugccccagacgcccuagcuacgcuaaggaacacaaacccuga

SEQ ID NO: 13446 - RNA, 3447 nt, Artificial Sequence
  derived and/or modified CDS sequence (opt5) from PUUV(PUUV/Konnevesi/Mg_M105A/2005)__JQ319173.1__GP
augggcaagagcucccccgugugccuguaccucauccugcaggggcuucugcucauuggagccgucaacgcuagaaaucugaacgagcuuaaaauggaauguccucacaccaucggccuggggcaaggacucguugugggcucuguggagcugccgcccgucccuauucaacagguggaaagccugaagcucgaguccucuugcaauuucgaccugcauacaagcacggccgggcagcaauccuuuaccaaauggacaugggaaaccaagucugaucuugcggagaacacacaggcuagcuccaccagcuuccagacaaaaucuuccgagguuaaucugcggggacucugucugauccccacccuuguggucgaaacggccgcccgcaugagaaagaccauugcuugcuaugaccugagcuguaaccagacagugugccaaccuaccguuuaccucaugggccccauccagacaugucugaccacgaagucuugccugcucggccugggggaucagcggauccaggugaauuaugagcgcacauacugugucuccggacaacuuguggaaggcgugugcuuuaacccuauucacaccauggcccugagccagccgucucauacauaugacaucgucaccguuauggugagauguuuccucgugauuaaaaaggucaccuccggggauagcaugaaaaucgagaagaauuuugagacacuggugcagaaaacgggaugcaccgcuaacuccuuccaaggcuacuauauuugccuuguugggucuagcuccgaaccccuguacgugccuacacucgacgauuaccggagcgccgagguccugucucgcauggcguuugcuccccacggagaagaccaugauaucgagaagaaugccauuuccgcccugagaaucgcuggcaaggugaccggcaaagccccuagcacagaaucuagcgacaccguucaggggaucgcguucuccggaucuccccucuauacgagcacaggcgugcugaccgccaaggaugacccggucuacauuugggcuccugggaucauuauggagggaaaccacuccgugugugagaaaaagacccuuccccugacauggaccggcuuuaucccucuccccggggaaauugagaaaacaacgcagugcaccgucuucuguacacuggccggacccggcgcugauugcgaagccuauagcgagaccggcaucuuuaauaucucuuccccuacaugucuuauuaaccgggugcagcgcuucagaggggccgaacaacagaucaaguuuguuugccagcggguggacauggacauuaccgucuacuguaauggagugaaaaagguuauccugacgaagacccucgugauuggccagugcaucuauacauucaccagcaucuucucucugauuccggggaucgcucacucccuggcggucgagcucugugugcccggacugcauggcugggccacagugcuucugcuccugaccuuuugcuucggguggguucugauuccuacgaucacaaugauucuucucaaaauccugauugcuuuugccuaccuguguagcaaguauaacaccgauuccaaauucaagauccucgucgagaaagugaagaaggaauaccagaaaacaaugggcucuauggugugcgaggucugccaguacgaaugugagaccgccaaggaacuggagagccaccgcaaauccugcucuaucggaagcugucccuauugccuuaacccuuccgaggcuacccccagcgcccugcaggcgcauuuuaagguguguaaacucacaucuagauuccaggaaaaucugaagaagucccugacgauguacgagccgaugcaaggcugcuaucggacccuuagccucuuucgcuacagaucucgguucuuuguugggcuggugugguguaugcugcucguccuggaacuuauugugugggcugccuccgccgagacacagaaccugaaugcuggauggaccgacacagcccacggcagcgggaucauuccuaugaaagcugaucucgagcuggacuucucucugcccagcuccgccagcuauaccuacagacgccagcuucagaacccugcgaaugaacaagagaagauccccuuucaccuccagauuucuaaacagguuauccaugccgaaauccaacaccugggacauuggauggaugcuacguucaaccugaagacagccuuucacugcuauggcuccugugagaaauacgcuuacccuuggcagaccgccgggugcuucguggaaaaggacuaugaguacgagaccggcuggggauguaaucccccggauugcccuggcgucgggacaggaugcaccgcguguggcguguaucucgacaagcugaaaagcguugggaagguguucaaaauugucucccuucgguacacaagaaaggugugcauccagcugggaacggaacagaccuguaaaacaguggauucuaacgacugccucauuaccacaagcgucaagguuugucugaucggcaccauuuccaaauuucaacccucugauacgcugcuuuuccucgggccccugcagcagggcggacugaucuuuaagcaguggugcaccacaaccugucaauucggcgacccuggggacaucaugagcacaccgaccggaaugaagugccccgagcucaauggcuccuuucgcaaaaagugugccuucgcuacaaccccugugugccaguuugaugggaacacgauuucuggauauaaacggaugaucgccacaaaggacagcuuccaguccuuuaaugugaccgaaccccauauuagcaccucugcucuggaguggaucgauccugacuccagccuuagagaucacauuaacgucaucgugucucgcgaccuguccuuccaggaucucagcgaaacacccugucaaaucgaccugaccgccucugccauugauggcgcuuggggguccggcguuggauuuaaucuggugugcacgaucagccuuacagagugcuccaccuuccugacaagcauuaaagcgugugacgccgcuaugugcuacggcucuaccacaaccaaccucguccgggggcagaauacgauccacgugguuggaaagggcgggcauagcggauccaaguuuauguguugccacgauaccaaauguucuagcacaggccugguggccgccgcuccucaucucaacagagucaccggcuucaaccaggccgacuccgauaagauuuucgacgacggggcgcccgagugcggagugucuuguugguuuaaaaagagcggcgaauggguucugggggugcuuaauggaaacuggauggucguggcugugcugaucgcccuccugauucuguccaucuuccuuuuugcccugugcuguccgcgccggccuucuuauaaaaaggagcacaagcccuga

SEQ ID NO: 13447 - RNA, 3447 nt, Artificial Sequence
  derived and/or modified CDS sequence (opt5) from PUUV(PUUV/Konnevesi/Mg_M114B/2005)__JQ319175.1__GP
augggcaagagcucccccgugugccuguaccucauccugcaggggcuucugcucuuuggagccgucaacgcuagaaaucugaacgagcuuaaaauggaauguccucacaccauuggccuggggcaaggacucguugugggcucuguggagcugccgcccgucccuauccaacagguggaaagccugaagcucgaguccucuugcaauuuugaccugcauacaagcacggccgggcagcaauccuucaccaaauggacaugggaaauuaagaacgaucuugcggagaauacccaggcuucuagcacauccuuucagaccaaaagcucugagguuaaccugcggggacucugucugauccccacacuuguggucgaaaccgccgcccgcaugagaaagacgauugcuugcuaugaccuguccuguaaucagaccgugugccaaccuacaguuuaccucaugggccccauccagaccugucugacaaccaagagcugccugcucggccugggggaucagcggauccaggugaacuaugagcgcacguacugugucucuggacaacuuguggaaggcgugugcuucaauccuauucacacaauggcccugucccagccgagccauaccuaugacaucgucacaauuaugguuagauguuuucucgugaucaaaaaggugaccucuggggauaacaugaaaauugagaagaauuucgagacccugguccagaaaacaggaugcacggcuaacuccuuucaaggcuacuauaucugccuuguggggagcuccucugaaccccuguacguuccuacccucgacgauuaccggagcgccgaggugcugucccgcauggcguucgcuccccacggagaagaccaugauauugagaagaaugccaucagcgcccugagaaucgcuggcaaggucacaggcaaagccccuucuaccgaauccagcgacacagugcaggggauugcguuuucuggaagcccccucuauaccuccacgggcguucugacagccaaggaugacccgguguacaucugggcuccugggauuaucauggagggaaaccacucugucugugagaaaaagacccuuccccugaccuggacaggcuucauuccucuccccggggaaaucgagaaaaccacacagugcacgguguuuuguacccuggccggacccggcgcugauugcgaagccuauagcgagacaggcaucuucaauauuuccagcccuaccugucuuaucaaccggguccagcgcuuuagaggggccgaacaacagauuaaguucgugugccagcggguugacauggacaucacaguguacuguaacggagucaaaaaggugauucugaccaagacgcucguuaucggccagugcaucuauaccuucacaucuauuuucucccugaucccggggauugcucacagccuggcgguggagcucuguguccccggacugcauggcugggccaccgugcuucugcuccugacauucugcuuugggugggugcugaucccuaccauuacgaugauccuucucaaaauucugaucgcuuucgccuaccuguguucuaaguauaauacagauuccaaauuuaagauccucguugagaaagucaagaaggaauaccagaaaaccaugggcagcauggugugcgaggugugccaguacgaaugugagacagccaaggaacuggagucccaccgcaaaucuugcagcauuggauccugucccuauugccuuaacccuucugaggcuacccccagcgcccugcaggcgcauuucaaggucuguaaacucaccuccagauuucaggaaaaucugaaaaagagccugacaauguacgagccgaugcaaggcugcuaucggacgcuuucucucuuccgcuacagaucccgguuuuucguggggcugguuugguguaugcugcucgugcuggaacuuaucgucugggcugccagcgccgagacccagaaccugaaugcuggauggacagacaccgcccacggcucugggauuaucccuaugaaggcugaucucgagcuggacuuuucccugcccagcucugccagcuauacauacagacgccagcuucagaacccugcgaaugaacaagagaagauucccuuccaccuccagaucuccaaacaggugauccaugccgaaauucaacaccugggacauuggauggaugcuaccuuuaaccugaagacggccuuccacugcuauggcagcugugagaaauacgcuuacccuuggcagacagccgggugcuucguugaaaaggacuaugaguacgagaccggcuggggauguaaucccccggauugcccuggcguggggaccggaugcacagcguguggcgucuaucucgacaagcugaaaucuguggggaagguuuuuaaaaucgugucccuucgguacaccagaaaggucugcauucagcugggaacagaacagacguguaaaaccguggauagcaacgacugccucaucacaaccuccgugaaggucugucugauuggcacaaucucuaaauuccaacccagcgauacccugcuuuuucucgggccccugcagcagggcggacugaucuucaagcaguggugcacgaccacaugucaauuuggcgacccuggggacauuauguccaccccgacaggaaugaagugccccgagcucaauggcucuuuccgcaaaaagugugccuuugcuaccacaccuguuugccaguucgaugggaacaccaucagcggauauaaacggaugauugccacgaaggacuccuuucagucuuucaaugugacagaaccccauaucagcaccuccgcucuggaguggauugauccugacagcucucuuagagaucacaucaacgugaucgucucccgcgaccugagcuuucaggaucucucugaaacccccugucaaauugaccugaucgccuccgccauugauggcgcuugggggagcggcgugggauucaaucugguuugcacagugucucuuaccgagugcuccacguuucugacaagcaucaaagcgugugacgccgcuaugugcuacggcuccaccacaauuaaccucauccgggggcagaacaccauucacgucgugggaaagggcgggcauagcggaucuaaguucauguguugccacgauacaaaauguagcuccaccggccugguugccgccgcuccucaucucgacagagugacgggcuucaaucaggccgauucugacaagaucuuugacgauggggcgcccgagugcggagucagcuguugguucaaaaaguccggcgaaugggugcuggggguucuuaacggaaauuggaugguggucgcugugcugaucgcccuccugauucugucuaucuuucuuuucgcccugugcuguccgcgccggccuagcuauaaaaaggagcacaagcccuga

SEQ ID NO: 13448 - RNA, 3447 nt, Artificial Sequence
  derived and/or modified CDS sequence (opt5) from PUUV(PUUV/Konnevesi/Mg_M78B/2005)__JQ319174.1__GP
augggcaagagcucccccgugugccuguaccucauccugcaggggcuucugcuguucggagccgucaacgcuagaaaucugaacgagcuuaaaauggaauguccucacaccauuggccuggggcaaggacucguugugggcucuguggagcugccgcccgucccuauccaacagguggaaagccugaagcucgaguccucuugcaauuuugaccugcauacaagcacggccgggcagcaguccuucaccaaauggacaugggaaauuaagaacgaucuugcggagaauacccaggcuucuagcacauccuuucagaccaaaagcucugagguuaaccugcggggacucugucugauccccacacuuguggucgaaaccgccgcccgcaugagaaagacgauugcuugcuaugaccuguccuguaaucagaccgugugccaaccuacaguuuaccucaugggccccauccagaccugucugacaaccaagagcugccugcucggccugggggaucagcggauccaggugaacuaugagcgcacguacugugucucuggacaacuuguggaaggcgugugcuucaauccuauucacacaauggcccugucccagccgagccauaccuaugacaucgucacaauuaugguuagauguuuucucgugaucaaaaaggugaccucuggggauaacaugaaaauugagaagaauuucgagacccugguccagaaaacaggaugcacggcuaacggcuuucaaggguacuauaucugccuugugggauccagcuccgaaccccuguacguuccuacccucgacgauuaccggucugccgaggugcugagccgcauggcguucgcuccccacggcgaagaccaugauauugagaagaaugccaucuccgcccugagaaucgcuggcaaggucacagggaaagccccuagcaccgaaucuuccgacacagugcagggaauugcguuuagcggcucuccccucuauaccagcacggggguucugacagccaaggaugacccgguguacaucugggcuccuggaauuaucauggagggcaaccacuccgucugugagaaaaagacccuuccccugaccuggacaggguucauuccucuccccggagaaaucgagaaaaccacacagugcacgguguuuuguacccuggccggccccggcgcugauugcgaagccuauucugagacagggaucuucaauauuagcuccccuaccugucuuaucaaccggguccagcgcuuuagaggagccaagcaacagauuaaauucgugugccagcggguugacauggacaucacaguguacuguaacggcgucaagaaggugauucugaccaaaacgcucguuaucgggcagugcaucuauaccuucacaagcaucuuuucucugauuccgggaauugcucacucccuggcgguggaacucuguguccccggccugcaugggugggccaccgugcuucugcuccugacauucugcuuuggcugggugcugaucccuaccauuacgaugauccuucucaagauucugaucgcuuucgccuaccuguguagcaaauauaauacagauucuaaguuuaaaauccucguugagaaggucaagaaagaguaccaaaagaccaugggauccauggugugcgaagugugccaguacgagugugaaacagccaaagagcuggaaagccaccgcaaguccugcucuauuggcagcugucccuauugccuuaacccuuccgaggcuacccccucugcccugcaggcgcauuucaaagucuguaagcucaccagcagauuucaggagaaucugaagaaaucccugacaauguacgaaccgaugcaagggugcuaucggacgcuuagccucuuccgcuacagaucucgguuuuucgugggacugguuugguguaugcugcucgugcuggagcuuaucgucugggcugccuccgccgaaacccagaaccugaaugcuggcuggacagacaccgcccacgggagcggaauuaucccuaugaaggcugaucucgagcuggacuuuucucugcccuccagcgccucuuauacauacagacgccagcuucagaacccugcgaaugagcaagaaaagauucccuuccaccuccagaucagcaaacaggugauccaugccgagauucaacaccugggccauuggauggaugcuaccuuuaaccugaaaacggccuuccacugcuauggguccugugaaaaguacgcuuacccuuggcagacagccggcugcuucguugagaaggacuaugaauacgagaccggauggggcuguaaucccccggauugcccuggggugggaaccggcugcacagcguguggggucuaucucgacaaacucaagagcgugggaaaaguuuuuaagaucgugucucuucgguacaccagaaaagucugcauucagcugggcacagagcagacguguaagaccguggauuccaacgacugccucaucacaaccagcgugaaagucugucugauugggacaaucuccaaguuccaacccucugauacccugcuuuuucucggcccccugcagcagggaggccugaucuucaagcaguggugcacgaccacaugucaauuuggggacccuggagacauuaugagcaccccgacaggcaugaaaugccccgaacucaauggguccuuccgcaagaaaugugccuuugcuaccacaccuguuugccaguucgauggaaacaccaucucuggcuauaagcggaugauugccacgaaagacagcuuucaguccuucaaugugacagagccccauaucucuaccagcgcucuggaauggauugauccugacuccagccuuagagaucacaucaacgugaucgucucucgcgaccuguccuuucaggaucucagcgagacccccugucaaauugacaugacagccucugccaucgauggggcuuggggcuccggagugggcuucaaucugguuugcaccgugagccugacggaaugcucuacauuucuuaccuccauuaaggcgugugacgccgcuaugugcuacgggagcacaaccacaaaccugguccggggacagaacaccauccacgugguuggcaaagggggacauuccggcagcaaguucauguguugccacgauacgaaguguucuagcaaaggccucguggccgccgcuccucaucuggacagagucaccggguucaaucaggccgauuccgacaagauuuuugacgauggagcgcccgagugcggcgugucuuguugguucaaaaagagcggggaguggguucucggagugcugaacggcaauuggauggucguggcugugcuuaucgcccugcucauucuguccaucuuucuguucgcccuuugcuguccgcgccggccuucuuauaagaaagaacacaagcccuga

SEQ ID NO: 13449 - RNA, 3447 nt, Artificial Sequence
  derived and/or modified CDS sequence (opt5) from PUUV(PUUV/Konnevesi/Mg_O78A/2005)__JQ319172.1__GP
augggcaagagcucccccgugugccuguaccucauccugcaggggcuucuccuguucggagccgucaacgcuagaaaucugaacgagcuuaaaauggaauguccucacaccauuggccuggggcaaggacucguugugggcucuguggagcugccgcccgucccuauccaacagguggaaagccugaagcucgaguccucuugcaauuuugaccugcauacaagcacggccgggcagcaauccuucaccaaauggacaugggaaauuaagucugaucuugcggagaacacccaggcuagcuccacaucuuuucagaccaaaucuuccgagguuaaucugcggggacucugucugauccccacacuuguggucgaaaccgccgcccgcaugagaaagacgauugcuugcuaugaccugagcuguaaccagaccgugugccaaccuacaguuuaccucaugggccccauccagaccugucugacaaccaagucuugccugcucggccugggggaucagcggauccaggugaauuaugagcgcacguacugugucuccggacaacuuguggaaggcgugugcuucaacccuauucacacaauggcccugagccagccgucucauaccuaugacaucgucacaauuaugguuagauguuuucucgugaucaaaaaggugaccuccggggauagcaugaaaauugagaagaauuucgagacccugguccagaaaacaggaugcacggcuaacuccuuucaaggcuacuauaucugccuuguggggucuagcuccgaaccccuguacguuccuacccucgacgauuaccggagcgccgaggugcugucucgcauggcguucgcuccccacggagaagaccaugauauugagaagaaugccaucuccgcccugagaaucgcuggcaaggucacaggcaaagccccuagcaccgaaucuagcgacacagugcaggggauugcguuuuccggaucuccccucuauaccagcacgggcguucugacagccaaggaugacccgguguacaucugggcuccugggauuaucauggagggaaaccacuccgucugugagaaaaagacccuuccccugaccuggacaggcuucauuccucuccccggggaaaucgagaaaaccacacagugcacgguguuuuguacccuggccggacccggcgcugauugcgaagccuauagcgagacaggcaucuucaauauuucuuccccuaccugucuuaucaaccggguccagcgcuuuagaggggccgaacaacagauuaaguucgugugccagcggguugacauggacaucacaguguacuguaauggagucaaaaaggugauucugaccaagacgcucguuaucggccagugcaucuauaccuucacaagcauuuuuagccugaucccggggauugcucacucccuggcgguggagcucuguguccccggacugcauggcugggccaccgugcuucugcuccugacauucugcuuugggugggugcugaucccuaccauuacgaugauccuucucaaaauucugaucgcuuucgccuaccuguguagcaaguauaacacagauuccaaauuuaagauccucguugagaaagucaagaaggaauaccagaaaaccaugggcucuauggugugcgaggugugccaguacgaaugugagacagccaaggaacuggagagccaccgcaaauccugcucuauuggaagcugucccuauugccuuaacccuuccgaggcuacccccagcgcccugcaggcgcauuucaaggucuguaaacucaccucuagauuucaggaaaaucugaagaagucccugacaauguacgagccgaugcaaggcugcuaucggacgcuuagccucuuccgcuacagaucucgguuuuucguggggcugguuugguguaugcugcucgugcuggaacuuaucgucugggcugccuccgccgagacccagaaccugaaugcuggauggacagacaccgcccacggcagcgggauuaucccuaugaaagcugaucucgagcuggacuuuucucugcccagcuccgccagcuauacauacagacgccagcuucagaacccugcgaaugaacaagagaagauucccuuccaccuccagaucucuaaacaggugauccaugccgaaauucaacaccugggacauuggauggaugcuaccuuuaaccugaagacggccuuccacugcuauggcuccugugagaaauacgcuuacccuuggcagacagccgggugcuucguugaaaaggacuaugaguacgagaccggcuggggauguaaucccccggauugcccuggcguggggaccggaugcacagcguguggcgucuaucucgacaagcugaaaagcguggggaagguuuuuaaaaucgugucccuucgguacaccagaaaggucugcauucagcugggaacagaacagacguguaaaaccguggauucuaacgacugccucaucacaaccagcgugaaggucugucugauuggcacaaucuccaaauuccaacccucugauacccugcuuuuucucgggccccugcagcagggcggacugaucuucaagcaguggugcacgaccacaugucaauuuggcgacccuggggacauuaugagcaccccgacaggaaugaagugccccgagcucaauggcuccuuccgcaaaaagugugccuuugcuaccacaccuguuugccaguucgaugggaacaccaucucuggauauaaacggaugauugccacgaaggacagcuuucaguccuucaaugugacagaaccccauaucagcaccucugcucuggaguggauugauccugacuccagccuuagagaucacaucaacgugaucgucucucgcgaccuguccuuucaggaucucagcgaaacccccugucaaauugaccugacagccucugccaucgauggcgcuuggggguccggcgugggauucaaucugguuugcaccauuagccuuacggagugcuccacauuucugaccagcaucaaagcgugugacgccgcuaugugcuacggcucuacaaccacaaaccucgugcgggggcagaauaccauucacgucgugggaaagggcgggcauagcggauccaaguucauguguugccacgauacgaaauguucuagcaccggccugguugccgccgcuccucaucucaacagagugacaggcuucaaccaggccgacuccgauaagaucuuugacgacggggcgcccgagugcggagucucuuguugguucaaaaagagcggcgaaugggugcuggggguucuuaauggaaacuggaugguggucgcugugcugauugcccuccugauccuguccaucuuucuuuucgcccugugcuguccgcgccggccuucuuauaaaaaggagcacaagcccuga

SEQ ID NO: 13450 - RNA, 3447 nt, Artificial Sequence
  derived and/or modified CDS sequence (opt5) from PUUV(PUUV/Pieksamaki/human_kidney/2008)__JN831951.1__GP
augggcaagagcucccccgugugccuguaccucauccugcaggggcuucuccuguucggagccgucaacgcuagaaaucugaacgagcuuaaaauggaauguccucacaccauuggccuggggcaaggacucguugugggcucuguggagcugccgcccgucccuauccaacagguggaaagccugaagcucgaguccucuugcaauuuugaccugcauacaagcacggccgggcagcaauccuucaccaaauggacaugggaaauuaagucugaucuugcggagaacacccaggcuagcuccacauccuuucagaccaaaucuuccgagguuaaucugcggggacucugucugauccccacacuuguggucgaaaccgccgcccgcaugagaaagacgauugcuugcuaugaccugagcuguaaccagaccgugugccaaccuacaguuuaccucaugggccccauccagaccugucugacaaccaagucuugccugcucggccugggggaucagcggauccaggugaauuaugagcgcacguacugugucuccggacaacuuguggaaggcgugugcuucaacccuauucacacaauggcccugagccagccgucucauaccuaugacgucguuacaaucauggugagauguuuucucgugauuaaaaaggucaccuccggggauagcaugaaaaucgagaagaauuucgagacccuggugcagaaaacaggaugcacggcuaacaauuuucaaggcuacuauauuugccuuguuggguccucuagcgaaccccuguacgugccuacccucgacgauuaccgguccgccgagguccugagccgcauggcguucgcuccccacggagaagaccaugauaucgagaagaacgccauuucugcccugagaaucgcuggcaaggugacaggcaaagccccuuccaccgaaagcucugacacaguucaggggaucgcguuuagcggaagcccccucuauaccucuacgggcgugcugacagccaaggaugacccggucuacauuugggcuccugggaucauuauggagggaaaucacagcgugugugagaaaaagacccuuccccugaccuggacaggcuucaucccucuccccggggaaauugagaaaaccacacagugcacggucuuuuguacccuggccggacccggcgcugauugcgaagccuauuccgagacaggcaucuucaacaucagcucuccuaccugucuuauuaaucgggugcagcgcuuuagaggggccgaacaacagaucaaguucguuugccagcggguggacauggacauuacagucuacuguaacggagugaaaaagguuauccugaccaagacgcucgugauuggccagugcaucuauaccuucacauccaucuuuagccugauuccggggaucgcucacucucuggcggucgagcucugugugcccggacugcauggcugggccaccgugcuucugcuccugacauucugcuuuggguggguucugauuccuaccaucacgaugauucuucucaaaauccugauugcuuucgccuaccuguguuccaaguauaacacagauagcaaauuuaagauccucgucgagaaagugaagaaggaauaccagaaaaccaugggcuccauggugugcgaggucugccaguacgaaugugagacagccaaggaacuggagucucaccgcaaaagcugcuccaucggaucuugucccuauugccuuaauccuagcgaggcuacccccuccgcccugcaggcgcauuucaagguguguaaacucaccagcagauuucaggaaaaccugaagaagucucugacaauguacgagccgaugcaaggcugcuaucggacgcuuucccucuuccgcuacagaagccgguuuuucguugggcuggugugguguaugcugcucguccuggaacuuauugugugggcugccucugccgagacccagaaucugaacgcuggauggacagacaccgcccacggcuccgggaucauuccuaugaaagcugaucucgagcuggacuuuagccugcccucuagcgccuccuauacauacagacgccagcuucagaauccugcgaacgaacaagagaagauccccuuccaccuccagauuagcaaacagguuauccaugccgaaauccaacaccugggacauuggauggaugcuaccuuuaaucugaagacggccuuccacugcuauggcucuugugagaaauacgcuuacccuuggcagacagccgggugcuucguggaaaaggacuaugaguacgagaccggcuggggauguaaucccccggauugcccuggcgucgggaccggaugcacagcguguggcguguaucucgacaagcugaaauccguugggaagguguuuaaaauugucagccuucgguacaccagaaaggugugcauccagcugggaacagaacagacguguaaaaccguggauuccaacgacugccucauuacaaccucugucaagguuugucugaucggcacaauuagcaaauuccaacccuccgauacccugcuuuuucucgggccccugcagcagggcggacugaucuucaagcaguggugcacgaccacaugucaauuuggcgacccuggggacaucaugucuaccccgacaggaaugaagugccccgagcucaacggcagcuuccgcaaaaagugugccuuugcuaccacaccugugugccaguucgaugggaauaccauuuccggauauaaacggaugaucgccacgaaggacucuuuucagagcuucaacgugacagaaccccauauuuccaccagcgcucuggaguggaucgauccugacucuucccuuagagaucacauuaaugucaucgugagccgcgaccugucuuuucaggaucucuccgaaacccccugucaaaucgaccugacagccagcgccauugauggcgcuugggggucuggcguuggauucaaccuggugugcaccaucucccuuacggagugcagcacauuucugaccuccauuaaagcgugugacgccgcuaugugcuacggcagcacaaccacaaaucucguccgggggcagaacaccauccacgugguuggaaagggcgggcauucuggaagcaaguucauguguugccacgauacgaaauguuccucuaccggccugguggccgccgcuccucaucucgacagagucacaggcuucaaccaggccgauagcgacaagauuuuugacgauggggcgcccgagugcggaguguccuguugguuccgcaaaucuggcgaauggguucugggggugcuuaauggaaacuggauggucguggcugugcugaucgcccuccugauucugagcaucuuucuuuucgcccugugcuguccgcggagaccuuccuauaagaaagagcacaagcccuga

SEQ ID NO: 13451 - RNA, 3447 nt, Artificial Sequence
  derived and/or modified CDS sequence (opt5) from PUUV(Samara_49/CG/2005)__AB433850.2__GP
augggcaagcugagccccgugugccucuaccugcuucugcaggggcuccugcuuuguaaaaccggaacagccagaaaccugaaugagcucaagauggaaugcccucacacgaucggccuggggcaaggacuggucguuggcuccguggagcucccgcccgugccuauucagcaggucgaaacccugaaacuugagucuagcuguaacuucgaccugcauacauccaccgcugggcagcaagccuuuacaaaguggaccugggaaaucaaaggagaucucgcggagaauacacaggcuucuagcaccuccuuccagacgaagucuagcgaggugaaccugcggggccuuugccugauucccacccucguuaucgaaacagccgcccgcaugagaaagaccauugcuuguuaugaccuguccugcaaucagacagugugucaaccuaccgucuaccugaugggccccauccagacgugcaucacaaccaaaagcugucuccuggggcuuggagaucagcggauucaggugaacuaugagaagacauacugcguuucuggccaacugguggaaggggucuguuuuaauccuauccacaccauggcccucucccagccgagccauaccuaugacauugugacaaugauggugcgcugcuuccuggucaucaaaaagguuacgucuggagauuccaugaaaauugagaagaacuuugagacccuugugcagaagaauggcugcacagcuaacagcuuccaaggguacuauaucugucugauuggaucuuccagcgaaccccucuacgugccuacccuggacgauuacagauccgccgagguccugucucggauggcguuugcuccccacggcgaagaccaugauguggagaaaaaugccaucagcgcccuccgcaucgcuggcaagguuacagggaaagccccuuccaccgaaagcucugacacggugcagggaauugcguucuccggcagcccccuguauacaucuaccgggguccuuaccgccaaggaugacccgguguacaucugggcuccuggaauuaucauggagggcaaccacagcguuugcgagaaaaagacacugccccucaccuggacaggguuuauuucccugccuggagaaaucgagaaaacgacccaguguacaguguucugcacccuugccggccccggcgcugauugugaagccuauucugagacagggaucuuuaauauuagcuccccuaccugccugaucaacagaguccagcgguuccgcggagccgaacaacagauuaaguuugugugucagagagucgacauggacaucacgguguacugcaauggcguuaagaaagugauucucaccaagacacuggucaucgggcaguguaucuauaccuucacaagcauuuucucucugauccccggaguggcucacucccucgcgguugagcugugcgugccgggccuucaugggugggccaccaugcugcuccugcugacguuuuguuucggcuggguccuuauucccacaaucaccaugauucuccugaaaauccugauugcuuuugccuaccucugcagcaaguauaacacagauucuaaauuccggauccugaucgagaaggugaagcgcgaauaccaaaagaccaugggauccauggugugcgagguuugucaguacgaaugcgagaccgccaaggaacuugagagccacaaaaaguccuguucuauuggcagcugcccuuauugucugaaccccuccgaggcuacaacgucugcccuccaggcgcauuuuaaagucugcaagcugaccagcagauuccaggaaaaucugcggaagucccuuacaguguacgagccuaugcaaggguguuaucgcacccucagccuguuuagauaccggucuagauucuuugugggacuggucuggugcgugcuccugguucuugaacugaucgugugggcugccuccgccgagacacagaaccucaaugcuggcuggaccgacacggcccacgggagcggaauuauccccaugaaaacagaucuggagcuggacuucucucuuccguccagcgcuucuuauaccuaccgccggcagcuccagaacccugccaaugaacaagagaacauucccuuucaucugcagaucagcaagcaggucauccacgcggaaauucaacaccugggccauuggauggaugccaccuucaaucucaaaacagcuuuucacuguuauggguccugcgagaaguacgccuacccuuggcagaccgcuggcuguuucguggaaaaagacuaugaguacgagacaggauggggcugcaaucccccugauugccccgggguuggaacgggcuguaccgccugcggggcguaucuggacaaacuuaagagcgugggaaaagucuucaagaucgugucucugagauacacacgcaaaguuuguauucagcucggcaccgaacagacaugcaagaccguggauuccaacgacugucugaucacgaccagcgucaaagugugccugauugggacaaucuccaaguuucaaccgucugauacccuucucuuccugggcccucugcagcagggaggccucaucuuuaaacagugguguacaaccacaugccaauucggggaccccggagacauuaugagcacccccacgggcaugaaguguccugaucugaacggguccuuucggaagaaaugcgccuucgcuacaaccccggugugucaguuugacggaaauaccaucucuggcuauaagagaaugauugccacaaaagauagcuuccaguccuuuaacgucaccgagccccauaucucugcuagcgcccuugaauggauugacccugauuccagccugcgcgaccacaucaauguuaucgugucucgggaucucuccuuccaggaccugagcgagacgcccugccaaauugaucugucuacagccuccaucgacggggcuuggggcagcggagugggcuuuaaccuugucugcaccgugucucugacagaauguuccgcguuccucaccagcauuaaggccugcgaugcugccauguguuacggguccacaaccgccaaucugaucagaggacagaacacgauucacaucguuggcaaagggggacauagcggcucuaaguuuaugugcugucacgacaccaagugcagcacaaccggccucguggcugccgcgccucaucuggaucgcgucacaggguauaaccaggcugacuccgacaaaauuuucgaugacggagcccccgaguguggcaugucuugcugguucaagaaaagcggggaguggauccuuggagugcugaauggcaacuggaugguuguggccguccucaucgcucugcuggugcuuuccauucugcucuuuacccuguguugcccucggagacccucuuaccgcaaggaacacaaaccguga

SEQ ID NO: 13452 - RNA, 3447 nt, Artificial Sequence
  derived and/or modified CDS sequence (opt5) from PUUV(Samara_94/CG/2005)__AB433852.2__GP
augggcaagcugagccccgugugccucuaccugcuucugcaggggcuccugcuuuguaacaccggaacagccagaaaucugaacgagcucaaaaucgaaugcccucacacgauuggccuggggcaaggacuggucguuggcuccguggagcucccgcccgugccuauccagcaggucgaaacccugaaacuugagucuagcuguaauuucgaccugcauacauccaccgcugggcagcaagccuuuacaaaauggaccugggaaauuaagggagaucucgcggagaacacacaggcuucuagcaccuccuuccagacgaaaucuagcgaggugaaucugcggggccuuugccugauccccacccucguuauugaaacagccgcccgcaugagaaagaccaucgcuuguuaugaccuguccugcaaccagacagugugucaaccuaccgucuaccugaugggccccauccagacgugcauuacaaccaagagcugucuccuggggcuuggagaucagcggauccaggugaauuaugagaaaacauacugcguuucuggccaacugguggaaggggucuguuuuaacccuauucacaccauggcccucucccagccgagccauaccuaugacaucgugacaaugauggugcgcugcuuccugauuaucaagaaagucacgucuggagauuccaugaagauugagaaaaauuuugagacccuuguucagaagaacgacugcacagcuaauagcuuccaaggcuacuauaucuguuuuaucgggucuuccagcgaaccccuguacgugccuacccucgaugacuacagauccgccgaggugcugucucggauggcguucgcuccccacggagaagaucaugacgucgagaagaacgccauuagcgcccugcgcaucgcuggcaaagugacaggcaaggccccuuccaccgaaagcucugauacgguucaggggauugcguuuuccggaagcccccucuauacaucuaccggcgugcuggccgcuaaagacgauccggucuacaucugggccccugggauuaucauggagggaaaucacagcaucugcgagaagaaaacccuuccccugacauggaccggcuucauuucccucccuggggaaaucgagaagacaacgcaguguaccguguuuugcacacuggcuggacccggcgccgacugugaagccuauucugagaccggcauuuucaacaucagcucccccacaugccuuauuaauagaguucagcgguuucgcggggcugaacaacagaucaaauucgugugucagagagucgacauggauaucaccguguacugcaacggagucaagaaggugauucugacgaaaacccucguuaucggccaguguauuuauacauucaccagcaucuuuucucugauuccugggguggcgcacucccuggccgucgagcucugcgugccgggacugcauggcugggcuacaaugcuucugcuccugaccuucuguuuuggguggguucugauccccacgauuacaaugauccuucucaagauccugauugccuucgccuaccugugcagcaaauauaacaccgacucuaaguuucggauccucauugagaaagugaagaaggaauaccaaaagacaaugggcuccauggucugcgaggugugucaguacgaaugcgagaccgcuaaggaacuggagagccaccgcaaauccuguucuaucggaagcugcccuuauugucuuaaucccuccgaggccaccacaucugcgcugcaggcucauuucaaggugugcaaacucacgagcagauuucaggaaaaccugcggaagucccugaccguuuacgagccuaugcaaggcuguuaucgcacacuuagccucuucagauaccggucuagauuuuucgucgggcugguguggugcgugcugcucguccuggaacuuauugugugggccgccuccgcugagacccagaaucugaacgccggauggacagauaccgcucacggcagcgggaucauccccaugaagacggaccucgagcuggauuuuucucugccguccagcgccucuuauacauaccgccggcagcuucagaauccugcgaacgaacaagagaauauucccuuccaccuccagaucagcaaacagguuauucaugccgaaauccaacaccugggacauuggauggacgcuaccuuuaaccugaagaccgccuuccacuguuauggcuccugcgagaaauacgcuuacccuuggcagacagccggguguuucguggaaaaggauuaugaguacgagaccggcuggggaugcaaucccccugacugccccggcgucgggacaggauguacggcgugcggcgccuaucucgauaaacuuaagagcguggggaagguuuuuaaaauugugucucugagauacacccgcaaggucuguauccagcugggaacagaacagaccugcaaaacaguggacuccaacgauugucucaucaccacgagcguuaaggugugccugauuggcaccaucuccaaauuccaaccgucugacacacugcuuuuucucgggccucugcagcagggcggacugauuuucaagcagugguguaccacaaccugccaauuuggcgaccccggggauaucaugagcacacccaccggaaugaaauguccugaccucaauggcuccuuccggaagaagugcgcuuuugccacgacaccggucugucaguucgaugggaacaccauuucuggauauaaaagaaugaucgcuaccaaggacagcuuucaguccuucaaugugacagagccccauaucucugccagcgcccuggaauggauugauccugacuccagccuucgcgaucacaucaacgugauugucucucgggaccuguccuuucaggaucucagcgagacccccugccaaaucgaccugucuacgacauccauugauggcgcuugggggagcggcguuggauucaaucuggugugcaccgugucucuuacagaauguuccgcguuucugaccagcaucaaagccugcgacgcugccauguguuacggcuccacaaccgccaaccucauuagagggcagaacacgauccacaucgucggaaagggcgggcauagcggaucuaaauucaugugcugucacgauaccaagugcagcacaaccggccugguggcugccgcgccucaucucgaccgcguuacaggcuauaaucaggcugacuccgauaagauuuucgacgauggggcccccgaguguggaaugucuugcugguuuaaaaagagcggcgaguggauccugggggugcuuaacggaaauuggauggucguggccguucugauugcucuccuggugcuguccauccuucuguucacccucuguugcccucggagacccucuuaccgcaaagaacacaagccguga

SEQ ID NO: 13453 - RNA, 3447 nt, Artificial Sequence
  derived and/or modified CDS sequence (opt5) from PUUV(Sotkamo)__NC_005223.1__GP
augggcaagagcucccccgugugccuguaccucauccugcaggggcuucuucucuucgacaccgucaacgccaaaaaucugaacgagcuuaagauggaauguccucacacaauuggacugggccaagggcucguugugggaucuguggagcugccgcccgucccuauccagcagauugaaagccugaaacucgaguccucuugcaauuuugaucugcauacgagcaccgcuggccagcaauccuucacaaaguggaccugggaaacaaaaggggaccuugccgagaacacccaggcgucuagcacauccuuucagaccaagagcucugaggugaaucugagaggacucugucugauccccacgcuuguuguggaaaccgcugcccggaugcgcaagacaauugccugcuaugaucuguccuguaaccagaccgucugccaaccuacaguguaccucaugggccccauccagaccugucugacgacaaaaagcugccugcucggccugggggaccagagaauccagguuaauuaugagcggaccuacugugugucuggacaacuugucgaaggcgugugcuucaacccuauucacacaauggcucugucccagccgagccauaccuaugauaucgugaccauuaugguccgcuguuuucucguuaucaagaaagugacaucuggggacuccaugaagauugagaaaaauuucgagacgcuggugcagaagaccggaugcacagccaacggcuuucaaggguacuauaucugccuuauuggaagcuccucugaaccccuguacgucccuacccucgaugacuacagaagcgcugaggugcugucccggauggccuucgcgccccacggcgaagaucaugacaucgagaagaaugccguuagcgcucugcgcaucgccggcaaagugacagggaaggcuccuucuaccgaauccagcgauacgguccagggaauugccuuuucuggcagcccccucuauacauccaccggggugcugaccgcgaaagacgauccgguuuacgugugggccccuggaaucauuauggagggcaaccacucugucugugagaagaaaacacuuccccugaccuggacaggguucaucccucuccccggagaaauugagaagacgacccagugcacaguguuuuguacccuggcuggccccggcgccgacugcgaagccuauagcgagacagggaucuucaauaucuccagcccuaccugucuuauuaacagaguccagcgguuucgcggagccgaacaacagaucaaauucgugugccagagaguugacauggauauuacgguguacuguaauggcgucaagaaggugauccugaccaaaacacucguuauugggcagugcaucuauaccuucacaucuaucuuuuccaugauuccgggaaucgcccacagccuggcuguggagcuguguguccccggccuccaugggugggcgaccgugcugcuucugcucacguucugcuuuggcugggugcugauuccuacaaucaccaugauucugcuuaagauccucauugccuucgcuuaccuguguucuaaauauaacacagacuccaaguuucggauccugguugagaaagucaagaaggaauaccaaaagaccaugggaagcauggugugcgaggugugccaguacgaaugugagaccgccaaggaacucgagucccaccgcaaaucuugcagcaucggcuccugucccuauugccugaacccuucugaggccacacccagcgcucugcaggcccauuucaaggucuguaaacugacguccagauuucaggaaaaucucaaaaagagccugaccauguacgagccgaugcaagggugcuaucggacacugucucuuuuccgcuacagaucccgguuuuucgugggacucguuugguguaugcugcuggugcucgaacugauugucugggcggcuagcgccgagacccagaaccuuaaugauggcuggacagacaccgcccacgggucuggaaucauuccuaugaaagcugaucuggagcucgacuuuucccugcccagcucugccagcuauacguacagacgccagcugcagaacccugcuaaugaacaagagaagauccccuuccaccuucagauuuccaaacaggugauccaugccgaaauccaacaccucggccauuggauggaugcgacauuuaaccugaagaccgccuuccacugcuaugggagcugugagaaauacgcuuacccuuggcagaccgccggcugcuucguugaaaaggacuaugaguacgagacaggauggggcuguaaucccccggauugcccuggggugggaaccggcugcacagcuuguggggucuaucuggacaagcucaaaucugugggaaagguuuuuaaaauugugucccugcgguacacgagaaaggucugcauccagcuuggcaccgggcagacauguaaaaccguggauagcaacgacugccugauuacaaccuccgugaaggucugucucaucggcacgauuucuaaauuccaacccagcgacacccugcuguuucuuggaccccuccagcagggcgggcugaucuucaagcaguggugcacaaccacaugucaauuuggagauccuggcgacaucauguccaccccgacagggaugaagugccccgaacugaauggaucuuuccgcaaaaagugugccuuugcgaccacgccuguuugccaguucgauggcaacacaauuagcggguauaaacggaugguggccaccaaggacuccuuucagucuuucaaugugaccgagccccauaucagcacauccgcucucgaauggauugaucuggacagcucucuuagagaucacaucaacgucauugugucccgcgaccugagcuuucaggaucucucugagaccccuugucaaguugaccugacgacauccgccaccgauggcgcuuggggaagcggcgugggguucaaucuggucugcacagugucucuuaccgaaugcuccgccuuucugacaagcaucaaagccugucacgcugcgaugugcuacggauccaccacgaccaaccucguucggggccagaauacaauccauguggucgggaagggaggccacagcggcucuaaguucauguguugccaugacaccaaauguagcuccacagggcugguggccgcugcuccccaccucgauagaguuaccggauucaaccaggccgacucugacaagauuuuugaugacggcgcuccugagugcgggaugagcuguugguucaaaaagcugggagagugggugcuuggcguccugaacgggaauuggauggugguggccguccucaucgcgcugcugauucuuuccaucuuucuguucgcucucugcuguccccgccggccgucuuauaaaaaggaucacaagccuuga

SEQ ID NO: 13454 - RNA, 3447 nt, Artificial Sequence
  derived and/or modified CDS sequence (opt5) from PUUV(2009)__HE801634.1__GP
augggcaagagcucccccgugugccuguaccucauccugcaggggcuucuccuguucgacaccgucaacgccagaaaucugaacgagcuuaaaauggaauguccucacacaauuggacugggccaagggcucguugugggaucuguggagcugccgcccgucccuauccagcagauugaaagccugaagcucgaguccucuugcaauuuugaucugcauacgagcaccgcuggccagcaauccuucacaaaauggaccugggaaacaaagggggaccuugccgagaacacccaggcgucuagcacauccuuucagaccaaaagcucugaggugaaucugcggggacucugucugauccccacgcuuguuguggaaaccgcugcccgcaugagaaagacaauugccugcuaugaucuguccuguaaccagaccgucugccaaccuacaguguaccucaugggccccauccagaccugucugacgacaaagagcugccugcucggccugggggaccagcggauccagguuaauuaugagcgcaccuacugugugucuggacaacuugucgaaggcgugugcuucaacccuauucacacaauggcucugucccagccgagccauaccuaugauaucgugaccauuauggucagauguuuucucguuaucaaaaaggugacaucuggggacuccaugaaaauugagaagaauuucgagacgcuggugcagaaaaccggaugcacagccaacggcuuucaaggguacuauaucugccuuauuggaagcuccucugaaccccuguacgucccuacccucgaugacuaccggagcgcugaggugcugucccgcauggccuucgcgccccacggcgaagaucaugacaucgagaagaaugccguuagcgcucugagaaucgccggcaaggugacagggaaagcuccuucuaccgaauccagcgauacgguccagggaauugccuuuucuggcagcccccucuauacauccaccggggugcugaccgcgaaggacgauccgguuuacgugugggccccuggaaucauuauggagggcaaccacucugucugugagaaaaagacacuuccccugaccuggacaggguucaucccucuccccggagaaauugagaaaacgacccagugcacaguguuuuguacccuggcuggccccggcgccgacugcgaggcuuauagcgaaacagggaucuucaauaucuccagcccuaccugucuuauuaaccggguccagcgcuuuagaggagccgaacaacagaucaaguucgugugccagcggguugacauggauauuacgguguacuguaauggcgucaaaaaggugauccugaccaagacacucguuauugggcagugcaucuauaccuucacaucuaucuuuucccugauuccgggaaucgcccacagccuggcuguggagcucuguguccccggccugcaugggugggcgaccgugcuucugcuccugacguucugcuuuggcugggugcugauuccuacaaucaccaugauucuucucaaaauccugauugccuucgcuuaccuguguucuaaguauaacacagacuccaaauuuaagauccucguugagaaagucaagaaggaauaccaaaagaccaugggaagcauggugugcgaggugugccaguacgaaugugagaccgccaaggaacuggagucccaccgcaaaucuugcagcaucggcuccugucccuauugccuuaacccuucugaggccacacccagcgcucugcaggcccauuucaaggucuguaaacucacguccagauuucaggaaaaucugaaaaagagccugaccauguacgagccgaugcaagggugcuaucggacacuuucucucuuccgcuacagaucccgguuuuucgugggacugguuugguguaugcugcucgugcuggaacuuauugucugggcggcuagcgccgagacccagaaccugaaugccggcuggacagauaccgcucacgggucuggaaucauuccuaugaaagccgaccucgagcuggauuuuucccugcccagcucugcuagcuauacguacagacgccagcuucagaacccugccaaugaacaagagaagauccccuuccaccuccagauuuccaaacaggugauccaugcggaaauccaacaccugggccauuggauggacgccacauuuaaccugaagaccgcuuuccacugcuaugggagcugugagaaauacgccuacccuuggcagaccgcuggcugcuucguugaaaaggauuaugaguacgagacaggauggggcuguaaucccccggacugcccuggggugggaaccggcugcacagccuguggggucuaucucgauaagcugaaaucugugggaaagguuuuuaaaauugugucccuucgguacacgagaaaggucugcauccagcugggcaccgaacagacauguaaaaccguggacagcaacgauugccucauuacaaccuccgugaaggucugucugaucgggacgauuucuaaauuccaacccagcgacacccugcuuuuucucggcccccugcagcagggaggccugaucuucaagcaguggugcacaaccacaugucaauuuggggacccuggagauaucauguccaccccgacaggcaugaagugccccgagcucaaugggucuuuccgcaaaaagugugcguuugccaccacgccuguuugccaguucgacggaaacacaauuagcggcuauaaacggaugguggcuaccaaggauuccuuucagucuuucaaugugaccgaaccccauaucagcacauccgcccuggaguggauugacccugauagcucucuuagagaccacaucaacgucauugugucccgcgaucugagcuuucaggaccucucugaaacccccugucaaguugaucugacgacauccgcuaucgacggggccuggggcagcggagugggcuucaaucuggucugcaccgugucucuuacagagugcuccgccuuucugaccagcaucaaggcuugugaugcggccaugugcuacggguccacaaccacgaaccucguucggggacagaauaccauucacguggucggcaaagggggacauagcggcucuaaguucauguguugccacgacacaaaauguagcuccaccggccugguggcugccgccccucaucucgauagaguuacaggguucaaccaggcugacucugacaagaucuuugaugacggagcccccgagugcggcaugagcuguugguucaaaaagcugggggaaugggugcuuggaguccugaacggcaauuggauggugguggcgguccucauugcucugcugauccuuuccauuuuucuguucgcccucugcuguccgcgccggccuucuuauaaaaaggagcacaagcccuga

SEQ ID NO: 13455 - RNA, 3447 nt, Artificial Sequence
  derived and/or modified CDS sequence (opt5) from PUUV(Umea/hu)__AY526218.1__GP
augggcaagcugagccccgugugccucuaccuguuccuucagugucugcuccugugguccagagggucugcccggaaccuuaaugagcugaaaauggaaugcccucacaccaucggacucggccaagggcuggucauuggaagcguugagcugccgcccgugccugugcagcaggucgaaucccucaagcuggagucuagcuguaacuuugaccuucauacauccacggcuacccagcaaucuuucacaaaauggaccugggaaaugaaggaugaccuggccgagaauacacaggcgagcuccaccagcuuucagacaaaaucuuccgaggugaaccuccgcggccugugccuuauucccccucugguuguggaaaccgcuagcagaacgcggaagaccaucgccuguuucgauaucucuugcaaucagacagucugucaacccaccguguaucucguugggccuauucagacaugcaucaccacgaaguccugucugcugggacucggcgaccagcgcauccaggugaacuacgagaaaacauauugcgucagcggccaacugguggaagggguguguuuuaauccgguccacaccaugguucuuucucagcccucccauacauacgauauugugaccaugauggugagaugcuuccuggucgugaagaaaguuaccagcggagacuccaugaagaucgagaaaaaccucgagacacuggugcagaagacggauugcaaugccaacggcuuucaaggguauuacauuugucuugucggaucuagcuccgaaccucuguaugugcccacccucgacgauuaccggagcgcugagguucugucucgcauggccuucgcuccucacggcgaagaccaugauaucgagagaaaugccguguccgcgcugcggauugucgggaaggugacaggaaaagcccccagcaccgaagccucugacacaauccagggcauugccuuuagcggcuccccgcucuacaccucuacggggguccugacagcuaaggauaacccuguguauguuuggagccccggaaucaucauggagggcaaucacuccgugugcgagaaaaagacccuuccucugaccuggacaggguucauuccccuccccggagaaaucggcaaaaccagccaguguacagucuuuugcacgcuggccgggccuggagcggacugugaggccuacucugaaaccggcauuuucaacaucuccagcccgacaugccuuauuaaucgcgcucagagauuucggggcgccgagcaacagaucaaguucgugugucagcgcguugacauggauaucaccguguauugcaacgggaugaaaaaggucauucugacaaagacccucgugaucggacaguguauuuacacguucaccucuaucuuuucccugauucccggcaucgcucacagccuggccguggaacucugcguuccugggcugcauggaugggccacaguccuucugcuccugaccuucuguuuuggcuggauccugauucccuucaucgcuaugauuucccuuaaaauccucauugcguuugccuaucugugcucuaaguacaacacagacagcaaauucaagauccugauugagaaagugaagaaggaguaucaaaagaccaugggguccauggugugcgaagucugucaguacgagugcgaaacggcuaaggagcucgaaucucacagaaaaagcuguccuaucggcuccugccccuacugucugaauccgagcgaggccacaaccucugcccuucaggcucauuuuaaggugugcaaacugacaucccggguucaggauaaccuccgcaagagccuggccgcguaugagccuaagcaaggauguuacagaacccugucucuuuuccgguauagaucccgcuuuuucgugggcuuuaucuggugcauucuccugguccuggaacucaucauuugggcugccagcgccgagacccagaaucugaacucuggguggacagacacggcucacggaagcggcaucauucccaugcggaccgaucuugaacuggacuucucccucccuagcucugccuccuacacauauagacgccagcugcagaaucccgcuaacgagcacgagaaaaucccuuuucaucugcaaaucagcaaacaggugauucacgccgaaauccagcaucuugggcacuggauggaugcgaccuucaaucucaaaacagccuuccauuguuacggauccugcgagaaguaugcuuaccccuggcaaaccgccggcugcuuuuucgaaaaagacuacgaguuugaaucuagcuggggguguaacccgccugauugccccggcguuggaacgggcuguacagcuugcgggguguaucuggacaagcugaaguccgucggaaaaguguucaagauuaucucucuccgguacaccagaaaagccuguauucagcugggcaccgagcagacaugcaagagcguugauuccaaugacugucuugugaccacaucugucaaagugugccugaucgggacggugagcaaguuucagcccuccgacacccuccuguuccugggaccucuugagcaaggcgggcucaucuuuaaacagugguguacaaccacaugccaguucggcgauccgggagacauuaugagcacccccacgggcaugaaguguccugaacugaacgggucuuuucgcaagaaaugcgcguucgccaccacacccgucugucaguuugauggaaauaccaucuccggcuauaagcggaugauugcuacaaaagacagcuuccaaucuuuuaacguuaccgauccucacaucuccacaagcgcccuggaguggauugaccccgauucuucccucagagaccacaucaaugugguggucagccgcgaucuguccuuccaggaccuuagcgaaaccccuugccagguggaucugacgacaucuagcaucgacggggcuuggggauccggcguuggguucaaccucgugugcaccgucucucugaccgaguguagcacauuucugaccuccauuaaggccugcgauucugccauguguuacggcagcacgacaaucaaucuuaugcggggacagaacaccgugcauauuguuggcaaagggggacacuccggcucuaaguucaugugcugucaugacacaaagugcagcuccaccgggcugguggcugcggcuccccaccucgacagagucacaggauuuaaccaagcugauagcgacaaaaucuucgaugacggcgccccggaauguggcaugucuugcugguuuaagaaauccggggaguggauucugggagugcucaauggcaacuggcugguuguggccguccuuguggcucuguucauccucagcauuuuucuguucacccuguguugcccucgccggcccaucuaugccaaggagcacaaaccuuga

SEQ ID NO: 13456 - RNA, 3447 nt, Artificial Sequence
  derived and/or modified CDS sequence (opt5) from PUUV(P360)__L08755.1__GP
augggcgagcugagccccgugugccucugucugcuucugcaggggcuccugcuuugcaacaccggagccgcuagaaaucugaacgaacucaagauggaguguccucacacaauccggcugggccaagggcuggucguuggauccguggaacucccgucucugcccauucaacagguggagacgcuuaaacuggaaagcuccugcaauuucgaccuccauaccucuacagccggccagcagagcuuuaccaaguggacaugggagaucaaaggggaucuggcggagaacacccaggcuuccucuaccagcuuccagacaaaguccagcgaagucaaucuucgcggacugugucucauuccuacgcuggugguugagaccgccgccagaaugcggaaaacaaucgcuugcuacgaccugucuuguaaccagaccgugugccaacccacagucuaucucaugggcccuauucagaccuguaucacgacaaaguccugccugcuuagccugggcgaucagcgcauccaggugaauuacgaaaagaccuauuguguuucugggcaacucguggagggaauuugcuuuaaccccauccacacaauggcccugucccagccuagccauaccuacgacauuaugaccaugauggucagaugcuuccuugugaucaaaaaggugacaucuggcgauuccaugaaaauugagaagaauuuugaaacgcugguccagaaaaacggguguaccgcuaauaacuuccaaggauauuacaucugccucauuggcagcuccucugagccgcuguauguucccgcccuggacgauuaccggagcgcggaagugcucucccgcauggccuuugcuccucacggggaggaccaugauaucgaaaagaaugccgugagcgcuaugagaaucgccggaaaggucacaggcaaagcgcccucuaccgaguccagcgacacagugcagggcauugccuucucugggagcccucuguacaccuccacgggaguucuuacaucuaaggaugaccccguguauaucugggcuccgggcauuaucauggaggggaaccacagcauuugugagaaaaagacccugccucucaccuggacaggauuuaucucccugcccggcgaaaucgagaaaaccacacagugcacggucuucuguacccuugccgggccuggagcugauugcgaagccuacagcgaaacaggcauuuuuaauaucucuucccccaccugucugauuaaccgggugcagcgcuucagaggcagcgagcaacagaucaaguuuguuugccagcggguggacauggacauuacagucuauuguaacgggaugaaaaaggugauccucaccaagacgcuggucaucggacagugcauuuacaccuucacaucuaucuucucccugauucccggcguggcccacagccucgcuguugagcugugugugccugggcuucauggaugggcgaccaugcugcuccugcugacauuuugcuucggcuggguccuuaucccgaccauuacgaugauccuccugaaaauucugaucgccuuugcuuaucucugcuccaaguacaauacagauucuaaauuccgcauccugauugaaaaggugaaaagagaguaucaaaagaccauggggagcaugguuugugaagugugccaguacgagugugaaacagccaaggagcuugagucccaccggaaaucuugcagcaucggcuccugucccuacugccugaacccuagcgaagccaccaccucugcucuccaggcccauuuuaaggucuguaaacugacaucccgcuuccaggagaaucugagaaagagccuuacgguguaugaacccaugcaaggaugcuaccggacccucucucuguuuagauaucgcucccgguucuuugugggccugguuugguguguccuccuggugcuugagcugauugugugggcggcuagcgccgagacacagaaccucaaugccggguggaccgacacagcucacggaucuggcaucauuccuaugaaaaccgaucuggaacuggacuucagccuucccuccagcgccucuuacacguauagacgccagcuccagaacccggcuaaugagcaagaaaagaucccuuuucaucugcagcuguccaagcaggucauccacgccgagauucaacaccucgggcauuggauggaugcgacauucaaccugaaaaccgccuuucacugcuacggaagcugugaaaaguaugcuuaccccuggcagaccgccggcugcuucaucgagaaagacuacgaguaugaaacaggguggggcugcaauccucccgauuguccuggagugggcaccgggugcacagcuuguggaguuuaccuugacaagcugaaauccgugggcaaggucuucaagauugugucucuccgguauacgagaaaaguuugcauccagcuggggaccgagcagacauguaagaccguggauagcaacgacugccugauuacaaccuccgucaaagugugucuuaucggaacgaucucuaaguuucaacccagcgauacccuccuguuccugggcccgcuccagcaagggggccugauuuuuaaacaguggugcacaaccacaugucaguucggagacccuggcgacaucauguccacccccacagggaugaagugccccgaacuuaauggaucuuuucgcaaaaagugugccuucgcgaccacgccuguuugccaguuugauggcaacacaauuagcggguacaagcggaugaucgccaccaaagacuccuuccagagcuuuaaugugaccgagccgcauauuucuacauccgcucuggaauggaucgaucccgacagcucucucagagaucacaucaacgucauugugucccgcgaccugagcuuccaggaucugucugagaccccuugccaaaucgaccuugccacggcuuccauugauggagccuggggcagcggggugggcuuuaaucuggucuguacaguuucccucaccgagugcagcgccuuccugacaucuaucaaggcuugugacgcggccaugugcuauggaagcaccacagcuaaccucgugcggggccagaacaccauucacaucguggggaaaggaggccauuccgggucuaaguuuauguguugccacgauacgaaauguagcuccaccggacuggucgccgccgcuccccaucuugacagagugacaggcuacaaucaggccgauucugacaagauuuucgacgauggcgcgccugaaugcgggaugagcuguugguucaagaaauccggagaguggauccugggcguucucaacgggaauuggaugguggucgcugugcugguugugcugcuuauccugucuauucuccuguuuacccucugcuguccccgccggccuagcuauagaaaggaacacaaacccuga

SEQ ID NO: 13457 - RNA, 3447 nt, Artificial Sequence
  derived and/or modified CDS sequence (opt5) from MUV(11-1)__JX028272.1__GP
augggcaagaucagccccguguaccuguaucuccuguuccaggggcuucugcucuggagagacggacuggcccggaaccuuaaugagcugaaaauggaaugcccucacaccauuggccucgggcaaggacuggucaucggcuccguugagcugccgcccgugccucuccgccagguggaaucucugaaacuugagagcuccuguaacuuugaucugcauacaucuacggcuacccagcagagcuucacaaaauggauuugggaauccaagaaugaccucaccgauucuacacaagccagcuccaccagcuaccagacaaaaucuaccgaggucaaccugaaggggcuuugccuggugcccacgcucguuaucgagaccgcggcuagaacacggaagaccauugccuguuuugaccuguccugcaaucagacagugugucagccuaccgucuaucugaucggacccauccaaacgugcauuacaaccaaaagcugucucaucggccugggcgaucagcgcauucaggugaacuacgaaaagacauauugcguuucugggcagcuuguggagggagucuguuucaauccuauccacaccauggcccugucccaaccgagccauaccuacgacguggugacaaugauggucagaugcuuucucguugugaaaaaggugacgucuggcgauuccaugaaaauugaaaagaacuucgagacccugguccagaagacaggguguagcaauaacaauuuucagggauauuacgugugccuuaucggcuccucuagcgagccccuguacguuccuacccucgacgauuaucgguccgcugaaauucugagccgcauggccuucgcuccccacggggaggaccaugauaucgaaagaaacgccaucucugcgaugcggauugugggaaaagucacaggcaaggccccuuccagcgagucuagcgacaccgugcaaggcguugcuuuuuccgggaauccccuguacacgucuacaggagugcucaccagcaaagaugacccggucuaugugugggccccuggcaucauuauggaagggaaccacuccgucugcgacaagaaaacccugccccuuacauggaccggauacaucccucugcccggcgagauugagaagacaacgcaguguaccguguucugcacacucgcugggcccggagccgauugugaagcguauagcgagaccggcaucuuuaauaucucuuccccuacaugccugauuaaccgcguucagagauuccggggcgccgaacagcaaaucaaauuugugugucagcgcgucgacauggauauuaccguguacugcaacgggaucaagaagguuauucuuacgaaaacccuggugaucggacaguguaucuauacauucaccagcauuuucucucucaugccgggcgucgcucacucccuggccguggagcugugcgugcccgggcuccauggaugggcuacaaugcugcuucugcucaccuuuuguuucggcuggauccugauuccuacgaucacacugauucuucucaagauccugcuggccuuugccuacguuugcagcaaauacaauaccgacuccaaguucaaaauucucaucgaaaaggucaagcaggaguaucaaaagacaauggggucuauggugugugaggugugccagcacgaaugcgagaccgcuaaggaacuggagagccauaaaaaguccugucccaucggcucuugcccuuacugucuuaaccccgcggaagccaccacaagcgcucugcaggcccacuuuaaagucugcaagcucacguccagauuccaggagaaucugcgcaagagccugaccguguaugagccgaaacaaggauguuaccggacacuuucucucuuuagauaucgguccagaugcuucguuggccugauuugguguauccugcucacccuggaacuuauugugugggccgcuagcgccgagacacugaaccucaauccuggguggaccgauacggcgcacggaucuggcaucguccccaugaagacagaccuggaacuggauuuuucccuuccuagcucugcuagcuacaccuaucgccggucccuccagaaccccgccaaugagcaggaacaggugccuuuccaucugcaaauugaaaaacagguuauccacgccgagauccagcaucuggggcacuggauggacgcuaccuuuaaccucaagacagccuuccauugcuacggagcuugugaaaaauacgccuaucccuggcaaaccgcgggcugcuuuguggagaaggauuucgaguucgagaauggguggggcuguaacccgccugacugccccggagucggcacagggugcacggccuguggagcuuaccuggauaaacuuaagagcgugggcaagguuuuuaaaauugugucucugagauauacccgcaaggccugcauccagcucgggacagagcagaccuguaaaaaugucgacuccaacgacugccuggugacaaccagcgugaaggucugucugauuggaacgaucuccaaauuccagcccucugauacccuucucuuucugggcccucuggaacaagggggcauuaucuucaagcaguggugcacaaccacaugucaguuuggagacccgggcgauaucaugagcacccccauugggaugaagugcccugagcucaauggauccuuccggaaaaaguguucuuuugcuacaacccccguuugccaguucgacggcaacacgaucagcggguacaaaagaaugauugccacaaaggauuccuuucaaucuuucaaugugaccgaaccucacaucagcgcguccgcccuggaguggauugaccccgauagcucucuucgcgaccacaucaacguggucgugggacgggaucugccuuuucaggaccucuccgaaacccccugucagaucgaucugagcacaucuuccauugacggcgcuugggggagcggcguuggauucaaccuggugugcucugucucccuuaccgagugcuuuacguuccugaauagcaucaaagccugugauacagcuaugugcuauggcuccaccacagccaaccucgugagagggcagaauaccguucauguggucggaaagggcgggcacagcggaucuaaguucauguguugccaugacacaaaauguagcaacaccggccugcucgccgcugcgccgcaccuggaccgcgugacgggcuacaaucaagccgauuccgacaagguuuuugaugacggggcuccugagugcggaaugaccuguugguucaaaaagucuggcgaauggauuaugggggugcuuagcggaaacuggauggucguggccgugcugaucacacuccugguccuguccauuuuucuuuucgcccugugcuguccccggagagcugccuauaaaaaggagcacaagccuuga

SEQ ID NO: 13458 - RNA, 3447 nt, Artificial Sequence
  derived and/or modified CDS sequence (opt5) from MUV(11-4)__JX046483.1__GP
augggcaagaucagccccguguaccugugccuccugcuucaggggcugcuccuguggagagacggacuugcccggaaccugaaugagcucaaaauggaauguccucacaccauuggccuggggcaaggacuggucaucggcuccguugagcucccgcccgugccucugcgccagguggaaucucuuaagcuggagagcuccugcaacuucgaucuccauacaucuacggcuacccagcagagcuuuacaaaauggauuugggaauccaagaaugaccugaccgauucuacacaagccagcuccaccagcuaucagacaaaaucuaccgaggucaaccuuaaggggcugugucucgugcccacgcugguuaucgagaccgcggcuagaacacggaagaccauugccugcuucgaccuguccuguaaucagacagugugccagccuaccgucuaccucaucggacccauccaaacguguauuacaaccaaaagcugccugaucggccuuggcgaucagcgcauucaggugaacuaugaaaagacauacuguguuucugggcagcugguggagggagucugcuuuaauccuauccacaccauggcccucucccaaccgagccauaccuaugacguggugacaaugauggucagauguuuccugguugugaaaaaggugacgucuggcgauuccaugaaaauugaaaagaacuuugagacccuuguccagaagacagggugcagcaauaacaauuuccagggauacuaugugugccugaucggcuccucuagcgagccccucuacguuccuacccuggacgauuaccgguccgcugaaauucugagccgcauggccuuugcuccccacggggaggaccaugauaucgaaagaaacgccaucucugcgaugcggauugugggaaaagucacaggcaaggccccuuccagcgagucuagcgacaccgugcaaggcaucgcuuucuccgggaauccccucuauacgucuacaggaguucugaccagcaaagaugacccgguguacgucugggccccuggcauuaucauggaagggaaccacuccgugugugacaagaaaacccuuccccugacauggaccggauauauuccucuccccggcgagaucgagaagacaacgcagugcaccgucuuuuguacacuggcugggcccggagccgauugcgaagcguacagcgagaccggcaucuucaauauuucuuccccuacaugucuuaucaaccgcgugcagagauuucggggcgccgaacagcaaauuaaauucguuugccagcgcguggacauggauaucaccgucuauuguaacgggauuaagaaggugauccugacgaaaacccucguuaucggacagugcauuuacacauuuaccagcaucuucucucugaugccgggcguggcucacucccuggccgucgagcucugugugcccgggcugcauggaugggcuacaaugcuucugcuccugaccuucugcuuuggcuggauucugaucccuacgauuacacuuauccuccugaagauucugcucgccuucgccuauguguguagcaaauacaauaccgacuccaaguuuaaaauccugaucgaaaagguuaagcaggaguaccaaaagacaauggggucuauggucugcgaggugugccagcacgaaugugagaccgcuaaggaacuugagagccauaaaaaguccugccccauuggcucuuguccuuauugccugaaccccgcggaagccaccacaagcgcucuccaggcccacuucaaaguguguaagcugacguccagauuucaggagaaucugcggaaaagccuuaccgucuacgagccgaaacaaggaugcuaucgcacacucucucuguucagauaccgguccagauguuuugugggccugaucuggugcauucuccugacccuugaacugaucguuugggccgcuagcgccgagacacucaaccugaauccuggguggaccgauacggcgcacggaucuggcauugugcccaugcgcacagaccuggaacuugauuucucccucccuagcucugcuagcuauaccuaccggagaucccugcagaaccccgccaaugagcaggagcagaucccuuuucaucugcaaaucgaaaagcaggucauucacgccgagauccagcaucucgggcacuggauggacgcuaccuucaaccugaaaacagccuuucauuguuauggagcuugcgaaaaguacgccuaccccuggcaaaccgcgggcuguuucguggagaaagauuuugaguucgaaaauggguggggcugcaacccgccugacugccccggaguuggcacaggguguacggccugcggagcuuaucuugauaagcucaagagcgugggcaaagucuucaagauugugucucugcgcuacacccggaaagccuguauccagcuggggacagagcagaccugcaagaauguugacuccaacgacugucuggugacaaccagcgucaaagugugccuuauuggaacgaucuccaaguuucagcccucugauacccuccuguuccugggcccucucgaacaagggggcaucauuuuuaaacagugguguacaaccacaugccaguucggagacccgggcgauaucaugagcacccccauugggaugaaguguccugagcugaauggauccuuuagaaagaaaugcucuuucgcuacaacccccgugugucaguuugacggcaacacgaucagcggguauaagcgcaugauugccacaaaagauuccuuccaaucuuuuaaugucaccgaaccucacaucagcgcguccgcccuugaguggaucgaccccgauagcucucugcgggaccacauuaacguuguggugggaagagaucucccuuuccaggaccuguccgaaacccccugccagaucgaucugagcacaucuuccauugacggcgcuugggggagcggcgucggauuuaaccuugugugcucuguuucccugaccgaguguagcacguuccucacauccaucaaggccugcgauaccgcuauguguuacggcagcacaaccgccaaucuggugcgcgggcagaacacaguccaugugguuggaaaaggcgggcacucuggaagcaaguuugugugcugucaugacaccaagugcuccaauacgggccuccuggccgcugcgccgcaccuugaccgggucaccggcuauaaccaagccgauucugacaaaguguucgaugacggggcuccugaguguggaaugacaugcugguucaagaaaagcggcgaauggauuauggggguucuguccggaaauuggaugguggucgccgugcucaucacccugcuggugcuuucuauuuuucuguucgcccucuguugccccagacgcgcugccuacaagaaagagcacaagccuuga

SEQ ID NO: 13459 - RNA, 3447 nt, Artificial Sequence
  derived and/or modified CDS sequence (opt5) from MUV(11-5)__JX046486.1__GP
augggcaagaucagccccguguaccugugccuccugcuucaggggcugcuccuguggagagacggacuugcccggaaccugaaugagcucaaaauggaauguccucacaccauuggccuggggcaaggacuggucaucggcuccguugagcucccgcccgugccucugcgccagguggaaucucuuaagcuggagagcuccugcaacuucgaucuccauacaucuacggcuacccagcagagcuuuacaaaauggauuugggaauccaagaaugaccugaccgauucuacacaagccagcuccaccagcuaucagacaaaaucuaccgaggucaaccuuaaggggcugugucucgugcccacgcugguuaucgagaccgcggcuagaacacggaagaccauugccugcuucgaccuguccuguaaucagacagugugccagccuaccgucuaccucaucggacccauccaaacguguauuacaaccaaaagcugccugaucggccuuggcgaucagcgcauucaggugaacuaugaaaagacauacuguguuucugggcagcugguggagggagucugcuuuaauccuauccacaccauggcccucucccaaccgagccauaccuaugacguggugacaaugauggucagauguuuccugguugugaaaaaggugacgucuggcgauuccaugaaaauugaaaagaacuuugagacccuuguccagaagacagggugcagcaauaacaauuuccagggauacuaugugugccugaucggcuccucuagcgagccccucuacguuccuacccuggacgauuaccgguccgcugaaauucugagccgcauggccuuugcuccccacggggaggaccaugauaucgaaagaaacgccaucucugcgaugcggauugugggaaaagucacaggcaaggccccuuccagcgagucuagcgacaccgugcaaggcaucgcuuucuccgggaauccccucuauacgucuacaggaguucugaccagcaaagaugacccgguguacgucugggccccuggcauuaucauggaagggaaccacuccgugugugacaagaaaacccuuccccugacauggaccggauauauuccucuccccggcgagaucgagaagacaacgcagugcaccgucuuuuguacacuggcugggcccggagccgauugcgaagcguacagcgagaccggcaucuucaauauuucuuccccuacaugucuuaucaaccgcgugcagagauuucggggcgccgaacagcaaauuaaauucguuugccagcgcguggacauggauaucaccgucuauuguaacgggauuaagaaggugauccugacgaaaacccucguuaucggacagugcauuuacacauuuaccagcaucuucucucugaugccgggcguggcucacucccuggccgucgagcucugugugcccgggcugcauggaugggcuacaaugcuucugcuccugaccuucugcuuuggcuggauucugaucccuacgauuacacuuauccuccugaagauucugcucgccuucgccuauguguguagcaaauacaauaccgacuccaaguuuaaaauccugaucgaaaagguuaagcaggaguaccaaaagacaauggggucuauggucugcgaggugugccagcacgaaugugagaccgcuaaggaacuugagagccauaaaaaguccugccccauuggcucuuguccuuauugccugaaccccgcggaagccaccacaagcgcucuccaggcccacuucaaaguguguaagcugacguccagauuucaggagaaucugcgcaagagccuuaccgucuacgagccgaaacaaggaugcuaucggacacucucucuguucagauaccgguccagauguuuugugggccugaucuggugcauucuccugacccuugaacugguugugugggccgcuagcgccgagacacucaaccugaauccuggguggaccgauacggcgcacggaucuggcaucguccccaugcgcacagaccuggaacuugauuucucccucccuagcucugcuagcuauaccuaccggagaucccugcagaaccccgccaaugagcaggagcagauuccuuuucaucugcaaaucgaaaaacaggugauccacgccgagauucagcaucucgggcacuggauggacgcuaccuucaaccugaaaacagccuuucauuguuauggagcuugcgaaaaguacgccuaccccuggcaaaccgcgggcuguuucguugagaaagauuuugaguucgaaaauggguggggcugcaacccgccugacugccccggagugggcacaggguguacggccugcggagcuuaucuugauaagcucaagagcgucggcaaaguguucaagaucguuucucugcgcuacacccggaaagccuguauucagcuggggacagagcagaccugcaagaauguggacuccaacgacugucuggucacaaccagcgugaaagugugccuuaucggaacgauuuccaaguuucagcccucugauacccuccuguuccugggcccucucgaacaagggggcaucaucuuuaaacagugguguacaaccacaugccaguucggagacccgggcgauauuaugagcacccccaucgggaugaaguguccugagcugaauggauccuuuagaaagaaaugcucuuucgcuacaacccccgucugucaguuugacggcaacacgauuagcggguauaagcgcaugaucgccacaaaagauuccuuccaaucuuuuaauguuaccgaaccucacauuagcgcguccgcccuugaguggaucgaccccgauagcucucugcgggaccacaucaacgugguggucggaagagaucucccuuuccaggaccuguccgaaacccccugccagauugaucugagcacaucuuccaucgacggcgcuugggggagcggcgugggauuuaaccuuguuugcucugugucccugaccgaguguagcacguuccucacauccauuaaggccugcgauaccgcuauguguuacggcagcacaaccgccaaucugguccgcgggcagaacacagugcauguugugggaaaaggcgggcacucuggaagcaaguuugucugcugucaugacaccaagugcuccaauacgggccuccuggccgcugcgccgcaccuugaccgggugaccggcuauaaccaagccgauucugacaaaguuuucgaugacggggcuccugaguguggaaugacaugcugguucaagaaaagcggcgaauggaucaugggggugcuguccggaaauuggauggucguggccgugcucauuacccugcugguccuuucuaucuuucuguucgcccucuguugccccagacgcgcugccuacaagaaagagcacaagccuuga

SEQ ID NO: 13460 - RNA, 3408 nt, Artificial Sequence
  derived and/or modified CDS sequence (opt5) from SANGV(SA14)__NC_034516.1__GP
augaucauguggggccugcuccugcuugccgcuauuaccuuccccugccagagccugaagaacguguacgacaugaaaaucgaguguccucacuccgucaauuuuggggaaucuagcguuaugggaaaggugcaacucccgucccugucuauuacagaggccgaacagcuugugcccgagagcuccugcaacauggauaaucaucagucucugagcguccuccagaaagcgacgaagaccacauggagaaagaaggcugaccacuccaacgccggcaaggauagcuaugaacugaucaccucugagauucaauucaaagggguguguucccugacacauaagaugaucgaggaaagccaccggcuccgcagaucuguuaucugcuacgaccuguccuguaauaccacacauugcaaaccuacccuuuauauggugguccccgugcacagcuguaacaugaugaagucuugccugauuggacucggcccuuaccggauccagguuguguaugagcgcacguacuguaccgucggggugcugaaugaaggaaaaugcuuugugcccgaucaguccgucgccaacauuguuaagaauggcaucuucgacauugugagcgugcagaucauuuguuucuucaucagaaucaagggcuccacauauaaaauucuugagaccgucaagacagcuaugaacgggaaaugcaauggaaccgaugacaaggugcaaggcuacuacaucugccugcucgggggaaacucuggcccuauuuauguuccgagcgggacggauuuucgggccauggaggcucuggccaauaugcugcgcgcgccccacggagaagaccaugaucucccuggcgaggaacuggccuccuacagcaucgcuggcacaauugaggggaaaaucccccacaccgccucuucccagaaccuugaauuuacagcuuauagcggaaucccuucuuacagcuccuuuucugugcauacccugacccaggacggccagcucagcuauucccccgggcuguucccgaaucuuaaccaaagcgauuguaagaaaaacgcccugccucucauuugggagggaacaaucgagcugcccggcuacuaugaagcgauucacccuugcaaugucuuuuguguguucucugggcccggagccuccugcgaggcuuuuagcgaaggcggcaucuucaacauuacgucucccaccugucugguuuccaagcagaauagauuccgggccgcugagcagcaaaucacauuugugugccagcgcgucgacauggacaucauuaucuacuguaacgggcagagaaaggugauucucaccaaaacacuggucaucggacagugcauuuacagcaucaccucccuuuucucucugcucccuagcguggcccacuccauugccaucgaacuguguguuccgggcuuucaugggugggcuacggcggcccuucugacaaccuucugcuuuggauggcuccugauccccucuauuaccuauaucgugcugcucauucugaaguucaucgcugccauuuuucacaauacaacccaagagaacaaauucaaggccauccuucggaaaaucaaggaggaauuugagaagacaaaaggcagcauggucugugauauuugcaaguacgaaugcgagacggggaaagaacugaaggcucauaaucucuccuguaaccagagccagugcccuuauuguuucacccacugcgagaugacagagucugccuuucaggcgcauuacaaagugugucaagcuacccaccgcuucagagaagaccugaagaagacaaucacgccccagaccauuuccccuggcugcuaucggacccugaaucuuuuucgcuacaaaagcagauguuauauccucacaguuuggcugugccugcucauucuggagucuaucgccugggccgcuuccgccagcgaaaccucucuuaacccccuguggacagauaaugcucacggagugggcagcgucccgaugcauaccgaccucgagcuggauuucucccugccuucuagcuccaaguacacguacaaacggaaacuuacaagccccaccaacccugagcaggccgugucccuccacaucgaaauugagucucaggggaucgcggccgacgugcauagccugggacacugguaugaugcuagacugaaucucaaaacauccuuccacuguuacggcgccugcaccaaguaucaauaccccuggcauaccgcuaagugucacuuugaacaugacuuccaguaugagaacucuugggggugcaauccucccgauugcccgggaguuggcacaggguguacggccugcggccuguaccuugaccagcugaaaccugucggaagcgcguauaagcucauuaccgugcgcuacucccggaaaguguguguccaguuuggcgaagagaaccugugcaagacaaucgauaugaacgacuguuucaugucuagacacgugaaaguuugcauuaucgggaccgugagcaaguuuucccaaggagacacacuggucuuccuuggcccccucgaagggggaggccugaucuuuaaagauugguguaccagcacgugccaguacggggaccccggcgauauuaugucuccucgcgaccggggauucuccuguccggaauuucccggcagcuucagaaagaagugcaauuuugccacaaccccugugugugaguauucugggaacaugguuuccggauacaaaaaggugauggcuaccaucgauagcuuccagucuuuuaauacaucccugauucauuucaccgaggagcgcaucgaauggaaagaccccgauggcaugcuccgggaccaccugaacauucuugucacaaaggauaucgacuucgagaaucugggggagaacccuugcaaagugggacuccaaacgagcuccauugaaggcgccugggggagcggcguuggauuuacccuggugugccaggucucucugaucgauugugcuagauuccuuacaagcaucaaggccugcgacauggccauuuguuauggcgcucaguccgugucucucgugcgcgggcagaauaccgucaagaucacaggaaaaggcgggcacagcggauccucuuuuaagugcugucaugagguugauugcagcuccaccggccugcaagcgucugcuccccaccuggacaaagugaacggcauuagcgaacaggagaaugacaagguguacgaugacggggccccucaguguggagucuccugcugguucgugaaaagcggcgaauggaucucugggauucuccauggaaacuggguuguggucgugguucuggugauccuucugcucuuuucccugauccugcuuagcauucugugucccguccggaagcacaagagaucuuga

SEQ ID NO: 13461 - RNA, 3408 nt, Artificial Sequence; identical to SEQ ID NO: 13460
  derived and/or modified CDS sequence (opt5) from SANGV(SA14)__NC_034516.1__GP

SEQ ID NO: 13462 - RNA, 3402 nt, Artificial Sequence
  derived and/or modified CDS sequence (opt5) from SEOV(L99)__AF288298.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucguguggcggaaaaaggcuaaucaagaacucgccaaccagaauagcuuugagguuguggaguccgaagucagcuucaaagggcugugcaugcuuaagcaccgcaugguggaggaaucuuauagaaaccggcgcuccguuaucuguuacgaccuggccugcaauagcacauuuuguaagccuaccguguauaugauuguccccauccaugcuugcaacaugaugaaaucuugucucauuggacugggcccuuacagaauccaggugguguaugagcggacauacugcaccacagggauccuuaccgagggaaaguguuucguccccgauaaagccguuguguccgcucugaagcgcggcauguaugccauugcgagcaucgaaacgauuugcuuuuucauccacaaaaagggcaauaccuacaagauugugacagccaucaccucugcuaugggguccaaauguaacaauacagacaccaagguccagggauacuauauuugcaucaucggcgggaacagcgccccuguguacgcuccggccggagaggauuuuagagcgauggaaguuuucuccggcauuaucacgucuccccauggggaggaccacgaucucccuggagaagagauugccacauaucaaaucagcggccagauugaggcuaaaaucccccacaccguguccagcaagucucugaaacugaucgccuuugcuggcauuccuuccuacagcucuacaagcauccucgccgccuccgaagacgggcgguucaucuuuucucccggacuguucccgaaucuuaaccagagcgucugcgauaacaaugcucugccucucauuuggcgcggccugauugaccuuaccggguauuacgaggcggugcaucccuguaacguuuucugcgugcuguccggaccuggcgccagcugugaggcuuuuucugaagggggaaucuucaauaucaccucccccaugugccucgucagcaagcagaacagauuucgggccgccgaacaacagauuucuuucaucugucagcgcguggauauggacauuaucgucuauugcaauggccagaaaaagacaauucugacgaagacccuggugaucggccaauguauuuacacaaucaccucccucuuuagccugcuucccgggguugcucacuccaucgccauugagcugugcgugccuggauuccauggcugggcgacagcugcccuccugaucaccuuuuguuucggguggguccuuauuccggccugcacgcuggcuauccuccuggugcugaaauuuuucgccaacauucuccacacaucuaaucaggagaacagauuuaaggcuauccugcggaaaaucaaggaagaguucgagaaaaccaagggaagcaugguuugugaaauuugcaaguacgaaugcgagacccuuaaagagcugaaggcccacaaucucuccugugugcagggcgaaugccccuauuguuuuacacauugcgagccuaccgaaacagcgauccaagcccacuacaaagucugucaggcuacgcaucgcuucagagaggaucugaagaaaaccgugacacccaagaacauugggccuggcugcuaucggacccugaaucuuuucagauacaagucucgcuguuauauccucacaauguggacccugcugcucauuaucgagagcauccugugggccgcuuccgccgcggaaauuccccuugugccgcuguggacggacaacgcccacggaguuggcagcgucccuaugcauaccgaccucgagcuggauuuuucucugcccuccagcucuaaauacgcuuauaagcggcaccuuacaaauccugugaacgaccagcaguccgugagccuccacaucgaaauugagucucaagggaucggagccgauguccaucaccugggccauugguacgacgcuagacugaaucucaaaaccagcuuccacugcuacggggccuguacaaaguaucaguaccccuggcacaccgccaaaugccauuuugaaaaggauuaugaguacgagaacuccugggcuuguaacccucccgacugcccgggagugggcacggggugcacagcguguggccuguaucuugaucagcugaagccuguuggaaccgccuucaaaauuaucagcgugcgcuacucucggaaggucugcgugcaguuuggcgaagaguaucucuguaaaacaaucgacaugaaugauugcuucguuaccagacacgcuaagauuuguaucauugggaccguguccaaauuuagccaaggagacacacugcuguuccuuggccccauggaagggggaggcaucauuuuuaagcauuggugcacguccaccugucacuucggggaucccggcgacgucaugggaccuaaagacaagccguuuucuugccccgaguucccuggccaguuucgcaagaaauguaacuucgccacaacccccaucugcgaauacgaugggaauauuaucagcggauacaagaaagugcucgccacaaucgacuccuuccagucuuuuaacaccagcaauauucauuucacggaugagcggaucgaguggagagacccugauggcaugcugcgcgaccacauuaacaucguuauuuccaaggauaucgacuuugaaaaucuggcugagucucccuguaaaguggggcuccaggccgcgaacaucgaaggagcuuggggcagcggggucggcuucacacugaccugccaagugucccuuaccgagugcccuacauuucugaccagcauuaaggccugugauauggccaucugcuauggagcugaaucugugacacucucccggggccagaauacggucagaauuaccgggaagggaggccacagcgggucuuccuucaaauguugccauggaaaggaguguagcucuacaggccugcaggccuccgcgccccaccuggacaaaguuaacggcaucagcgagcuugaaaaugagaagguguacgaugacggggcuccggaaugcggagugaccuguugguuuaaaaaguccggcgagugggucauggggauuaucaacggaaauugggugguucucaucgugcugugcguccugcuccuguucagccuuauucugcucucuauccuguguccugugcgcaagcauaaaaagagcuga

SEQ ID NO: 13463 - RNA, 3402 nt, Artificial Sequence
  derived and/or modified CDS sequence (opt5) from SEOV(Rn10-134)__JF693883.2__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcgcuuccucugauuuggcgcggccucauugaccugaccggguauuacgaggcuguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucauuacguuuuguuucggguggguccugaucccggccugcacacuugcuauucugcucgugcugaaguuuuucgccaauauccugcacaccucuaaccaggagaauagauuuaaagcuauucuccggaagaucaaagaagaguucgaaaagaccaaaggaagcaugguuugugagaucugcaaguacgaaugcgagacacugaaggagcuuaaagcccacaaccuguccugugugcaaggcgaaugccccuauuguuuuacccauugcgagccuacagaaacggcgauucaggcccacuacaaggucugucaggcuacccaucgcuucagagaggaucucaaaaagacagugacaccccagaauaucgggccuggcugcuaucggacccugaaccuguucagauacaaaucucgcuguuauauucuuaccauguggacgcuccugcugaucauugagagcauccucugggccgcuuccgccguggaaaucccccugguuccgcuuuggaccgacaaugcgcacggagucggcagcgugccuaugcauacagaccuggagcucgauuuuucucugcccuccagcucucgguacaccuauaagagacaccugacaaacccugugaaugaccaacaguccgucagccuucacauugaaaucgagucucaggggauuggagccgaugugcaucaccucggccauugguacgacgcucgccugaaccugaagaccagcuuccacugcuacggggccuguacgaaauaucaguaccccuggcacacagcuaagugccauuuugaaaaagauuaugaguacgagaacuccugggccuguaauccucccgacugcccgggaguuggcaccgggugcacagccuguggccucuaucuggaucaacuuaagccugugggaaccgcuuucaaaaucauuagcguccgguacucuagaaaggugugcguucaguuuggcgaagaguaucuguguaagaccaucgacaugaacgauugcuucgugacacgccacgcgaaaaucuguauuaucgggacggucuccaaguuuagccagggagacacccuccuguuccugggccccauggaagggggaggcauuaucuuuaaacauuggugcacauccaccugucacuucggggaucccggcgacgugaugggaccuaaggacaaaccguuuauuugccccgaguucccuggccaguuucggaagaaauguaauuucgccacaacccccguuugcgaauacgaugggaacaucauuucuggauacaagaaggugcuugcuacgaucgacagcuuccaauccuuuaauacaucuaacauccauuucaccgaugagagaauugaguggcgcgacccugauggcaugcuccgggaccacaucaauauugucaucagcaaagauauugacuuugaaaaccuggccgagaaucccuguaagguggggcugcaggccgcuaacaucgaaggagccuggggcuccggggugggcuucacccucacaugccaggucucucugaccgagugcccuacauuucuuacgagcaucaaagcgugugauauggcuauuugcuauggagccgaauccguuacccugagcagaggccaaaauacagugaagaucaccgggaaaggaggccacucuggguccagcuucaaguguugccauggaaaggaguguucucucacaggccugcaggccuccgcuccccaccuggacaaagugaacggcauuagcgagcuugaaaaugagaaggucuacgaugacggggccccggaaugcggaaucaccuguugguuuaaaaagucuggcgagugggugauggggauuaucaacggaaauuggguugugcucaucguccugugcgugcugcuccuguucucccuuauucugcucagcauccuguguccuguucgcaaacauaagaaguccuga

SEQ ID NO: 13464 - RNA, 3402 nt, Artificial Sequence
  derived and/or modified CDS sequence (opt5) from SEOV(Gou3-e5)__AF288650.1__GP
auguggggccugcuccugcuugccgcucugguggggcagggacucgcccugaagaacgucuucgacaugaaaauccaaugcccccacagcguuaauuuuggcgagaccuccgugucuggguacacagaacuuccuccgcugccccuccaggaggcggaacagcuggugccugagagcuccuguaacauggauaaucaucagucucugagcacgauuaacaagcucaccaaagucaucuggagaaagaaagcuaaucaagaauccgccucucagaacagcuucgaggugguugagaaugaaguguccuuuaagggacugugcaugcuuaagcaccggauggucgaggaaagcuaucgcaacagacggucugugauuuguuacgaccuggccugcaauacaaccuucuguaaacccacaguuuauaugaucgugccuauucaugcuugcaacaugaugaaguccugucucaucggccuggggcccuaccgcauccaggucauuuaugagagaaccuacugcacaaccggaauccuuacggagggcaaauguuuugugccugauaaggccguggucagcgcucugaaacggggcauguaugccauugcgucuaucgaaaccauuugcuucuuuguucaccagaaggggaauacauacaagaucguguccgccauuaccagcgcuaugggaucuaaauguaacaauacagacuccaaggugcaaggcuacuauaucugcaucauugggggaaacagcgccccggucuacgcucccgccggcgaggauuuccgcgcgauggaaguguuuuccgggaucauuaccucuccucauggagaggaccacgaucuccccggcgaagagaucgccacguaucagauuagcggccagaucgaggcuaaaaucccucacacaguuuccagcaagaaucugaaacugaccgccuucgcugggauucccucuuacuccagcacaucuauccucgccgccagcgaagacggaagauuuauuuucuccccgggccuguuuccuaaccuuaaccagucugugugcgauaauaacgcucugccccucaucuggcgggggcugauugaccuuaccggauauuacgaggcgauccauccuuguaaugucuucugcgugcugagcggccccggggccuccugugaggcuuucagcgaaggaggcaucuuuaacauuaccucucccaugugccucguuuccaagcaaaaucgcuucagagccgccgaacagcagaucagcuuuauuugucaacggguggauauggacaucgucguguauugcaacggccagaaaaagacaauucugacgaagacccuggucaucgggcaguguauuuacacaaucaccucucucuucucccugcuuccuggaguggcucacagcaucgccauugagcugugcguuccgggcuuucaugggugggcgacagcugcccuccuggugaccuucuguuuuggauggguccuuauccccgccugcacgcuggcugugcuccuguuccugaaauuuuucgccaauauucuccacacauccaaccaggagaaucgcuuuaaggcuauccugagaaaaauuaaggaagaguucgagaaaaccaagggcucuaugguuugugaaaucugcaaguacgaaugcgagacccuuaaagagcugaaggcccacaaccucagcugugugcaaggggaaugcccuuauuguuuuacacauugcgagcccaccgaaacagcgauccaggcccacuacaaagucugucaggcuacgcaucgguuccgcgaggaucugaagaaaaccgugacaccucagaauauuggccccggaugcuauagaacccugaaccuuuuccgguacaaguccagauguuauauccucacaauguggauucugcugcucgugaucgagucuauucugugggccgcuagcgccgcggaaaucccgcuuguuccucuguggaccgacaaugcccacggcgucggguccgugcccaugcauacggaccucgagcuggauuuuagccugccuucuuccagcaaguacaccuauaaacgccaccuuacaaaccccgugaaugaccaacagucugucucccuccacaucgaaauugagagccagggaaucggcgcugaugugcaucaccuggggcauugguacgacgcccggcugaaccucaagaccucuuuccacugcuacggagcuuguacaaaauaucaguacccuuggcacaccgccaagugccauuuugaaaaagauuaugaguacgagaacagcugggccuguaaucccccggacugcccuggcguugggacgggcugcacaggauguggccuguaucuugaucaacugaagcccguggggaccgcuuucaagauuaucuccgucagauacagccgcaaagugugcguucaguuuggagaagaguaucucuguaagacaauugacaugaacgauugcuucgugacccggcacgcgaaaaucuguaucauuggcaccgucucuaaguuuucccagggggacacacugcuguuccuuggacccauggaaggcgggggcaucauuuuuaaacauuggugcacgagcaccugucacuucggagauccuggcgacgugauggggccgaaggacaaacccuuuaucugcccugaguuccccggacaguuuagaaagaaguguaauuucgccacaaccccuguuugcgaauacgauggcaacgugauuuccggguaccgcaaaguccucgcuacaaucgacucuuuccagagcuuuaauaccuccaacgugcauuucacggaugagcggauugaguggaaggaccccgauggaaugcugagagaccacaucaauaucgugauuucuaaagauaucgacuuugaaaaccuggccgagaauccuuguaaggucggccuccaagccgcuaacauugaaggggccuggggcagcggaguuggcuucacacugaccugccaggugucccuuaccgagugccccacauuucugaccucuaucaaagcgugugauauggcuauuugcuauggggccgaaagcgugacacucucccgcggacaaaauacgaucaagaucaccggccggggcggacacagcgggucuuccuucaaguguugccauggcaaagaguguagcgccaacgggcugcaggcuucugccccgcaccuggacaaggucaauggaauuuccgagcuugaaaacgagaaaguguacgaugacggcgcgccugaaugcgggaucacauguugguuuaagaaaagcggagaguggguuaugggcauuaucaaugggaacugggugguccucauugugcugugcguucugcuccuguucucucuuauccugcucuccauccugugucccgugagaaagcauaagaaaagcuga

SEQ ID NO: 13465 - RNA, 3402 nt, Artificial Sequence
  derived and/or modified CDS sequence (opt5) from SEOV(China)__EU163437.1__GP
auguggagccugcuccugcuugccgcucuggugggccagggguucgcccucaagaacgucuuugacaugagaauccaaugcccccacuccguuaaauucggagagaccucugugagcggcuacacagaacugccuccgcuuucccugcaggaggcggaacagcucgugcccgagucuagcuguaauauggauaaccaucagucccugucuacgauuaauaagcugaccaaagucaucuggcggaagaaagcuaaccaagaaagcgccaaucagaacuccuuugagauucucgagagcgaagugucuuucaaggggcugugcaugcuuaagcaccgcaugguugaggaauccuauagaaaucggcgcagcgugaucuguuacgaccuggccugcaacucuacauuuuguaaaccuaccgucuauaugauugugcccauccaugcuugcaauaucaugaaguccugucucauuggacugggcccuuacagaauccagguuguguaugagcggacauacugcaccacagggauucuuaccgagggaaaauguuucguccccgauaaggccguggugagcgcucugaaacgcggcauguaugccaucgcgucuauugaaacgaucugcuuuuucauucaccagaagggcaacaaguacaaaaucgucaccgccaucacauccgcuauggggagcaaguguaauaacaccgacacaaaaguucaaggauacuauauuugcaucauuggcggaaauuccgccccuguguacgcuccggccggggaggauuuuagagcgauggaaguguucucuggcaucauuaccagcccccauggggaggaccacgaucucccuggagaagagaucgccacguaucagaucuccggccagauugaggcuaagaucccccacacagucagcucucagaaccugaaacugaccgccuuugcuggcauuccuuccuacagcucuacaagcauccucgccgccuccgaagacgggcgguucaucuuuucucccggacuguucccgaaucuuaaccaaagcgugugcgauaacaaugcucugccucucaucuggcgcggccugaucgaccuuaccggguauuacgaggcgguucaucccuguaacguguucugcguccuguccggaccuggcgccagcugugaagccuuuucugaagggggaauuuucaauaucaccucccccaugugccucgugagcaagcagaacagauuucgggccgccgaacagcaaauuucuuucaucugucagcgcguugauauggacauuaucguguauugcaauggccagaaaaagacaauucugacgaagacccuggucaucggccaguguaucuacacaauuaccucccucuuuagccugcuucccgggguggcucacuccaucgccauugagcugugcgucccuggauuccauggcugggcgacagcugcccuccugaucaccuuuuguuucgggugggugcuuauuccggccugcacgcuggcuauccuccugguucugaaauuuuucgccaacauccuccaaacaucuaaucaggagaacagauuuaaggcuauucugcggaaaaucaaggaagaguucgagaaaaccaagggaagcauggugugugagauuugcaaguacgaaugcgagacccuuaaagagcugaaggcccacaaucucuccuguguccagggcgaaugccccuauuguuuuacacacugcgagccuaccgaaacagcgauccaggcccauuacaaagugugucaagcuacgcaccgcuucagagaggaucugaagaaaaccguuacaccccagaacauugggccuggcugcuaucggacccugaaucuuuucagauacaagucucgcuguuauauccucacaauguggacccugcugcucaucauugagagcauccugugggccgcuuccgccgcggaaauuccccuugugccgcuguggacggacaacgcccauggagucggcagcgugccuaugcacaccgaccucgagcuggauuuuucucugcccuccagcucuaaguacacauauaaacggcaucuuaccaauccugugaacgaccagcaguccguuagccuccacaucgaaauugagucucaagggaucggagcugauguccaccaucugggccacugcuacgacgccagacugaaucucaagaccagcuuccauuguuacggggcuugcacaaaauaucaguaccccuggcacacggccaagugucacuuugaaaaagauuaugaguacgagaacuccugggccugcaacccucccgacugcccgggagugggcacaggguguaccgcuugcggccuguaucuugaucagcugaagccugugggaacagcguucaagaucauuagcguccgcuacucucggaaaguguguguucaguuuggcgaagaguaucucugcaagaccaucgacaugaaugauuguuucgugaccagacaugccaaaauuugcaucauugggacagucuccaaguuuagccaaggagacacgcugcuguuccuuggccccauggaagggggaggcaucauuuuuaaacacugguguaccuccacaugccauuucggggaucccggcgacgugaugggaccuaaggacaaaccguuuaucugucccgaguucccuggccaguuucgcaagaagugcaacuucgcuaccacacccguuugugaauacgaugggaauaucauuucuggauacaaaaaggugcucgccaccaucgacagcuuccaguccuuuaaccggucuuauauucacuucacggaugagagaaucgaguggcgcgacccugauggcaugcugcgggaccauauuaauaucgucaucagcaaagauauugacuuugaaaaccuggccgagaaucccugcaagguggggcuccaagcugccaacaucgaaggagcguggggccuggggguuggcuucacacuuaccugccaggugucccugaccgaguguccuacauuucucaccucuauuaaggcuugcgauauggccaucuguuacggagccgaaagcgucacacuguccagaggccagaauacggugaaaauuaccgggaagggaggccacagcgggucuuccuucaaaugcugucacggaaaggagugcagcucuacaggccugcaggcuuccgcuccccaucuugacaaagugaacggcaucagcgagcucgaaaaugagaaggucuaugaugacggggcgccggaauguggaauuaccugcugguuuaaaaagucuggcgaguggguuauggggauuaucaacggaaauuggguggugcugauuguccugugugugcuccugcuuuucucccugauccuccugagcauucugugcccuguucgcaagcacaaaaaguccuga

SEQ ID NO: 13466 - RNA, 3402 nt, Artificial Sequence
  derived and/or modified CDS sequence (opt5) from SEOV(DPRK08)__JX853576.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcccuuccucugauuuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucauuacguuuuguuucggguggguccugaucccggccugcacacuugcuauucugcucgugcugaaguuuuucgccaauauccugcacaccucuaaccaggagaauagauuuaaagcuauucuccggaagaucaaagaagaguucgaaaagaccaaaggaagcaugguuugugagaucugcaaguacgaaugcgagacacugaaggagcuuaaagcccacaaccuguccugugugcaaggcgaaugccccuauuguuuuacccauugcgagccuacagaaacggcgauucaggcccacuacaaggucugucaggcuacccaucgcuucagagaggaucucaaaaagacagugacaccccagaauaucgggccuggcugcuaucggacccugaaccuguucagauacaaaucucgcuguuauauucuuaccauguggacgcuccugcugaucauugagagcauccucugggccgcuuccgccgcggaaaucccccuggugccgauuuggaccgacaaugcccacggaguuggcagcgucccuaugcauacagaccuugagcuggauuuuucucuccccuccagcucuaaguacaccuauaagcggcaccugacaaacccugugaaugaccaacaguccgugagccugcacaucgaaauugagucucaggggaucggagcugauguccaucaccuuggccauugguacgacgccagacucaaccugaaaaccagcuuccacugcuacggggcuuguacgaaguaucaguaccccuggcacacagccaaaugccauuuugaaaaggauuaugaguacgagaacuccugggccuguaauccucccgacugcccgggagugggcaccgggugcacagcuuguggccuguaucucgaucaacugaaaccuguuggaaccgcguucaagauuaucagcgugcgcuacucucggaaggucugcaugcaguuuggcgaagaguaucuuuguaaaaccaucgacaugaacgauugcuucgugacaagacacgccaagauuuguaucauugggacgguuuccaaauuuagccagggagacacccuccuguuccugggccccauggaagggggaggcaucauuuuuaagcauuggugcacauccaccugucacuucggggaucccggcgacgugaugggaccuaaagacaagccguuuaucugccccgaguucccuggccaguuucgcaaaaaguguaauuucgcuacaacccccgucugcgaauacgaugggaacauuaucucuggauacaagaaagugcuggccacgaucgacagcuuccaauccuuuaauacaucuaacauucauuucaccgaugagcggaucgaguggagagacccugauggcaugcuucgcgaccacauuaauaucguuauuagcaaggauaucgacuuugaaaaccucgccgagaaucccuguaaaguggggcugcaggcugccaacaucgaaggagcguggggcuccggggucggcuucacccugacaugccaggugucucucaccgagugcccuacauuucugacgagcauuaaggcuugugauauggccaucugcuauggagccgaauccgugacccuuagccggggccaaaauacagucaaaauuaccgggaagggaggccacucuggguccagcuucaaguguugccauggaaaagaguguucuuccacaggccugcaggcuagcgcuccccaccucgacaagguuaacggcaucucugagcuggaaaaugagaaaguguacgaugacggggcgccggaaugcggagugaccuguugguuuaagaaauccggcgagugggucauggggauuaucaacggaaauugggugguucugaucgugcuuugcguccuccugcuguucagccucauucugcuuuccauccuguguccugugagaaagcauaagaaaagcuga

SEQ ID NO: 13467 - RNA, 3402 nt, Artificial Sequence
  derived and/or modified CDS sequence (opt5) from SEOV(Fj372/2013)__KP645197.1__GP
auguggagccugcuccugcuugccgcucuggugggccccggguucgcccucaagaacgucuuugacaugagaauccagugcccucacuccguuaauuucggagagaccucugugagcggcuacacagaacugccgccccuuucccugcaagaggcggaacagcucgugccugagucuagcuguaacauggauaaucaucagucccugucuacgauuaacaaacugaccaaggucaucuggcagaaaaaggcuaaucaagaaagcgccaaccaaaauuccuuugaggugguugagagcgaagugucuuucaaagggcucugcaugcugaagcaccggauggucgaggaauccuaucgcaacagacggagcgugauuuguuacgaccuugccugcaauucuacauuuuguaagcccaccguuuauaugaucgugccuauucaugcuugcaacaugaugaaauccugucugaucggacucggccccuaccgcauccaggucguguaugagagaacauacugcaccacagggauucugaccgagggaaaguguuucgugccugauaaagccgucguuagcgcucuuaagcggggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccggucuacgcucccgccggagaggauuuucgcgcgauggaaguguucucuggcaucauuacgagcccucauggggaggaccacgaucugcccggagaagagaucgccacauaucagauuuccggccagaucgaggcuaagaucccucacaccguuagcucuaaaaaucucaagcugacagccuuugcuggcauucccuccuacagcucuaccagcauccuggccgccuccgaagacgggagauucaucuuuucuccgggacucuucccuaaccugaaccagagcgugugcgauaauaacgcucugccccugauuuggcggggccucauugaccugaccggguauuacgaggcgguccauccuuguaauguguucugcguucuuuccggacccggcgccagcugugaggcuuuuucugaagggggaaucuucaacaucacaucccccaugugccuggugagcaaacaaaaucgcuuuagagccgccgaacagcagauuucuuucgucugucaacggguggauauggacaucauugucuauugcaacggccagaagaaaacgauccucaccaagacacuggugauuggccaguguaucuacaccauuacaucccuguuuagccuccugccugggguugcucacuccaucgccaucgagcuuugcgugccgggauuccauggcugggcgaccgcugcccugcucauuacguuuuguuucggguggguccugauccccgccugcacacuugcuauucugcucgugcugaaguuuuucgccaauauccugcacaccucuaaccaggagaaucgcuuuaaagcuauucucagaaagaucaaagaagaguucgaaaagaccaaaggaagcaugguuugugagaucugcaaguacgaaugcgagacacugaaggagcuuaaagcccacaaccuguccugugugcaaggcgaaugcccuuauuguuuuacccauugcgagcccacagaaacggcgauucaggcccacuacaaggucugucaggcuacccaucgguuccgcgaggaucucaaaaagacagugaccccucagaauaucgggcccggcugcuauagaacacugaaccuguuccgguacaaaucuagauguuauauucuuaccauguggacgcuccugcugaucauugagagcauccucugggccgcuuccgccgcggaaaucccgcuggugccucuuuggaccgacaaugcccacggaguuggcagcguccccaugcauacagaccuggagcucgauuuuucucugccuuccagcucuaaguacaccuauaagcgccaccugacaaaccccgugaaugaccaacaguccgugagccuucacauugaaaucgagucucaggggauuggagcugauguccaucaccucggccauugguacgacgcccggcugaaccugaaaaccagcuuccacugcuacggggcuuguacgaaguaucaguacccuuggcacacagccaaaugccauuuugaaaaggauuaugaguacgagaacuccugggccuguaaucccccggacugcccuggagugggcaccgggugcacagcuuguggccucuaucuggaucaacuuaaacccguuggaaccgcguucaagaucauuagcgugagauacucucgcaaggucugcgugcaguuuggcgaagaguaucuguguaaaaccaucgacaugaacgauugcuucguuacacggcacgccaagaucuguauuaucgggacgguguccaaauuuagccagggagacacccuccuguuccugggccccauggaagggggaggcauuaucuuuaagcauuggugcacauccaccugucacuucggggauccuggcgacgucaugggaccgaaagacaagcccuuuauuugcccugaguuccccggccaguuucgcaaaaaguguaauuucgcuacaaccccugugugcgaauacgaugggaacaucauuucuggauacaagaaaguucuugccacgaucgacagcuuccaauccuuuaauacaucuaacauccauuucaccgaugagagaauugaguggcgggaccccgauggcaugcucagagaccacaucaauauugugaucagcaaggauauugacuuugaaaaccuggccgagaauccuuguaaagucgggcugcaggcugccaacaucgaaggagcguggggcuccggggugggcuucacccucacaugccaggugucucugaccgagugccccacauuucuuacgagcaucaaggcuugugauauggccauuugcuauggagccgaauccgucacccugagccgcggccaaaauacaguuaaaaucaccgggaagggaggccacucuggguccagcuucaaguguugccauggaaaagaguguucuuccacaggccuccaggcuagcgccccgcaccuggacaaggugaacggcauuucugagcuggaaaaugagaaaguguacgaugacggggcgccugaaugcggaaucaccuguugguuuaagaaauccggcgagugggucauggggauuaucaacggaaauugggugguucuuaucgugcucugcguccugcuucucuucagccugauucuucuguccauccucugucccgugcggaagcauaagaaaagcuga

SEQ ID NO: 13468 - RNA, 3402 nt, Artificial Sequence
  derived and/or modified CDS sequence (opt5) from SEOV(HeB38)__JN377554.1__GP
auguggagccugcuccugcuugccgcucuggugggccagggguucgcccucaagaacgucuuugacaugagaauccaaugcccccacuccguuaaauucggagagaccucugugagcggcuacacagaacugccuccgcuuucccugcaggaggcggaacagcucgugcccgagucuagcuguaauauggauaaccaucagucccugucuacgauuaauaagcugaccaaagucaucuggcaaaagaaagcuaaccaggaaagcgccaaucagaacuccuuugagguggccgagagcgaaguuucuuucaaggggcucugcaugcugaagcaccggaugguggaggaauccuaucgcaauagacggagcgucauuuguuacgaccuugcuugcaacucuacauuuuguaaaccuaccguguauaugaucguucccauucaugccugcaauaugaugaaguccugucugaucggacucggcccuuaccgcauccagguggucuaugagagaacauacugcaccacagggauucugaccgagggaaaauguuucgugcccgauaaggcuguggucagcgcccuuaaacggggcauguaugcgaucgccucuauugaaacgaucugcuuuuucauucaccaaaagggcaacaccuacaagaucguuacagcuauuaccuccgccauggggagcaaauguaauaacacagacaccaaggugcagggauacuauaucugcaucauuggcggaaauuccgcuccuguguacgccccgucuggggaggauuuucgcgcgauggaagucuucagcggcaucauuaugagcccccauggggaggaccacgaucugccuggagaagagaucgccacguaucagauuagcggccagaucgaggcuaaaaucccccacacagugucuuccaagaaccucaaacugaccgccuuugcuggcauuccuagcuacucuagcacauccauccuggccgccucugaagacgggagauucauuuuuagccccggacucuucccgaaucugaaccaauccguuugcgauaacaaugcccuuccucugaucuggcggggccucauugaccugaccggguauuacgaggcggugcaucccuguaacgucuucugcgugcuuagcggaccuggcgccucuugugaggcuuuuuccgaagggggaaucuucaauaucaccagccccaugugccugguuucuaagcagaaccgcuuuagagccgccgaacagcaaauuuccuucgugugucagcgggucgauauggacaucauuguguauugcaauggccagaaaaagacaauccucacgaagacccuggucauuggccaguguaucuacacaauuaccagccuguuuucccuccugcccgggguggcucacucuaucgccaucgagcuuugcguuccuggauuccauggcugggcgacagcugcccugcucauuaccuuuuguuucgggugggugcugaucccggccugcacgcuugcuauucugcucguccugaaauuuuucgccaacauccugcacacaagcaaucaagagaaccgcuuuaaggcuauucucagaaaaaucaaggaagaguucgagaaaaccaagggauccauggugugugaaaucugcaaguacgaaugcgagacccugaaagagcuuaaggcccacaaucugucuuguguucagggcgaaugccccuauuguuuuacacauugcgagccuaccgaaacagcgauucaggcccacuacaaagugugucaggcuacgcaucgguuccgcgaggaucucaagaaaaccgucacaccccaaaacaucgggccuggcugcuauagaacccugaaucuguuccgguacaagagcagauguuauauucuuacaauguggacccuccugcugaucauugaguccauccucugggccgcuagcgccgcggaaaucccccuggugccgcuuuggacggacaacgcccacggagugggcucuguuccuaugcauaccgaccuggagcucgauuuuucccugcccuccucuuccaaguacacauauaaacgccaccugaccaauccugucaacgaccagcagagcgugucucuucacauugaaaucgagagccaggggauuggagcugaugugcaucaccucggccauugguacgacgcccggcugaaucugaagacauccuuccacugcuacggggcuuguaccaaauaucaauaccccuggcacacggccaagugccauuuugaaaaagauuaugaguacgagaacagcugggccuguaacccucccgacugcccgggagucggcacagggugcaccgcuuguggccucuaucuggaucagcuuaagccugugggaacagcguucaagaucauuucuguuagauacucccgcaaagugugcguccaguuuggcgaagaguaucuguguaagaccaucgacaugaaugauugcuucgugacccggcacgccaaaaucuguauuaucgggacaguuagcaaguuuucccagggagacacgcuccuguuccugggccccauggaagggggaggcauuaucuuuaaacauuggugcaccucuacaugucacuucggggaucccggcgacgugaugggaccuaaggacaaaccguuuauuugccccgaguucccuggccaauuuagaaagaaguguaacuucgcuaccacacccgucugcgaauacgaugggaauaucauuagcggauacaaaaaggugcuugccaccaucgacuccuuccagucuuuuaacacgagcaauauccauuucacagaugagcgcauugaguggcgggacccugauggcaugcucagagaccacaucaacauuguuaucuccaaagauauugacuuugaaaaucuggccgagaaccccuguaagguggggcugcaggcugccaauaucgaaggagcguggggcucuggggucggcuucacccugaccugccaagugagccucacagagugcccuaccuuucuuacauccaucaaggcuugugauauggccauuugcuauggagccgaaagcgugacgcugcuccgcggccagaacaccgucaaaaucacagggaagggaggccacucuggguccagcuucaaauguugccauggaaaggaguguucuuccaccggccugcaggcuagcgcuccccaccuggacaaaguuaauggcauuucugagcuugaaaacgagaagguguacgaugacggggcgccggaaugcggaaucacauguugguuuaaaaaguccggcgagugggugauggggauuaucaauggaaacugggucgugcucaucguucugugcgugcugcuccuguucagccuuauucugcucuccauccuguguccuguccggaagcauaaaaagagcuga

SEQ ID NO: 13469 - RNA, 3402 nt, Artificial Sequence
  derived and/or modified CDS sequence (opt5) from SEOV(JiangxiXinjianRn-07-2011)__KP859513.1__GP
auguggagccugcuccugcuugccgcucuggugggccagugcuucgcccucaagaacgucuuugacaugagaauccaauguccccacuccguuaauuucggggagaccucugugagcggauacacagaacugccuccgcuuucccugcaggaggcggaacagcucgugcccgagucuagcugcaacauggauaaucaucagucccugucuacgauuaacaaacugaccaaggucaucuggcggaaaaaggcuaaucaagaaagcgccaaccaaaauuccuuugaggugguugagagcgaagugucuuucaaaggccucuguaugcugaagcaccgcauggucgaggaauccuauagaaaccggcgcagcgugauuugcuacgaccuugccuguaauucuacauuuugcaagccuaccguuuauaugaucgugcccauucaugcuuguaacaugaugaaauccugccugaucgggcucggaccuuacagaauccaggucguguaugagcggacauacuguaccacaggcauucugaccgaggggaagugcuucgugcccgauaaagccgucguuagcgcucuuaagcgcggaauguaugccaucgcgucuauugaaacgaucugcuuuuucauucaccagaaaggcaauaccuacaagaucgugacagccauuaccuccgcuaugggcagcaagugcaacaauacagacaccaaagugcagggguacuauaucugcaucauuggaggcaacuccgccccugucuacgcuccggccggggaggauuuuagagcgauggaaguguucucuggaaucauuacgagcccccauggcgaggaccacgaucugccuggggaagagaucgccacauaucagauuuccggacagaucgaggcuaagaucccccacaccguuagcucuaaaaaucucaagcugacagccuuugcuggcauuccuuccuacagcucuaccagcauccuggccgccuccgaagacggccgguucaucuuuucucccggacucuucccgaaccugaaccagagcgugugugauaauaacgcccuuccucugaucuggcgcgggcucauugaccugaccggcuauuacgaggcgguccaucccugcaauguguucuguguucuuuccgggccuggagccagcugcgaggcuuuuucugaaggcgggaucuucaacaucacaucccccaugugucuggugagcaaacaaaauagauuucgggccgccgaacagcagauuucuuucgucugccaacgcguggauauggacaucauugucuauuguaacggacagaagaaaacgauccucaccaagacacuggugauuggccagugcaucuacaccauuacaucccuguuuagccuccugcccggcguugcucacuccaucgccaucgagcuuugugugccuggguuccauggaugggcgaccgcugcccugcucauuacguuuugcuucggcuggguccugaucccggccuguacacuugcuauucugcucgugcugaaguuuuucgccaauauccugcacaccucuaaccaggagaauagauuuaaagcuauucuccggaagaucaaagaagaguucgaaaagaccaaagggagcaugguuugcgagaucugcaaguacgaaugugagacacugaaggagcuuaaagcccacaaccuguccugcgugcaaggagaaugucccuauugcuuuacccauugugagccuacagaaacggcgauucaggcccacuacaaggucugccaggcuacccaucgcuucagagaggaucucaaaaagacagugacaccccagaauaucggcccuggguguuaucggacccugaaccuguucagauacaaaucucgcugcuauauucuuaccauguggacgcuccugcugaucauugagagcauccucugggccgcuuccgccgcggaaaucccccuggugccgcuuuggaccgacaaugcccacggcguuggaagcgucccuaugcauacagaccuggagcucgauuuuucucugcccuccagcucuaaguacaccuauaagcggcaccugacaaacccugugaaugaccaacaguccgugagccuucacauugaaaucgagucucagggcauuggggcugauguccaucaccucggacauugguacgacgccagacugaaccugaaaaccagcuuccacuguuacggcgcuugcacgaaguaucaguaccccuggcacacagccaaaugucauuuugaaaaggauuaugaguacgagaacuccugggccugcaauccucccgacugcccgggggugggaaccggcuguacagcuugcgggcucuaucuggaucaacuuaaaccuguuggcaccgcguucaagaucauuagcgugcgcuacucucggaaggucugugugcaguuuggagaagaguauuucugcaaaaccaucgacaugaacgauuguuuuguuacaagacacgccaagaucugcauuaucggcacgguguccaaauucagccagggggacacccugcucuuucugggacccauggaaggcgggggaauuaucuucaagcauugguguacaucuaccugccacuuuggcgaucccggggacgucaugggcccuaaagacaagccguucauuugucccgaguuuccuggacaguuccgcaaaaagugcaauuucgcuacaacccccgugugugaauacgauggcaacaucauuuccggguacaagaaaguucuggccacgaucgacagcuuucaauccuucaauacaucuaacauccauuuuaccgaugagcggauugaguggagagacccugauggaaugcuucgcgaccacaucaauauugugaucagcaaggauauugacuucgaaaaccucgccgagaaucccugcaaagucggccugcaggcugccaacaucgaaggggcguggggauccggcgugggguuuacccugacaugccaggugucucucaccgaguguccuacauuccugacgagcaucaaggcuugcgauauggccauuuguuauggcgccgaauccgucacccuuagccggggacaaaauacaguuaaaaucaccggcaaagggggacacucuggcuccagcuuuaagugcugucaugggaaggaguguucuuccacaggacugcaggcuagcgcuccccaccucgacaaggugaacggcauuucugagcuggaaaaugagaaaguguacgaugacggcgcgccggaaugugggauuaccugcugguucaagaaauccggagagugggucaugggcauuaucaacgggaauugggugguucugaucgugcuuuguguccuccugcuguuuagccucauucugcuuuccauccugugcccugugagaaagcauaagaaaagcuga

SEQ ID NO: 13470 - RNA, 3402 nt, Artificial Sequence
  derived and/or modified CDS sequence (opt5) from SEOV(LYON/Rn/FRA/2013/LYO852)__KF387724.1__GP
auguggagccugcuccugcuugccgcucuggccggccagggguucgcgcucaagaacguguuugacaugagaauccaaugcccccacuccgucaauuucggagagaccucuguuagcggcuacacagaacugccuccgcuuucccugcaggaggcugaacagcucgugcccgagucuagcuguaacauggauaaucaucagucccugucuacgauuaacaaacugaccaaggugaucuggcggaaaaaggccaaucaagaaagcgccucccagaacagcuuugaggucguggagucugaaguuuccuucaaagggcucugcaugcugcgccacagaaugguggaggaaagcuauaagaaucggcgcucugucauuuguuacgaccuugcuugcaacuccacauuuuguaagccuaccguguauaugaucguucccauucaugccugcaauaugaugaaaagcugucugaucggacucggcccuuacagaauccagguggucuaugagcggacauacugcaccacagggauucugaccgagggaaaguguuucgugcccgauaaagcuguggucucugcccuuaagcgcggcauguaugcgaucgccuccauugaaacgaucugcuuuuucauucaccagaaaggcaacaccuacaagaucguuacagcuauuaccagcgccaugggguccaaguguaauaacacagacaccaaagugcaaggauacuauaucugcaucauuggcggaaauucugcuccuguguacgccccggcgggggaggauuuuagagccauggaagucuucagcggcaucauuacgagcccccauggggaggaccacgaucugccuggagaagagaucgcuacauaucagauuagcggccagaucgaggccaagaucccccacaccgugucuuccaaaaaccucaagcugacagcuuuugccggcauuccuagcuacucuagcaccuccauccuggccgcuucugaagacgggcgguucauuuuuagccccggacucuucccgaaucugaaccaguccguuugcgauaacaaugcgcuuccucugaucuggcgcggccucauugaccugaccggguauuacgaggccgugcaucccuguaacgucuucugcgugcuuagcggaccuggcgcuucuugugaagccuuuuccgaagggggaaucuucaauaucacaagccccaugugccugguuucuaaacaaaacagauuucgggccgcugagcagcagauuuccuucgugugucaacgcgucgauauggacaucauuguguauugcaauggccagaagaaaacgauccucaccaagacacuggucauuggccaguguaucuacaccauuacaagccuguuuucccuccugcccgggguggcccacucuaucgcgaucgagcuuugcguuccuggauuccauggcugggcuaccgccgcccugcucauuacguuuuguuucgggugggugcugaucccggcuugcacacuugccauucugcucguccugaaguuuuucgcuaacauccugcacaccagcaaucaggagaacagauuuaaagccauucuccggaagaucaaagaagaguucgaaaagaccaaaggauccauggugugugagaucugcaaguacgaaugcgagacacugaaggagcuuaaagcgcacaaucugucuuguguucaaggcgaaugccccuauuguuuuacccauugcgagccuacagaaacggccauucaggcucacuacaaggugugucaggccacccaucgcuucagagaggaucucaaaaagacagucacaccccagaacaucgggccuggcugcuaucggacccugaaucuguucagauacaaaagccgcuguuauauucuuaccauguggacgcuccugcugaucauugaguccauccucugggcugccagcgcggccgaaaucccccuggugccgcuuuggaccgacaacgcucacggagugggcucuguuccuaugcauacagaccuggagcucgauuuuucccugcccuccucuuccaaguacaccuauaagcggcaccugacaaauccugucaacgaccaacagagcgugucucuucacauugaaaucgagagccaggggauuggagccgaugugcaucaccucggccauugguacgacgcuagacugaaucugaaaaccuccuuccacugcuacggggccuguacgaaguaucaguaccccuggcacacagccaaaugccauuuugaaaaggauuaugaguacgagaacagcugggcuuguaacccucccgacugcccgggagucggcaccgggugcacagcguguggccucuaucuggaucaacuuaaaccugugggaaccgccuucaagaucauuucuguucgcuacucccggaaggugugcguccaguuuggcgaagaguaucuguguaaaaccaucgacaugaaugauugcuucgugacaagacacgcuaagaucuguauuaucgggacgguuagcaaauuuucccagggagacacccuccuguuccugggccccauggaagggggaggcauuaucuuuaagcauuggugcacaucuaccugucacuucggggaucccggcgacgugaugggaccuaaagacaagccguuuauuugccccgaguucccuggccaguuucgcaaaaaguguaacuucgccacaacccccgucugcgaauacgaugggaauaucauuagcggauacaagaaagugcuugccacgaucgacuccuuccaaucuuuuaacacaagcaauauccauuucaccgaugagcggauugaguggagagacccugauggcaugcuccgcgaccacaucaacauuaucauuuccaaggauaucgacuuugaaaaucuggcugagaaccccuguaaaguugggcugcaggccgcgaauaucgaaggagcuuggggcucuggggugggcuucacccucacaugccaggucagccugaccgagugcccuacauuucuuacguccauuaaggccugugauauggccaucugcuauggagcugaaagcgugacccugucucggggccaaaacacagugaaaauuaccgggaagggaggccacuccgggagcucuuucaaguguugccauggaaaagaguguucccucacaggccugcaggccagcgcgccccaccuggacaaggucaauggcaucucugagcuugaaaacgagaaaguuuacgaugacggggcuccggaaugcggaauuaccuguugguuuaagaaauccggcgagugggugauggggaucaucaauggaaacugggugguccucauugugcugugcguuuuccugcucuuuagccugauccuucuguccauucucuguccugugagaaagcauaagaaaagcuga

SEQ ID NO: 13471 - RNA, 3402 nt, Artificial Sequence
  derived and/or modified CDS sequence (opt5) from SEOV(Seoul-Baxter/NYC-D1_M)__KJ950863.1__GP
auguggagccugcuccugcuugccgcucuggugggccagggguucgcccucaagaacgucuuugacaugaaaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaagcugaccaaagucaucuggagaaagaaagcuaaucaagaaagcgccaaccaaaauuccuuugagguggccgagagcgaaguuucuuucaaggggcucugcaugcugaagcaccggaugguggaggaauccuaucgcaacagacggagcgucauuuguuacgaccuugcuugcaauucuacauuuuguaaaccuaccguguauaugaucguucccauucaugccugcaacaugaugaaguccugucugaucggacucggcccuuaccgcauccagguggucuaugagagaacauacugcaccacagggauucugaccgagggaaaauguuucgugcccgauaaggcuguggucagcgcccuuaaacggggcauguaugcgaucgccucuauugaaacgaucugcuuuuucauucaccagaagggcaauaccuacaagaucguuacagcuauuaccuccgccauggggagcaaauguaacgacacagauaccaaggugcagggauacuauaucugcaucauuggcggaaauuccgcuccuguguacgccccggcgggggaggacuuucgcgccauggaagucuucucuggcaucauuacgagcccccauggggaggaucacgaccugccuggagaagagaucgcuacauaucagauuuccggccagaucgaggccaaaaucccccacaccgugagcucuaagaaccucaaacugacagcuuuugccggcauuccuuccuacagcucuaccagcauccuggccgcuuccgaagaugggagauucaucuuuucucccggacucuucccgaaucugaaccagagcguuugcgacaacaaugcgcuuccucugguguggcggggccucauugaucugaccggguauuacgaggccguccaucccuguaacguguucugcguucuuuccggaccuggcgcuagcugugaagccuuuucugaagggggaauuuucaauaucacaucccccaugugccuggugagcaagcaaaaccgcuuuagagccgcugaacagcagaucucuuucgucugucaacggguggacauggauauuaucgucuauugcaauggccagaaaaagacgauucucaccaagacacuggugaucggccaguguauuuacaccaucacaucccuguuuagccuccugcccgggguugcccacuccauugcgaucgagcuuugcgugccuggauuccauggcugggcuaccgccgcccugcucaucacguuuuguuucggguggguccugauuccggcuugcacacuugccauccugcucgugcugaaauuuuucgcuaacauucugcacaccucuaaucaggagaaccgcuuuaaggccauccucagaaaaauuaaggaagaguucgagaaaaccaagggaagcaugguuugugagaucugcaaguacgaaugcgagacacugaaagagcuuaaggcgcacaaucuguccugugugcaaggcgaaugccccuauuguuuuacccauugcgagccuacagaaacggccauccaggcucacuacaaagucugucaggccacccaucgguuccgcgaggaccucaagaaaacagugacaccccagaacauugggccuggcugcuauagaacccugaaucuguuccgguacaagucuagauguuauauccuuaccauguggacgcuccugcugauuaucgagagcauucucugggcugccuccgcggccgaaaucccccuggugccgcuuuggaccgacaacgcucacggaguuggcagcgucccuaugcauacagaucuggagcucgacuuuucucugcccuccagcucuaaguacaccuauaaacgccaccugacaaauccugugaacgaucaacaguccgugagccuucacaucgaaauugagucucaggggaucggagccgacguccaucaccucggccauugguacgaugcucggcugaaucugaagaccagcuuccacugcuacggggccuguacgaaauaucaguaccccuggcacacagccaagugccauuuugaaaaagacuaugaguacgagaacuccugggcuuguaacccucccgauugcccgggagugggcaccgggugcacagcguguggccucuaucuggaccaacuuaagccuguuggaaccgccuucaagauuaucagcgugagauacucucgcaaagucugccugcaguuuggcgaagaguaucucuguaagaccauugauaugaaugacugcuucgugacacggcacguuaaaaucuguaucauugggacgguguccaaguuuagccagggagauacccugcuguuccuuggccccauggaagggggaggcaucauuuuuaaacauuggugcacauccaccugucacuucggggaccccggcgacgucaugggaccuaaggauaaaccguuuaucugccccgaguucccuggccaguuuagaaagaaguguaacuucgcuacaacccccgugugcgaauacgacgggaauauuaucucuggauacaaaaagguucucgccacgauugauagcuuccaauccuuuaacacaucuaauauccauuucaccgacgagcgcaucgaguggcgggauccugacggcaugcugagagaucacauuaacaucgugauuagcaaagacaucgauuuugaaaaucuggccgagaaccccuguaaggucgggcuccaggcugccaauauugaaggagcguggggcuccggggugggcuucacccugacaugccaggugucucuuaccgagugcccuacauuucugacgagcaucaaagccugugacauggccaucugcuauggagccgaauccgucacccucagccgcggccaaaacacaguuaagauuaccgggaagggaggccacucuggguccagcuucaaauguugccauggaaaggaguguucuuccacaggccugcaggcuagcgcuccccaccuggauaaagugaauggcaucucugagcuugaaaacgagaagguguacgacgauggggcgccggaaugcggaauuaccuguugguuuaaaaaguccggcgagugggucauggggaucauuaauggaaacugggugguucucaucgugcugugcguccugcuccuguucagccuuauccugcucuccauucuguguccugugcggaagcauaaaaagagcuga

SEQ ID NO: 13472 - RNA, 3402 nt, Artificial Sequence
  derived and/or modified CDS sequence (opt5) from SEOV(Singapore/06(RN41))__GQ274942.1__GP
auguggagccugcuccugcuugccgcucuggccggccagggguucgcgcucaagaacguguuugacaugagaauccaaugcccccacuccgucaauuucggagagaccucuguuagcggcuacacagaacugccuccgcuuucccugcaggaggcugaacagcucgugcccgagucuagcuguaacauggauaaucaucagucccugucuacgauuaacaaacugaccaaggugaucuggcggaaaaaggccaaucaagaaagcgccucccagaacagcuuugaggucguggagucugaaauuuccuucaaagggcucugcaugcugaagcaccgcaugguugaggaaagcuauagaaaucggcgcucugugaucuguuacgaccuugcuugcaacuccacauuuuguaagccuaccgucuauaugauugugcccauccaugccugcaauaugaugaaaagcugucugaucggacucggcccuuaccggauucagguuguguaugagagaacauacugcaccacagggauccugaccgagggaaaguguuucguccccgauaaagcuguggugucugcccuuaagcgcggcauguaugcgauugccuccaucgaaacgauuugcuuuuucauccaccagaaaggcaacaccuacaagauugucacagcuaucaccagcgccaugggguccaaguguaauaacacagacaccaaaguucaaggauacuauaucugcauuaucggcggaaauucugcuccuguguacgccccggcgggggaggauuuuagagccauggaaguguucagcggcauuaucacgagcccccauggggaggaccacgaucugccuggagaagagauugcuacauaucagaucagcggccagaucgaggccaagauuccccacaccgucucuuccaaaaaccucaagcugacagcuuuugccggcaucccuagcuacucuagcaccuccauucuggccgcuucugaagacgggcgguucaucuuuagccccggacucuucccgaaucugaaccaguccgugugcgauaacaaugcgcuuccucugauuuggcgcggccucaucgaccugaccggguauuacgaggccguucaucccuguaacguguucugcguccuuagcggaccuggcgcuucuugugaagccuuuuccgaagggggaaucuucaauauuacaagccccaugugccuggugucuaaacaaaacagauuucgggccgcugagcagcagaucuccuucguuugucaacgcguggauauggacauuaucgucuauugcaauggccagaagaaaacgauucucaccaagacacuggugaucggccaguguauuuacaccaucacaagccuguuuucccuccugcccggggucgcccacucuaucgcgauugagcuuugcgugccuggauuccauggcugggcuaccgccgcccugcucaucacguuuuguuucggguggguucugauuccggcuugcacacuugccauccugcucgugcugaaguuuuucgcuaacauucugcacaccagcaaucaggagaacagauuuaaagccauccuccggaagaucaaagaagaguucgaaaagaccaaaggauccauggucugugagauuugcaaguacgaaugcgagacacugaaggagcuuaaagcgcacaaucugucuugugugcaaggcgaaugccccuauuguuuuacccauugcgagccuacagaaacggccauccaggcucacuacaagguuugucaggccacccaucgcuucagagaggaucucaaaaagacagugacaccccagaacauugggccuggcugcuaucggacccugaaucuguucagauacaaaagccgcuguuauauccuuaccauguggacgcuccugcugauuaucgaguccauccucugggcugccagcgcggccgaaauuccccuggucccgcuuuggaccgacaacgcucacggagugggcucugugccuaugcauacagaccuggagcucgauuuuucccugcccuccucuuccaaguacaccuauaagcggcaccugacaaauccuguuaacgaccaacagagcgucucucuucacaucgaaauugagagccaggggaucggagccgaugugcaucaccucggccauugguacgacgcuagacugaaucugaaaaccuccuuccacugcuacggggccuguacgaaguaucaguaccccuggcacacagccaaaugccauuuugaaaaggauuaugaguacgagaacagcugggcuuguaacccucccgacugcccgggagugggcaccgggugcacagcguguggccucuaucuggaucaacuuaaaccugucggaaccgccuucaagauuaucucugugcgcuacucccggaagguuugcgugcaguuuggcgaagaguaucuguguaaaaccaucgacaugaaugauugcuucgucacaagacacgcuaagauuuguaucauugggacggugagcaaauuuucccagggagacacccuccuguuccugggccccauggaagggggaggcaucauuuuuaagcauuggugcacaucuaccugucacuucggggaucccggcgacguuaugggaccuaaagacaagccguuuaucugccccgaguucccuggccaguuucgcaaaaaguguaacuucgccacaacccccgugugcgaauacgaugggaauauuaucagcggauacaagaaaguccuugccacgaucgacuccuuccaaucuuuuaacacaagcaauauucauuucaccgaugagcggaucgaguggagagacccugauggcaugcuccgcgaccacauuaacaucgugauuuccaaggauaucgacuuugaaaaucuggcugagaaccccuguaaaguugggcugcaggccgcgaauaucgaaggagcuuggggcucuggggugggcuucacccucacaugccaggucagccugaccgagugcccuacauuucuuacguccauuaaggccugugauauggccaucugcuauggagcugaaagcgugacccugucucggggccaaaacacagugaaaauuaccgggaagggaggccacuccgggagcucuuucaaguguugccauggaaaagaguguuccagcacaggccuccaggccucugcgccccaccuggacaaggucaauggcaucuccgagcuggaaaacgagaaaguuuacgaugacggggcuccggaaugcggaauuaccuguugguuuaagaaaagcggcgagugggugauggggaucaucaauggaaacugggugguccuuauugugcucugcguucugcuccuguucucccugauccuucugagcauucucuguccugugagaaagcauaagaaaucuuga

SEQ ID NO: 13473 - RNA, 3402 nt, Artificial Sequence
  derived and/or modified CDS sequence (opt5) from SEOV(11CSG)__AB618131.1__GP
auguggagccugcuccugcuugccgcucuggccggccagggguucgcgcucaagaacguguuugacaugagaauccaaugcccccacuccgucaauuucggagagaccucuguuagcggcuacacagaacugccuccgcuuucccugcaggaggcugaacagcucgugcccgagucuagcuguaacauggauaaucaucagucccugucuacgauuaacaaacugaccaaggugaucuggcggaaaaaggccaaucaagaaagcgccucccagaacagcuuugaggucguggagucugaaguuuccuucaaagggcucugcaugcugaagcaccgcaugguggaggaaagcuauagaaaucggcgcucugucauuuguuacgaccuugcuugcaacuccacauuuuguaagccuaccguguauaugaucguucccauucaugccugcaauaugaugaaaagcugucugaucggacucggcccuuacagaauccagguggucuaugagcggacauacugcaccacagggauucugaccgagggaaaguguuucgugcccgauaaagcuguggucucugcccuuaagcgcggcauguaugcgaucgccuccauugaaacgaucugcuuuuucguucaccagaaaggcaacaccuacaagauugugacagcuaucaccagcgccaugggguccaaguguaauaacacagacaccaaagugcaaggauacuauauuugcaucaucggcggaaauucugcuccugucuacgccccggcgggggaggauuuuagagccauggaaguguucagcggcauuaucacgagcccccauggggaggaccacgaucugccuggagaagagauugcuacauaucagaucagcggccagauugaggccaaguuuccccacaccguuucuuccaaaaaccucaagcugacagcuuucgccggcaucccuagcuacucuagcaccuccauccuggccgcuucugaagacgggcgguuuauuuucagccccggacucuucccgaaucugaaccaguccgugugcgauaacaaugcgcuuccucugaucuggcgcggccucauugaccugaccggguauuacgaggccguccaucccuguaacguguuuugcguucuuagcggaccuggcgcuucuugugaagccuucuccgaagggggaaucuuuaauauuacaagccccaugugccuggugucuaaacaaaacagauuccgggccgcugagcagcagaucuccuuugucugucaacgcguggauauggacaucauugucuauugcaauggccagaagaaaacgauccucaccaagacacuggugauuggccaguguaucuacaccauuacaagccuguucucccuccugcccgggguugcccacucuaucgcgauugagcuuugcgugccuggauuucauggcugggcuaccgccgcccugcucaucacguucuguuuuggguggguccugaucccggcuugcacacuugccauucugcucgugcugaaguucuuugcuaacauccugcacaccagcaaucaggagaacagauucaaagccauucuccggaagaucaaagaagaguuugaaaagaccaaaggauccaugguuugugagauuugcaaguacgaaugcgagacacugaaggagcuuaaagcgcacaaucugucuugugugcaaggcgaaugccccuauuguuucacccauugcgagccuacagaaacggccauccaggcucacuacaaggucugucaggccacccaucgcuucagagaggaucucaaaaagacagugacaccccagaacaucgggccuggcugcuaucggacccugaaucuguuuagauacaaaagccgcuguuauauucuuaccauguggacgcuccugcugaucauugaguccauccucugggcugccagcgcggccgaaauuccccuggugccgcuuuggaccgacaacgcucacggaguuggcucugucccuaugcauacagaccuggagcucgauuucucccugcccuccucuuccaaguacaccuauaagcggcaccugacaaauccugugaacgaccaacagagcgugucucuucacaucgaaaucgagagccaggggauuggagccgauguccaucaccucggccauugguacgacgcuagacugaaucugaaaaccuccuuucacugcuacggggccuguacgaaguaucaguaccccuggcacacagccaaaugccauuucgaaaaggauuaugaguacgagaacagcugggcuuguaacccucccgacugcccgggagugggcaccgggugcacagcguguggccucuaucuggaucaacuuaaaccuguuggaaccgccuuuaagaucauuucugugcgcuacucccggaaggucugcgugcaguucggcgaagaguaucuguguaaaaccaucgacaugaaugauugcuuuguuacaagacacgcuaagauuuguaucaucgggacggugagcaaauucucccagggagacacccuccuguuucugggccccauggaagggggaggcauuaucuucaagcauuggugcacaucuaccugucacuuuggggaucccggcgacgucaugggaccuaaagacaagccguucauuugccccgaguuuccuggccaguuccgcaaaaaguguaacuucgccacaacccccgugugcgaauacgaugggaauacgaucagcggauacaagaaaguucuugccacaauugacuccuuucaaucuuucaacaccagcaauauccauuuuaccgaugagcggauugaguggagagacccugauggcaugcuccgcgaccacaucaacaucgugauuuccaaggauaucgacuucgaaaaucuggcugagaaccccuguaaagucgggcugcaggccgcgaauauugaaggagcuuggggcucuggggugggcuuuacacugaccugccaggugagccucacagagugcccuacguuccuuaccuccaucaaggccugugauauggccauuugcuauggagcugaaagcgucacacugucucggggccaaaacaccguuaaaaucacagggaagggaggccacuccgggagcucuuuuaaguguugccauggaaaagaguguuccagcaccggccuccaggccucugcgccccaccuggacaaggugaauggcaucuccgagcuggaaaacgagaaaguguacgaugacggggcuccggaaugcggaauuacguguugguucaagaaaagcggcgagugggucauggggaucauuaauggaaacuggaucgugcuuauuguucucugcgugcugcugcucuuuucccugauccuucugagcauccucuguccugucagaaagcauaagaaaucuuga

SEQ ID NO: 13474 - RNA, 3402 nt, Artificial Sequence
  derived and/or modified CDS sequence (opt5) from SEOV(5CSG)__AB618130.1__GP
auguggagccugcuccugcuugccgcucuggccggccagggguucgcgcucaagaacguguuugacaugagaauccaaugcccccacuccgucaauuucggagagaccucuguuagcggcuacacagaacugccuccgcuuucccugcaggaggcugaacagcucgugcccgagucuagcuguaacauggauaaucaucagucccugucuacgauuaacaaacugaccaaggugaucuggcggaaaaaggccaaucaagaaagcgccucccagaacagcuuugaggucguggagucugaaguuuccuucaaagggcucugcaugcugaagcaccgcaugguggaggaaagcuauagaaaucggcgcucugucauuuguuacgaccuugcuugcaacuccacauuuuguaagccuaccguguauaugaucguucccauucaugccugcaauaugaugaaaagcugucugaucggacucggcccuuacagaauccagguggucuaugagcggacauacugcaccacagggauucugaccgagggaaaguguuucgugcccgauaaagcuguggucucugcccuuaagcgcggcauguaugcgaucgccuccauugaaacgaucugcuuuuucauucaccagaaaggcaacaccuacaagaucguuacagcuauuaccagcgccaugggguccaaguguaauaacacagacaccaaagugcaaggauacuauaucugcaucauuggcggaaauucugcuccuguguacgccccggcgggggaggauuuuagagccauggaagucuucagcggcaucauuacgagcccccauggggaggaccacgaucugccuggagaagagaucgcuacauaucagauuagcggccagaucgaggccaagaucccccacaccgugucuuccaaaaaccucaagcugacagcuuuugccggcauuccuagcuacucuagcaccuccauccuggccgcuucugaagacgggcgguucauuuuuagccccggacucuucccgaaucugaaccaguccguuugcgauaacaaugcgcuuccucugaucuggcgcggccucauugaccugaccggguauuacgaggccauccaucccuguaacguguucugcguccuuagcggaccuggcgcuucuugugaagccuuuuccgaagggggaaucuucaauauuacaagccccaugugccuggugucuaaacaaaacagauuucgggccgcugagcagcagaucuccuucguuugucaacgcguggauauggacauuaucgucuauugcaauggccagaagaaaacgauucucaccaagacacuggugaucggccaguguauuuacaccaucacaagccuguuuucccuccugcccggggucgcccacucuaucgcgauugagcuuugcgugccuggauuccauggcugggcuaccgccgcccugcucaucacguuuuguuucggguggguucugauuccggcuugcacacuugccauccugcucgugcugaaguuuuucgcuaacauucugcacaccagcaaucaggagaacagauuuaaagccauccuccggaagaucaaagaagaguucgaaaagaccaaaggauccauggucugugagauuugcaaguacgaaugcgagacacugaaggagcuuaaagcgcacaaucugucuugugugcaaggcgaaugccccuauuguuuuacccauugcgagccuacagaaacggccauccaggcucacuacaagguuugucaggccacccaucgcuucagagaggaucucaaaaagacagugacaccccagaacauugggccuggcugcuaucggacccugaaucuguucagauacaaaagccgcuguuauauccuuaccauguggacgcuccugcugauuaucgaguccauccucugggcugccagcgcggccgaaauuccccuggucccgcuuuggaccgacaacgcucacggagugggcucugugccuaugcauacagaccuggagcucgauuuuucccugcccuccucuuccaaguacaccuauaagcggcaccugacaaauccuguuaacgaccaacagagcgucucugugcacaucgaaauugagagccaggggaucggagccgaugugcaucaccuuggccauugguacgacgcuagacucaaucugaaaaccuccuuccacugcuacggggccuguacgaaguaucaguaccccuggcacacagccaaaugccauuuugaaaaggauuaugaguacgagaacagcugggcuuguaacccucccgacugcccgggagucggcaccgggugcacagcguguggccuguaucucgaucaacugaaaccugugggaaccgccuucaagauuaucucuguucgcuacucccggaaggugugcguccaguuuggcgaagaguaucuuuguaaaaccaucgacaugaaugauugcuucgugacaagacacgcuaagauuuguaucauugggacgguuagcaaauuuucccagggagacacccuccuguuccugggccccauggaagggggaggcaucauuuuuaagcauuggugcacaucuaccugucacuucggggaucccggcgacgugaugggaccuaaagacaagccguuuaucugccccgaguucccuggccaguuucgcaaaaaguguaacuucgccacaacccccgucugcgaauacgaugggaauacgauuagcggauacaagaaagugcuggccacaaucgacuccuuccaaucuuuuaacaccagcaauauccauuucaccgaugagcggauugaguggagagacccugauggcaugcuucgcgaccacaucaacauuguuaucuccaaggauauugacuuugaaaaucucgcugagaaccccuguaaaguggggcugcaggccgcgaauaucgaaggagcuuggggcucuggggucggcuucacacugaccugccaggugagccucacagagugcccuacguuucugaccuccaucaaggccugugauauggccauuugcuauggagcugaaagcgugacacuuucucggggccaaaacaccgucaaaaucacagggaagggaggccacuccgggagcucuuucaaguguugccauggaaaagaguguuccagcaccggccugcaggccucugcgccccaccucgacaagguuaauggcauuuccgagcuggaaaacgagaaaguguacgaugacggggcuccggaaugcggaaucacguguugguuuaagaaaagcggcgagugggugauggggauuaucaauggaaacugggucgugcugaucguucuuugcgugcuccugcuguucucccucauucugcuuagcauccuguguccugucagaaagcauaagaaaucuuga

SEQ ID NO: 13475 - RNA, 3402 nt, Artificial Sequence
  derived and/or modified CDS sequence (opt5) from SEOV(80-39)__S47716.1__GP
auguggagccugcuccugcuugccgcucuggugggccagggguucgcccucaagaacgucuuugacaugagaauccaaugcccccacuccguuaaauucggagagaccucugugagcggcuacacagaacugccuccgcuuucccugcaggaggcggaacagcucgugcccgagucuagcuguaauauggauaaccaucagucccugucuacgauuaauaagcugaccaaagucaucuggcggaagaaagcuaaccaagaaagcgccaaucagaacuccuuugagcucauggagagcgaagugucuuucaaggggcugugcaugcuuaagcaccgcaugguugaggaauccuauagaaaucggcgcagcgugauuuguuacgaccuggccugcaacucuacauuuuguaaaccuaccgucuauaugaucgugcccauucaugcuugcaauaugaugaaguccugucucaucggacugggcccuuacagaguucagguggucuaugagcggacauacugcaccacagggauccuuaccgagggaaaauguuucgugcccgauaaggccguggucagcgcucugaaacgcggcauguaugccauugcgucuaucgaaacgauuugcuuuuucauccaccagaagggcaacaccuacaagauuguuacagccaucaccuccgcuauggggagcaaauguaauaacacagacaccaaggugcaaggauacuauauuugcaucaucggcggaaauuccgccccuguguacgcuccggccggggaggauuuuagagcgauggaagucuucucuggcauuaucacgagcccccauggggaggaccacgaucucccuggagaagagauugccacauaucagaucuccggccagauugaggcuaaaaucccccacaccgugagcucuaagaaccugaaacugacagccuuugcuggcaucccuuccuacagcucuaccagcauucucaccgccuccgaagacgggcgguucaucuuuucucccggacuguucccgaaucuuaaccagagcguuugcgauaacaaugcccugccucucauuuggcgcggccugaucgaccuuacaggguauuacgaggcugugcaucccuguaacgucuucugcgugcuguccggaccuggcgcgagcugugaagccuuuucugaagggggaauuuucaauaucacgucccccaugugccucguuagcaagcaaaacagauuucgggcugccgaacagcagaucucuuucgugugucaacgcgucgauauggacauuaucguguauugcaauggccagaaaaagaccauucugacaaagacccuggucaucggccaguguauuuacacaaucaccucccucuuuagccugcuucccgggguggcccacuccauugcuaucgagcugugcguuccuggauuccauggcugggccacggcggcucuccugaucacauuuuguuucgggugggugcuuauuccggccugcacccuggccauccuccugguccugaaauuuuucgcuaacauucuccacaccucuaaucaggagaacagauuuaaggccauccugcggaaaauuaaggaagaguucgagaaaacaaagggaagcauggugugugagaucugcaaguacgaaugcgagacccuuaaagagcugaaggcucacaaucucuccuguguucaaggcgaaugccccuauuguuuuacacauugcgagccuacggaaaccgccauccaggcgcacuacaaagugugucaggccacacaucgcuucagagaggaucugaagaaaaccgucacaccccagaacauugggccuggcugcuaucggacccugaaucuuuucagauacaagucucgcuguuauauccucacgauguggacccugcugcucauuaucgagagcauucugugggcugccuccgcugccgaaaucccccuugugccgcuguggacagacaacgcgcacggagugggcagcguuccuaugcauaccgaccucgagcuggauuuuucucugcccuccagcucucgguacacauauaagagacaccuuaccaauccugucaacgaccaacaguccgugagccuccacaucgaaauugagucucaggggaucggagccgaugugcaucaccugggccauugguacgacgcucgccugaaucucaaaacgagcuuccacugcuacggggccuguacaaaguaucaguaccccuggcacaccgcuaaaugccauuuugaaaaggauuaugaguacgagaacuccugggccuguaacccucccgacugcccgggagucggcacagggugcaccgccuguggccuguaucuugaucaacugaaaccugugggaaccgcuuucaagauuaucagcguucgguacucuagaaaggugugcguccaguuuggcgaagaguaucucuguaaaacaauugacaugaaugauugcuucgugacgcgccacgcgaagaucuguaucauugggaccguuuccaaauuuagccagggagacacacugcuguuccuuggccccauggaagggggaggcaucauuuuuaagcauuggugcaccuccacaugucacuucggggaucccggcgacgugaugggaccuaaagacaagccguuuaucugccccgaguucccuggccaguuucggaaaaaguguaacuucgccaccacgcccgucugcgaauacgaugggaauauuaucucuggauacaagaaagugcucgcuacaauugacagcuuccaauccuuuaacaccucuaauauccauuucaccgaugagagaaucgaguggcgcgacccugauggcaugcugcgggaccacauuaacaucguuauuagcaaggauaucgacuuugaaaaucuggccgagaaccccuguaaaguggggcuccaggccgcuaauauugaaggagccuggggcuccggggucggcuucacacugaccugccaggugucucuuacagagugcccuacguuucugaccagcaucagagcgugugauauggcuaucugcuauggagccgaauccgugacacucagccgcggccaaaacaccgucaagauuacagggaaaggaggccacucuggguccagcuucaaguguugccauggaaaggaguguucucugaccggccugcaggccuccgcuccccaccuugacaaaguuaauggcaucagcgagcucgaaaacgagaagguguacgaugacggggccccggaaugcggaauuacguguugguuuaaaaagucuggcgagugggugauggggaucauuaauggaaacugggucgugcugaucguucugugcgugcuccugcuuuucucccugauccuccugagcauucuguguccuguccggaaacauaagaaguccuga

SEQ ID NO: 13476 - RNA, 3402 nt, Artificial Sequence
  derived and/or modified CDS sequence (opt5) from SEOV(93HBQ3)__KM115585.1__GP
auguggagccugcuccugcuugccgcucuggugggccagggguucgcccucaagaacgucuuugacaugagaauccaaugcccccacuccguuaaauucggagagaccucugugagcggcuacacagaacugccuccgcuuucccugcaggaggcggaacagcucgugcccgagucuagcuguaauauggauaaccaucagucccugucuacgauuaauaagcugaccaaagucaucuggcaaaagaaagcuaaccaggaaagcgccaaucagaacuccuuugagguggccgagagcgaaguuucuuucaaggggcucugcaugcugaagcaccggaugguggaggaauccuaucgcaauagacggagcgucauuuguuacgaccuugcuugcaacucuacauuuuguaaaccuaccguguauaugaucguucccauucaugccugcaauaugaugaaguccugucugaucggacucggcccuuaccgcauccagguggucuaugagagaacauacugcaccacagggauucugaccgagggaaaauguuucgugcccgauaaggcuguggucagcgcccuuaaacggggcauguaugcgaucgccucuauugaaacgaucugcuuuuucauucaccaaaagggcaacaccuacaagaucguuacagcuauuaccuccgccauggggagcaaauguaauaacacagacaccaaggugcagggauacuauaucugcaucauuggcggaaauuccgcuccuguguacgccccgucuggggaggauuuucgcgcgauggaagucuucagcggcaucauuaugagcccccauggggaggaccacgaucugccuggagaagagaucgccacguaucagauuagcggccagaucgaggcuaaaaucccccacacagugucuuccaagaaccucaaacugaccgccuuugcuggcauuccuagcuacucuagcacauccauccuggccgccucugaagacgggagauucauuuuuagccccggacucuucccgaaucugaaccaauccguuugcgauaacaaugcccuuccucugaucuggcggggccucauugaccugaccggguauuacgaggcggugcaucccuguaacgucuucugcgugcuuagcggaccuggcgccucuugugaggcuuuuuccgaagggggaaucuucaauaucaccagccccaugugccugguuucuaagcagaaccgcuuuagagccgccgaacagcaaauuuccuucgugugucagcgggucgauauggacaucauuguguauugcaauggccagaaaaagacaauccucacgaagacccuggucauuggccaguguaucuacacaauuaccagccuguuuucccuccugcccgggguggcucacucuaucgccaucgagcuuugcguuccuggauuccauggcugggcgacagcugcccugcucauuaccuuuuguuucgggugggugcugaucccggccugcacgcuugcuauucugcucguccugaaauuuuucgccaacauccugcacacaagcaaucaagagaaccgcuuuaaggcuauucucagaaaaaucaaggaagaguucgagaaaaccaagggauccauggugugugaaaucugcaaguacgaaugcgagacccugaaagagcuuaaggcccacaaucugucuuguguucagggcgaaugccccuauuguuuuacacauugcgagccuaccgaaacagcgauucaggcccacuacaaagugugucaggcuacgcaucgguuccgcgaggaucucaagaaaaccgucacaccccaaaacaucgggccuggcugcuauagaacccugaaucuguuccgguacaagagcagauguuauauucuuacaauguggacccuccugcugaucauugaguccauccucugggccgcuagcgccgcggaaaucccccuggugccgcuuuggacggacaacgcccacggagugggcucuguuccuaugcauaccgaccuggagcucgauuuuucccugcccuccucuuccaaguacacauauaaacgccaccugaccaauccugucaacgaccagcagagcgugucucuucacauugaaaucgagagccaggggauuggagcugaugugcaucaccucggccauugguacgacgcccggcugaaucugaagacauccuuccacugcuacggggcuuguaccaaauaucaauaccccuggcacacggccaagugccauuuugaaaaagauuaugaguacgagaacagcugggccuguaacccucccgacugcccgggagucggcacagggugcaccgcuuguggccucuaucuggaucagcuuaagccugugggaacagcgcugaagaucauuucuguuagauacucccgcaaagugugcguccaguucggcgaagaguaucucuguaagaccaucgacaugaaugauugcuuugugacccggcacgccaaaaucuguauuaucgggacaguuagcaaguucucccagggagacacgcugcuguuucuuggccccauggaagggggaggcauuaucuucaaacauuggugcaccucuacaugucacuuuggggaucccggcgacgugaugggaccuaaggacaaaccguucauuugccccgaguuuccuggccaauucagaaagaaguguaacuuugcuaccacacccgucugcgaauacgaugggaauaucauuagcggauacaaaaaggugcucgccaccaucgacuccuuccagucuuucaacacgagcaauauccauuuuacagaugagcgcauugaguggcgggacccugauggcaugcugagagaccacaucaacauuguuaucuccaaagauauugacuucgaaaaucuggccgagaaccccuguaagguggggcuccaggcugccaauaucgaaggagcguggggcucuggggucggcuuuacccugaccugccaagugagccuuacagagugcccuaccuuccugacauccaucaaggcuugugauauggccauuugcuauggagccgaaagcgugacgcuccugcgcggccagaacaccgucaaaaucacagggaagggaggccacucuggguccagcuuuaaauguugccauggaaaggaguguucuuccaccggccugcaggcuagcgcuccccaccuugacaaaguuaauggcauuucugagcucgaaaacgagaagguguacgaugacggggcgccggaaugcggaaucacauguugguucaaaaaguccggcgagugggugauggggauuaucaauggaaacugggucgugcugaucguucugugcgugcuccugcuuuuuagccugauucuccuguccauccuguguccuguccggaagcauaaaaagagcuga

SEQ ID NO: 13477 - RNA, 3402 nt, Artificial Sequence
  derived and/or modified CDS sequence (opt5) from SEOV(93HBQ4)__KM115586.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaagcugaccaaggucaucuggcggaaaaaggcuaaucaagaaagcgccaaccaaaauuccuuugagguggccgagagcgaaguuucuuucaaagggcucugcaugcugaagcaccgcaugguggaggaauccuauagaaaccggcgcagcgucauuuguuacgaccuugcuugcaauucuacauuuuguaagccuaccguguauaugaucguucccauucaugccugcaacaugaugaaauccugucugaucggacucggcccuuacagaauccagguggucuaugagcggacauacugcaccacagggauucugaccgagggaaaguguuucgugcccgauaaagcuguggucagcgcccuuaagcgcggcauguaugcgaucgccucuauugaaacgaucugcuuuuucauucaccagaaaggcaauaccuacaagaucguuacagcuauuaccuccgccauggggagcaaguguaacaauacagacaccaaagugcaaggauacuauaucugcaucauuggcgggaacuccgcuccuguguacgccccgucuggagaggauuuuagagcgauggaagucuucagcggcaucauuaugagcccccauggggaggaccacgaucugccuggagaagagaucgccacguaucagauuagcggccagaucgaggcuaagaucccccacacagugucuuccaaaaaucucaagcugaccgccuuugcuggcauuccuagcuacucuagcacauccauccuggccgccucuggggacagccgguucaucuuuucccccggacucuucccgaaccugaaccagagcguuugcgauaauaacgcccuuccucugauuuggcgcggccucauugaccugaccggguauuacgaagcggugcaucccuguaaugucuucugcgugcuuucuggaccuggcgccuccugugaggcuuuuagcgaagggggaaucuucaacaucaccucucccaugugccugguuuccaaacaaaauagauuucgggccgccgagcagcagauuagcuucgugugucaacgcgucgauauggacaucauuguguauugcaacggccagaagaaaacaauccucacgaagacccuggucauuggccaguguaucuacacaauuaccucccuguuuucucuccugcccgggguggcucacagcaucgccaucgaacuuugcguuccuggauuccauggcugggcgacagcugcccugcucauuaccuuuuguuucgggugggugcugaucccggccugcacgcuugcuauucugcucguccugaaguuuuucgccaauauccugcacacauccaaccaggagaauagauuuaaagcuauucuccggaagaucaaagaggaguucgagaagaccaaaggaucuauggugugugaaaucugcaaguacgagugcgaaacccugaaggagcuuaaagcccacaaccugagcuguguucaaggcgagugccccuauuguuuuacacauugcgaaccuaccgagacagcgauucaggcccacuacaaggugugucaggcuacgcaucgcuucagagaagaucucaaaaagaccgucacaccccagaauaucgggccuggcugcuaucggacccugaaccuguucagauacaaaucccgcuguuauauucuuacaauguggacccuccugcugaucauugagagcauccucugggccgcuucugccgcggagaucccccuggugccgcuuuggacggacaaugcccacggagugggcuccguuccuaugcauaccgaccuggaacucgauuuuagccugcccucuuccagcaaguacacauauaagcggcaccugaccaacccugucaaugaccaacagucugugagccuucacauugagaucgaaucccaggggauuggagcugaugugcaucaccucggccauugguacgacgccagacugaaccugaaaacauccuuccacugcuacggggcuuguaccaaguaucaguaccccuggcacacggccaaaugccauuuugagaaggauuaugaauacgagaacucuugggccuguaauccucccgacugcccgggagucggcacagggugcaccgcuuguggccucuaucuggaucaacuuaaaccugugggaacagcguucaagaucauuuccguucgcuacagccggaaggugugcguccaguuuggcgaggaauaucuguguaaaaccaucgacaugaacgauugcuucgugaccagacacgccaagaucuguauuaucgggacaguuuccaaauuuucucagggagacacgcuccuguuccugggccccauggaagggggaggcauuaucuuuaagcauuggugcaccagcacaugucacuucggggaucccggcgacgugaugggaccuaaagacaagccguuuauuugccccgaguucccuggccaguuucgcaaaaaguguaauuucgcuaccacacccgucugcgaauacgaugggaacaucauuuccggauacaagaaagugcuugccaccaucgacucuuuccagagcuuuaauacguccaacauccauuucacagaugaaaccauugaguggcgggacccugauggcaugcucagagaccacaucaauauuguuaucucuaaggauauugacuuugagaaccuggccgaaaaucccuguaaaguggggcugcaggcugccaacaucgagggagcguggggcagcggggucggcuucacccucacaugccaggugucccugaccgaaugcccuacauuucuuacgagcaucaaggcuugugauauggccauuugcuauggagccgagucugugacccugucccgcggccaaaauacagucaaaaucaccgggaagggaggccacagcgggucuuccuucaaguguugccauggaaaagaauguagcucuacaggccuccaggcuuccgcuccccaccuggacaagguuaacggcauuagcgagcuggagaaugaacggguguacgaugacggggcgccggagugcggaaucaccuguugguuuaaaaaguccggcgaaugggugauggggauuaucaacggaaauugggucgugcuuaucguucucugcgugcugcuccuguucagccugauucuucugucuauccucuguccugucagaaaacauaaaaagagcuga

SEQ ID NO: 13478 - RNA, 3402 nt, Artificial Sequence
  derived and/or modified CDS sequence (opt5) from SEOV(B1)__AB457790.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucuccggcugacagccuuugcuggcauuccuuccuacagcucuaccagcauccuggccgccuccgaagacgggcgcuucaucuuuucucccggacucuucccgaaccugaaccagagcgugugcgauaauaacgcccuuccucugauuuggagaggccucauugaccugaccggguauuacgaggcgguccaucccuguaauguguucugcguucuuuccggaccuggcgccagcugugaggcuuuuucugaagggggaaucuucaacaucacaucccccaugugccuggugagcaagcaaaaucgguuucgcgccgccgaacagcagauuucuuucgucugucaaagaguggauauggacaucauugucuauugcaacggccagaaaaagacgauccucaccaaaacacuggugauuggccaguguaucuacaccauuacaucccuguuuagccuccugcccgggguugcucacuccaucgccaucgagcuuugcgugccuggauuccauggcugggcgaccgcugcccugcucauuacguuuuguuucggguggauccugauuccggccuggacacuugcuauccugcucguccugaaguuuuucgccaauauucugcacaccucuaaccaggagaaucgguuuaaggcuauccuccgcaaaaucaaggaagaguucgagaaaaccaagggaagcauggugugcgaaauuuguaaauacgaaugcgagacacugaaggagcuuaaggcccacaaccuguccugcguucaaggcgaaugucccuauugcuuuacccauugugagccuacagaaacggcgauccaggcccacuacaaaauuugccaggcuacccauagauuccgggaggaucucaagaaaacagugacaccccagaauaucgggccuggcuguuauagaacccugaaccuguuccgcuacaagucucggugcuauauucuuaccauguggacgcuccugcugaucaucgagagcauucucugggccgcuuccgccgcggaaaucccccuggucccgcuuuggaccgacaaugcccacggagugggcagcgugccuaugcauacagaccuggagcucgauuuuucucugcccuccagcucuaaauacaccuauaagagacaccugacaaacccuguuaaugaccaacaguccgucagccuucacauugaaaucgagucucaggggauuggagcugaugugcaucaccucggccauugguacgacgcccgccugaaccugaagaccagcuuccacuguuacggggcuugcacgaaauaucaguaccccuggcacacagccaagugucauuuugaaaaagauuaugaguacgagaacuccugggccugcaauccucccgacuguccgggagugggcaccgggugcacagcuugcggccucuaucuggaucaacuuaagccugucggaaccgcguucaaaaucaucagcgugcgguacucuagaaagguuugugugcaguuuggcgaagaguaucugugcaagaccauugacaugaacgauuguuucgucacacgccacgccaaaaucugcauuaucgggacgguguccaaguuuagccagggagacacccuccuguuccugggccccauggaagggggaggcauuaucuuuaaacauugguguacaucuaccugccacuucggggaucccggcgacguuaugggaccuaaggacaaaccguuuauuugucccgaguucccuggccaguuucggaagaaaugcaauuucgcuacaacccccgugugugaauacgaugggaacaucaucuccggauacaagaagguccuugccacgauugacagcuuccaauccuuuaauacaucuaacauccauuucaccgaugagagaauugaguggcgcgacccugauggcaugcuccgggaccacaucaauauugugaucagcaaagauaucgacuuugaaaaccuggccgagaaucccugcaagguugggcugcaggcugccaacauugaaggagcguggggcuccggggugggcuucacccucacaugucaggucucucugaccgagugcccuacauuucuuacgagcaucaaggcuugcgauauggccauuuguuauggagccgaauccgugaaacugagcagaggccaaaauaccgugaaaaucacagggaagggaggccacucuggguccagcuucaagugcugucauggaaaagaguguucuuccaccggccuccaggcuagcgcuccccaccuggacaaggucaacggcauuucugagcuggaaaaugagaaaguuuacgaugacggggcgccggaaugcggagugacaugcugguuuaagaaauccggcgagugggugauggggaucaucaacggaaauugggucgugcuuauuguucucugucugcugcuccuguucagccuuauccugcucuccauucugugcccugugcgcaagcauaagaaaagcuga

SEQ ID NO: 13479 - RNA, 3402 nt, Artificial Sequence
  derived and/or modified CDS sequence (opt5) from SEOV(B1)__AB457791.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcagaaaaaggcuaaucaggaaagcgccaaccaaaauuccuuugaggugguugagagcgaagugucuuucaaagggcucugcaugcugaagcaccggauggucgaggaauccuaucgcaacagacggagcgugauuuguuacgaccuugccugcaauucuacauuuuguaagccuaccguuuauaugaucgugcccauucaugcuugcaacaugaugaaauccugucugaucggacucggcccuuaccgcauccaggucgccuaugagagaacauacugcaccacagggauucugaccgagggaaaguguuucgugcccgauaaagcuguggucagcgcccuuaagcggggcauguaugcgaucgccucuauugaaacgaucugcuuuuucauucaccaaaaaggcaauaccuacaagaucguuacagcuauuaccuccgccauggggagcaaguguaacaauacagacaccaaagugcagggauacuauaucugcaucauuggcgggaacuccgcuccuguguacgccccggcgggagaggauuuucgcgccauggaagucuucucuggcaucauuacgagcccccauggggaggaccacgaucugccuggagaagagaucgcuacauaucagauuuccggccagaucgaggccaagaucccccacaccgugagcucuaaaaaucucagacugacagcuuuugccggcauuccuuccuacagcucuaccagcauccuggccgcuuccaaggacgggcgguucauuuucucucccggacucuucccgaaccugaaccaaagcguuugcgauaauaacgcgcuuccucugaucuggcgcggccucauugaccugaccggguauuacgaagccgugcaucccuguaaugucuucugcgugcuuuccggaccuggcgcuagcugugaggccuuuucugaagggggaaucuucaacaucacaucccccaugugccugguuagcaaacagaauagauuucgggccgcugagcagcaaauuucuuucgugugucagcgcgucgauauggacaucauuguguauugcaacggccagaagaaaacgauccucaccaagacacuggucauuggccaguguaucuacaccauuacaucccuguuuagccuccugcccgggguggcccacuccaucgcgaucgaacuuugcguuccuggauuccauggcugggcuaccgccgcccugcucauuacguuuuguuucggguggauccugauuccggcuugcacacuugccauccugcucgugcugaaguuuuucgcuaauauucugcacaccucuaaccaagagaauagauuuaaagccauccuccggaagaucaaagaggaauuugagaagaccaaaggaagcauggucugugaaauuugcaaguacgagugcgaaacacugaaggagcuuaaagcgcacaaccuguccugugugcagggcgagugccccuauuguuuuacccauugcgaaccuacagagacggccauccaggcucacuacaagauuugucaggccacccaucgcuucagagaagaucucaaaaagacaguuacaccccaaaauaucgggccuggcugcuaucggacccugaaccuguucagauacaaaucucgcuguuauauucuuaccauguggacgcuccugcugaucaucgagagcauucucugggcugccuccgcggccgagaucccccuggugccgcuuuggaccgacaaugcucacggagucggcagcgugccuaugcauacagaccuggaacucgauuuuucucugcccuccagcucuaaguacaccuauaagcggcaccugacaaacccugugaaugaccagcaguccguuagccuucacauugagaucgaaucucaggggauuggagccgauguccaucaccucggccauugguacgacgcuagacugaaccugaaaaccagcuuccacugcuacggggccuguacgaaguaucaauaccccuggcacacagccaaaugccauuuugagaaggauuaugaauacgagaacuccugggcuuguaauccucccgacugcccgggagugggcaccgggugcacagcguguggccucuaucuggaucagcuuaaaccugugggaaccgccuucaagaucaucagcguccgcuacucucggaaggugugcguucaguuuggcgaggaauaucuguguaaaaccauugacaugaacgauugcuucgugacaagacacgcuaagaucuguauuaucgggacggucuccaaauuuagccagggagacacccuccuguuccugggccccauggaagggggaggcauuaucuuuaagcauuggugcacauccaccugucacuucggggaucccggcgacgugaugggaccuaaagacaagccguuuauuugccccgaguucccuggccaauuucgcaaaaaguguaauuucgccacaacccccguuugcgaguacgaugggaacaucaucucuggauacaagaaagugcuugccacgauugacagcuuccaguccuuuaauacaucuaacauccauuucaccgaugaacggauugaguggagagacccugauggcaugcuccgcgaccacaucaauauugucaucagcaaggauaucgacuuugagaaccuggcugaaaaucccuguaaaguggggcugcaggccgcgaacauugagggagcuuggggcuccgggguuggcuucacccucacaugccaagugucucugaccgaaugcccuacauuucuuacgagcaucaaggccugugauauggccauuugcuauggagcugaguccgucacccugagccggggccagaauacagugaaaaucaccgggaagggaggccacucuggguccagcuucaaguguugccauggaaaagaauguucuuccacaggccuccaggccagcgcgccccaccuggacaaggugaacggcauuucugagcuggagaaugaaaaagucuacgaugacggggcuccggagugcggaguuaccuguugguuuaagaaauccggcgaaugggugauggggaucaucaacggaaauugggugguccuuauugugcucugccugcugcuccuguucagccuuauccugcucuccauucuguguccuaucagaaagcauaagaaaagcuga

SEQ ID NO: 13480 - RNA, 3402 nt, Artificial Sequence
  derived and/or modified CDS sequence (opt5) from SEOV(B1)__AB457792.1__GP
auguggagccugcuccugauggccgcucuugugggccagggguucgcccugaagaacgucuuugacaugagaauccaaugcccccacuccguuaauuucggagagaccucugugagcggcuacacagaacucccuccgcugucccuucaggaggcggaacagcuggugcccgagucuagcuguaacauggauaaucaucagucccucucuacgauuaacaaacugaccaaggucaucuggcagaaaaaggcuaaucaggaaagcgccaaccaaaauuccuuugaggugguugagagcgaagugucuuucaaagggcugugcaugcucaagcaccggauggucgaggaauccuaucgcaacagacggagcgugauuuguuacgaccuggccugcaauucuacauuuuguaagccuaccguuuauaugaucgugcccauucaugcuugcaacaugaugaaauccugucuuaucggacugggcccuuaccgcauccaggucgccuaugagagaacauacugcaccacagggauucucaccgagggaaaguguuucgugcccgauaaagcuguggucagcgcccugaagcggggcauguaugcgaucgccucuauugaaacgaucugcuuuuucauucaccaaaaaggcaauaccuacaagaucguuacagcuauuaccuccgccauggggagcaaguguaacaauacagacaccaaagugcagggauacuauaucugcaucauuggcgggaacuccgcuccuguguacgccccggcgggagaggauuuucgcgccauggaagucuucucuggcaucauuacgagcccccauggggaggaccacgaucuuccuggagaagagaucgcuacauaucagauuuccggccagaucgaggccaagaucccccacaccgugagcucuaaaaaucugagacucacagcuuuugccggcauuccuuccuacagcucuaccagcauccuggccgcuuccaaggacgggcgguucauuuucucucccggacuguucccgaaccucaaccaaagcguuugcgauaauaacgcgcugccucuuaucuggcgcggccugauugaccucaccggguauuacgaagccgugcaucccuguaaugucuucugcgugcuguccggaccuggcgcuagcugugaggccuuuucugaagggggaaucuucaacaucacaucccccaugugccuuguuagcaaacagaauagauuucgggccgcugagcagcaaauuucuuucgugugucagcgcgucgauauggacaucauuguguauugcaacggccagaagaaaacgauccugaccaagacacucgucauuggccaguguaucuacaccauuacaucccuguuuagccugcuccccgggguggcccacuccaucgcgaucgaacugugcguuccuggauuccauggcugggcuaccgccgcccuucugauuacguuuuguuucggguggauccucauuccggcuugcacacuggccauccuucuggugcucaaguuuuucgcuaauauucugcacaccucuaaccaagagaauagauuuaaagccauccugcggaagaucaaagaggaauuugagaagaccaaaggaagcauggucugugaaauuugcaaguacgagugcgaaacacucaaggagcugaaagcgcacaaccuuuccugugugcagggcgagugccccuauuguuuuacccauugcgaaccuacagagacggccauccaggcucacuacaagauuugucaggccacccaucgcuucagagaagaucugaaaaagacaguuacaccccaaaauaucgggccuggcugcuaucggacccucaaccuguucagauacaaaucucgcuguuauauucugaccauguggacgcuucuccugaucaucgagagcauucugugggcugccuccgcggccgagaucccccucgugccgcuguggaccgacaaugcucacggagucggcagcgugccuaugcauacagaccuugaacuggauuuuucucuccccuccagcucuaaguacaccuauaagcggcaccugacaaacccugugaaugaccagcaguccguuagccugcacauugagaucgaaucucaggggauuggagccgauguccaucaccuuggccauugguacgacgcuagacucaaccugaaaaccagcuuccacugcuacggggccuguacgaaguaucaauaccccuggcacacagccaaaugccauuuugagaaggauuaugaauacgagaacuccugggcuuguaauccucccgacugcccgggagugggcaccgggugcacagcguguggccuguaucucgaucagcugaaaccugugggaaccgccuucaagaucaucagcguccgcuacucucggaaggugugcguucaguuuggcgaggaauaucuuuguaaaaccauugacaugaacgauugcuucgugacaagacacgcuaagaucuguauuaucgggacggucuccaaauuuagccagggagacacccuccuguuccugggccccauggaagggggaggcauuaucuuuaagcauuggugcacauccaccugucacuucggggaucccggcgacgugaugggaccuaaagacaagccguuuauuugccccgaguucccuggccaauuucgcaaaaaguguaauuucgccacaacccccguuugcgaguacgaugggaacaucaucucuggauacaagaaagugcuggccacgauugacagcuuccaguccuuuaauacaucuaacauccauuucaccgaugaacggauugaguggagagacccugauggcaugcuucgcgaccacaucaauauugucaucagcaaggauaucgacuuugagaaccucgcugaaaaucccuguaaaguggggcugcaggccgcgaacauugagggagcuuggggcuccgggguuggcuucacccugacaugccaagugucucucaccgaaugcccuacauuucugacgagcaucaaggccugugauauggccauuugcuauggagcugaguccgucacccuuagccggggccagaauacagugaaaaucaccgggaagggaggccacucuggguccagcuucaaguguugccauggaaaagaauguucuuccacaggccugcaggccagcgcgccccaccucgacaaggugaacggcauuucugagcuggagaaugaaaaagucuacgaugacggggcuccggagugcggaguuaccuguugguuuaagaaauccggcgaaugggugauggggaucaucaacggaaauugggugguccugauugugcuuugccuccugcuccuguucagccugauccuucuguccauucucuguccuaucagaaagcauaagaaaagcuga

SEQ ID NO: 13481 - RNA, 3402 nt, Artificial Sequence
  derived and/or modified CDS sequence (opt5) from SEOV(B1)__AB457793.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcagaaaaaggcuaaucaggaaagcgccaaccaaaauuccuuugaggugguugagagcgaagugucuuucaaagggcucugcaugcugaagcaccggauggucgaggaauccuaucgcaacagacggagcgugauuuguuacgaccuugccugcaauucuacauuuuguaagccuaccguuuauaugaucgugcccauucaugcuugcaacaugaugaaauccugucugaucggacucggcccuuaccgcauccaggucgccuaugagagaacauacugcaccacagggauucugaccgagggaaaguguuucgugcccgauaaagcuguggucagcgcccuuaagcggggcauguaugcgaucgccucuauugaaacgaucugcuuuuucauucaccaaaaaggcaauaccuacaagaucguuacagcuauuaccuccgccauggggagcaaguguaacaauacagacaccaaagugcagggauacuauaucugcaucauuggcgggaacuccgcuccuguguacgccccggcgggagaggauuuucgcgccauggaagucuucucuggcaucauuacgagcccccauggggaggaccacgaucugccuggagaagagaucgcuacauaucagauuuccggccagaucgaggccaagaucccccacaccgugagcucuaaaaaucucagacugacagcuuuugccggcauuccuuccuacagcucuaccagcauccuggccgcuuccaaggacgggcauuucaucuuuucucccggacucuucccgaaccugaaccaaagcguuugcgauaauaacgcgcuuccucugauuuggcggggccucauugaccugaccggguauuacgaagccgugcaccccuguaaugucuucugcgugcuuuccggaccuggcgcuagcugugaggccuuuucugaagggggaaucuucaacaucacaucccccaugugccugguuagcaaacagaaucgcuuuagagccgcugagcagcaaauuucuuucgugugucagcgggucgauauggacaucauuguguauugcaacggccagaagaaaacgauccucaccaagacacuggucauuggccaguguaucuacaccauuacaucccuguuuagccuccugcccgggguggcccauuccaucgcgaucgaacuuugcguuccuggauuccacggcugggcuaccgccgcccugcucauuacguuuuguuucggguggauccugauuccggcuugcacacuugccauccugcucgugcugaaguuuuucgcuaauauucugcacaccucuaaccaagagaaucgcuuuaaagccauccucagaaagaucaaagaggaguucgagaagaccaaaggaagcauggucugugaaauuugcaaguacgagugcgaaacacugaaggagcuuaaagcgcauaaccuguccugugugcagggcgagugccccuauuguuuuacccacugcgaaccuacagagacggccauccaggcucauuacaagauuugucaggccacccaccgguuccgcgaagaucucaaaaagacaguuacaccccaaaauaucgggccuggcugcuauagaacccugaaccuguuccgguacaaaucuagauguuauauucuuaccauguggacgcuccugcugaucaucgagagcauucucugggcugccuccgcggccgagaucccccuggugccgcuuuggaccgacaaugcucauggagucggcagcgugccuaugcacacagaccuggaacucgauuuuucucugcccuccagcucuaaguacaccuauaagcgccaccugacaaacccugugaaugaccagcaguccguuagccuucauauugagaucgaaucucaggggauuggagccgauguccaccaucucggccacugguacgacgcucggcugaaccugaaaaccagcuuccacugcuacggggccuguacgaaguaucaauaccccuggcauacagccaaaugccacuuugagaaggauuaugaauacgagaacuccugggcuuguaauccucccgacugcccgggagugggcaccgggugcacagcguguggccucuaucuggaucagcuuaaaccugugggaaccgccuucaagaucaucagcgucagauacucucgcaaggugugcguucaguuuggcgaggaauaucuguguaaaaccauugacaugaacgauugcuucgugacacggcaugcuaagaucuguauuaucgggacggucuccaaauuuagccagggagacacccuccuguuccugggccccauggaagggggaggcauuaucuuuaagcacuggugcacauccaccugucauuucggggaucccggcgacgugaugggaccuaaagacaagccguuuauuugccccgaguucccuggccaauuucgcaaaaaguguaauuucgccacaacccccguuugcgaauacgaugggaacaucaucucuggauacaagaaagugcuugccacgauugacagcuuccaguccuuuaauacaucuaacauccacuucaccgaugaaagaauugaguggcgggacccugauggcaugcucagagaccacaucaauauugucaucagcaaggauaucgacuuugagaaccuggcugaaaaucccuguaaaguggggcugcaggccgcgaacauugagggagcuuggggcuccgggguuggcuucacccucacaugccaagugucucugaccgaaugcccuacauuucuuacgagcaucaaggccugugauauggccauuugcuauggagcugaguccgucacccugagccgcggccagaauacagugaaaaucaccgggaagggaggccauucuggguccagcuucaaguguugccacggaaaagaauguucuuccacaggccuccaggccagcgcgccccaucuggacaaggugaacggcauuucugagcuggagaaugaaaaagucuacgaugacggggcuccggagugcggaguuaccuguugguuuaagaaauccggcgaaugggugauggggaucaucaacggaaauugggugguccuuauugugcucugccugcugcuccuguucagccuuauccugcucuccauucuguguccuauccggaagcacaagaaaagcuga

SEQ ID NO: 13482 - RNA, 3402 nt, Artificial Sequence
  derived and/or modified CDS sequence (opt5) from SEOV(B1)__AB457794.1__GP
auguggagccugcuccugauggccgcucuugugggccagggguucgcccugaagaacgucuuugacaugagaauccaaugcccccacuccguuaauuucggagagaccucugugagcggcuacacagaacucccuccgcugucccuucaggaggcggaacagcuggugcccgagucuagcuguaacauggauaaucaucagucccucucuacgauuaacaaacugaccaaggucaucuggcagaaaaaggcuaaucaggaaagcgccaaccaaaauuccuuugaggugguugagagcgaagugucuuucaaagggcugugcaugcucaagcaccggauggucgaggaauccuaucgcaacagacggagcgugauuuguuacgaccuggccugcaauucuacauuuuguaagccuaccguuuauaugaucgugcccauucaugcuugcaacaugaugaaauccugucuuaucggacugggcccuuaccgcauccaggucgccuaugagagaacauacugcaccacagggauucucaccgagggaaaguguuucgugcccgauaaagcuguggucagcgcccugaagcggggcauguaugcgaucgccucuauugaaacgaucugcuuuuucauucaccaaaaaggcaauaccuacaagaucguuacagcuauuaccuccgccauggggagcaaguguaacaauacagacaccaaagugcagggauacuauaucugcaucauuggcgggaacuccgcuccuguguacgccccggcgggagaggauuuucgcgccauggaagucuucucuggcaucauuacgagcccccauggggaggaccacgaucuuccuggagaagagaucgcuacauaucagauuuccggccagaucgaggccaagaucccccacaccgugagcucuaaaaaucugagacucacagcuuuugccggcauuccuuccuacagcucuaccagcauccuggccgcuuccaaggacgggcauuucaucuuuucucccggacuguucccgaaccucaaccaaagcguuugcgauaauaacgcgcugccucuuauuuggcggggccugauugaccucaccggguauuacgaagccgugcaccccuguaaugucuucugcgugcuguccggaccuggcgcuagcugugaggccuuuucugaagggggaaucuucaacaucacaucccccaugugccuuguuagcaaacagaaucgcuuuagagccgcugagcagcaaauuucuuucgugugucagcgggucgauauggacaucauuguguauugcaacggccagaagaaaacgauccugaccaagacacucgucauuggccaguguaucuacaccauuacaucccuguuuagccugcuccccgggguggcccauuccaucgcgaucgaacugugcguuccuggauuccacggcugggcuaccgccgcccuucugauuacguuuuguuucggguggauccucauuccggcuugcacacuggccauccuucuggugcucaaguuuuucgcuaauauucugcacaccucuaaccaagagaaucgcuuuaaagccauccugagaaagaucaaagaggaguucgagaagaccaaaggaagcauggucugugaaauuugcaaguacgagugcgaaacacucaaggagcugaaagcgcauaaccuuuccugugugcagggcgagugccccuauuguuuuacccacugcgaaccuacagagacggccauccaggcucauuacaagauuugucaggccacccaccgguuccgcgaagaucugaaaaagacaguuacaccccaaaauaucgggccuggcugcuauagaacccucaaccuguuccgguacaaaucuagauguuauauucugaccauguggacgcuucuccugaucaucgagagcauucugugggcugccuccgcggccgagaucccccucgugccgcuguggaccgacaaugcucauggagucggcagcgugccuaugcacacagaccuugaacuggauuuuucucuccccuccagcucuaaguacaccuauaagcgccaccugacaaacccugugaaugaccagcaguccguuagccugcauauugagaucgaaucucaggggauuggagccgauguccaccaucuuggccacugguacgacgcucggcucaaccugaaaaccagcuuccacugcuacggggccuguacgaaguaucaauaccccuggcauacagccaaaugccacuuugagaaggauuaugaauacgagaacuccugggcuuguaauccucccgacugcccgggagugggcaccgggugcacagcguguggccuguaucucgaucagcugaaaccugugggaaccgccuucaagaucaucagcgucagauacucucgcaaggugugcguucaguuuggcgaggaauaucuuuguaaaaccauugacaugaacgauugcuucgugacacggcaugcuaagaucuguauuaucgggacggucuccaaauuuagccagggagacacccuccuguuccugggccccauggaagggggaggcauuaucuuuaagcacuggugcacauccaccugucauuucggggaucccggcgacgugaugggaccuaaagacaagccguuuauuugccccgaguucccuggccaauuucgcaaaaaguguaauuucgccacaacccccguuugcgaauacgaugggaacaucaucucuggauacaagaaagugcuggccacgauugacagcuuccaguccuuuaauacaucuaacauccacuucaccgaugaaagaauugaguggcgggacccugauggcaugcuuagagaccacaucaauauugucaucagcaaggauaucgacuuugagaaccucgcugaaaaucccuguaaaguggggcugcaggccgcgaacauugagggagcuuggggcuccgggguuggcuucacccugacaugccaagugucucucaccgaaugcccuacauuucugacgagcaucaaggccugugauauggccauuugcuauggagcugaguccgucacccuuagccgcggccagaauacagugaaaaucaccgggaagggaggccauucuggguccagcuucaaguguugccacggaaaagaauguucuuccacaggccugcaggccagcgcgccccaucucgacaaggugaacggcauuucugagcuggagaaugaaaaagucuacgaugacggggcuccggagugcggaguuaccuguugguuuaagaaauccggcgaaugggugauggggaucaucaacggaaauugggugguccugauugugcuuugccuccugcuccuguucagccugauccuucuguccauucucuguccuauccggaagcacaagaaaagcuga

SEQ ID NO: 13483 - RNA, 3402 nt, Artificial Sequence
  derived and/or modified CDS sequence (opt5) from SEOV(B-1)__X53861.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuacuaugaccuugccggaaauucuacauuuuguaagccuaccguuuacaugaucgugcccauucaugcuugcaacaugaugaaauccugucugaucggccucgggccuuauagaauccaggucguguacgagcggacauauugcaccacagggauucugaccgagggcaaguguuucgugcccgauaaagccgucguuagcgcucuuaagcgcggcauguacgccaucgcgucuauugaaacgaucugcuuuuucauucaccagaaauggaauaaguacaagaucgugaccgccauuacauccgcuauggggagcaaauguaacaauaccgacacaaaggugcagggauauuacaucugcaucauuggcgggaacuccgccccugucuaugcuccggccggagaggauuuuagagcgauggaaguguucucuggcaucauuaccagcccccauggggaggaccacgaucugccuggagaagagaucgccacguaccacauuuccggccagaucgaggcuaaaaucccccauacaguuagcucuaagaaucuccggcuggccgcuuuugccggcauuccuuccuauagcucuaccagcauccuggccgcuuccgaagacgggcgcuucauuuuuagccccggacucuucccgaaccugaaccagagcgugugugauaauaacgcgcuuccucugaucuggagaggccucauugaccugacaggguacuaugaggccguccaccccugcaauguguucugcguucuuuccggaccuggcgcuagcugugaagccuuuucugaagggggaaucuucaacaucaccucccccaugugccuggugagcaaacagaaucgguuucgcgccgcugaacaacagauuucuuucgucugucagagaguggauauggacaucauugucuacugcaacggccaaaagaaaaccauccucacaaagacgcuggugauuggccaguguaucuacaccauuacaucccuguuuagccuccugcccgggguugcccauuccaucgcgaucgagcuuugcgugccuggauuccacggcugggcuaccgccgcccugcucauuacauuuuguuucggguggguccugaucccggcuugcacccuugccauucugcucgugcugaaguuuuucgcuaauauccugcacacgucuaaccaggagaaucgguuuaaagccauucuccgcaagaucaaagaagaguucgaaaagagaaaaggaagcaugguuugugagaucugcaaguaugaaugugagacacugaaggagcuuaaagcgcauaaccuguccugcgugcagggcgaaugccccuacuguuuuacccacugcgagccuaccgaaacagccauucaagcucauuauaaggucugucaggccacccaccgguucagagaggaucucaaaaagacagugacgccccagaauaucgggccuggcugcuaccgcacccugaaccuguuccgguauaaaucuagauguuacauucuuacaauguggacccuccugcugaucauugagagcauccucugggcugccuccgcggccgaaaucccccuggugccgcuuuggacagacaaugcucauggaguuggcagcgucccuaugcacaccgaccuggagcucgauuuuucucugcccuccagcucuaaguauacguacaagcgccaccugaccaacccugugaaugaccagcaauccgugagccuucauauugaaaucgagucucaggggauuggagccgauguccaccaucucggccacugguacgacgcucggcugaaccugaaaacaucuuuccacugcuauggggccuguaccaaguaccaguaucccuggcauacagccaaaugccacuuugaaaaggauuacgaguaugagaacuccugggcuuguaauccucccgacugcccgggagugggcaccggguguacggcgugcggccucuaccuggaucagcuuaaaccuguuggaacagccuucaagaucauuagcgugagauauucucgcaaggucugcgugcaauuuggcgaggagcaucuguguaaaaccaucgacaugaacgauugcuucguuacacggcacgcuaagaucuguauuaucgggaccguguccaaauuuagccagggagacacccuccuguuccugggccccauggaagggggaggcauuaucuuuaagcauuggugcacauccacgugucacuucggggaucccagagacgucaugggcccuaaagacaagccguuuauuugccccgaguucccuggacaguuucgcaaaaaguguaauuucgccaccacacccgugugcgaauacgauggcaacaucauuucuggguacaagaaaguucuugccaccaucgacagcuuccaguccuuuaauacaucuaacauccacuucaccgaugagcggauugaguggagagacccugauggaaugcuccgcgaccauaucaauauugugaucagcaaggauauugacuuugaaaaccuggcugagaaucccuguaaagucggccugcaagccgcgaacaucgaaggggcuuggggauccggcgugggguucacgcucacaugccaggugucucugaccgaguguccuaccuuucuuacaagcaucaaggccugcgauauggccauuugcuauggcgcugaauccgucacccugagccggggacagaauacaguuaaaaucacgggcaagggaggacacucuggcuccagcuucaaguguugccaugggaaagaguguucuuccaccggacuccaagccagcgcgccccaccuggacaaggugaacggcauuucugagcuggaaaaugagaaaguguacgaugacggcgcuccggaaugcggggucacauguugguuuaagaaauccggagagugggugaugggcaucauuaacgggaauuggguugugcuuaucguccucugcgugcugcuccuguucagccugauccuucuguccauucucuguccuguuagaaagcauaagaaaagcuga

SEQ ID NO: 13484 - RNA, 3402 nt, Artificial Sequence
  derived and/or modified CDS sequence (opt5) from SEOV(BjHD01)__DQ133505.1__GP
auguggagccuccuguuccuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaagcugaccaaggucaucuggcggaaaaaggcuaaucaagaaagcgccaaccaaaauuccuucgaggugguugagagcgaagugucuuuuaaagggcugugcaugcucaagcaccgcauggucgaggaauccuauagaaaccggcgcagcgugauuuguuacgaccuggccugcaauucuacauucuguaagccuaccguuuauaugaucgugcccauucaugcuugcaacaugaugaaauccugucuuaucggacugggcccuuacagaauccaggucguguaugagcggacauacugcaccacagggauucucaccgagggaaaguguuuugugcccgauaaagccgucguuagcgcucugaagcgcggcauguaugccaucgcgucuauugaaacgaucugcuucuuuauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuucagagcgauggaaguguuuucuggcaucauuacgagcccccauggggaggaccacgaucuuccuggagaagagguugccacauaucagaucuccggccagauugaggcuaagaucccccacaccgugagcucuaaaaaucugaagcucacagccuucgcuggcaucccuuccuacagcucuaccagcauucuggccgccuccgaagacgggcgguuuaucuucucucccggacuguucccgaaccucaaccagagcgucugcgauaauaacgcucugccucuuauuuggcgcggccugaucgaccucaccggguauuacgaggcggugcaucccuguaauguguuuugcguucuguccggaccuggcgccagcugugaggcuuucucugaagggggaauuuuuaacaucacaucccccaugugccuugucagcaaacaaaauagauuccgggccgccgaacagcagaucucuuuugugugucaacgcgucgauauggacauuaucguguauugcaacggccagaagaaaacgauucugaccaagacacucguuaucggccaguguauuuacaccaucacaucccuguucagccugcuccccgggguggcucacuccauugccaucgagcugugcgucccuggauuucauggcugggcgaccgcugcccuucugaucacguucuguuuugggugggugcucauuccggccugcacacuggcuauccuucugguucucaaguucuuugccaauauucugcacaccucuaaccaggagaauagauucaaagcuauccugcggaagauuaaagaagaguuugaaaagaccaaaggaagcauggugugugagaucugcaaguacgaaugcgagacacucaaggagcugaaagcccacaaccuuuccuguguccaaggcgaaugccccuauuguuucacccauugcgagccuacagaaacggcgauccaggcccacuacaaggugugucaggcuacccaucgcuucagagaggaucugaaaaagacagugacaccccagaauauugggccuggcugcuaucggacccucaaccuguuuagauacaaaucucgcuguuauauccugaccauguggacgcuucuccugauuaucgagagcauucugugggccgcuuccgccgcggaaaucccccucguuccgcuguggaccgacaaugcccacggagucggcagcgugccuaugcauacagaccuugagcuggauuucucucuccccuccagcucuaaguacaccuauaagcggcaccugacaaacccugugaaugaccaacaguccgucagccugcacaucgaaauugagucucaggggaucggagcugaugugcaucaccuuggccauugguacgacgccagacucaaccugaaaaccagcuuucacugcuacggggcuuguacgaaguaucaguaccccuggcacacagccaaaugccauuucgaaaaggauuaugaguacgagaacuccugggccuguaauccucccgacugcccgggaguuggcaccgggugcacagcuuguggccuguaucucgaucaacugaaaccugugggaaccgcguuuaagauuaucagcguccgcuacucucggaaggugugcguucaguucggcgaagaguaucuuuguaaaaccauugacaugaacgauugcuuugugacaagacacgccaagaucuguaucauugggacggucuccaaauucagccagggagacacccugcucuuucugggccccauggaagggggaggcaucauuuucaagcauuggugcacauccaccugucacuuuggggaucccggcgacgugaugggaccuaaagacaagccguucaucugccccgaguuuccuggccaguuccgcaaaaaguguaauuucgcuacaacccccguuugcgaauacgaugggaacauuaucucuggauacaagaaagugcuggccacgauugacagcuuucaauccuucaauacaucuaacauccauuuuaccgaugagcggaucgaguggagagacccugauggcaugcuucgcgaccacauuaauaucgucauuagcaaggauaucgacuucgaaaaccucgccgagaaucccuguaaaguggggcugcaggcugccaacauugaaggagcguggggcuccggggugggcuuuacccugacaugccaggucucucucaccgagugcccuacauuccugacgagcaucaaggcuugugauauggccaucugcuauggagccgaauccguuacccuuagccggggccaaaauacagugaaaauuaccgggaagggaggccacucuggguccagcuuuaaguguugccauggagaggaguguucuuccacaggccugcaggcuagcgcgccccaccucgacaaagugaacggcaucucugaacuggagaaugaaaaggucuacgaugacggggccccggagugcggagugaccuguugguucaaaaaguccggcgaguggguuauggggauuaucaacggaaauugggugguccugauugugcuuugcguucuccugcuguuuagccucauccugcuuuccauccuguguccugugagaaaacauaaaaagagcuga

SEQ ID NO: 13485 - RNA, 3402 nt, Artificial Sequence
  derived and/or modified CDS sequence (opt5) from SEOV(Cherwell)__KM948593.1__GP
auguggagccugcuccugcuugccgcucuggugggccaaggguccgcccucaagaacgucuucgacaugagaauccaaugcccccacucuguuaauuuuggagagaccagcguguccggcuacacagaacugccuccgcuuucucugcaggaggcggaacagcucgugcccgagagcuccuguaacauggauaaucaucagucucugagcacgauuaacaaacugaccaaggucaucuggcggaaaaaggcuaaucaagaauccgccaaccagaauagcuucgaggugguugagucugaaguguccuuuaaagggcucugcaugcugaagcaccgcauggucgaggaaagcuauagaaaccggcgcucugugauuuguuacgaccuugccugcaauuccacauucuguaagccuaccguuuauaugaucgugcccauucaugcuugcaacaugaugaaaagcugucugaucggacucggcccuuacagaauccaggucguguaugagcggacauacugcaccacagggauucugaccgagggaaaguguuuugugcccgauaaagccgucguuucugcucuuaagcgcggcauguaugccaucgcguccauugaaacgaucugcuucuuuauucaccagaaaggcaauaccuacaagaucgugacagccauuaccagcgcuaugggguccaaguguaacaauacagacaccaaagugcaaggauacuauaucugcaucauuggcgggaacucugccccugucuacgcuccggccggagaggauuucagagcgauggaaguguuuagcggcaucauuacgagcccccauggggaggaccacgaucugccuggagaagagaucgccacauaucagauuagcggccagaucgaggcuaagaucccccacaccguuucuuccaaaaaucucaagcugacagccuucgcuggcauuccuagcuacucuagcaccuccauccuggccgccucugaagacgggcgguuuauuuucagccccggacucuuuccgaaccugaaccaguccgugugcgauaauaacgcgcuuccucugaucuggcgcggccucauugaccugaccggguauuacgaggcuguccaucccuguaauguguucugcguucuuagcggaccuggcgccucuugugaggcuuucuccgaagggggaaucuuuaacaucacaagccccaugugccuggugucuaaacaaaauagauuccgggccgccgaacagcagauuuccuuugucugucaacgcguggauauggacaucauugucuauugcaacggccagaagaaaacgauccucaccaagacacuggugauuggccaguguaucuacaccauuacaagccuguucucccuccugcccgggguugcucacucuaucgccaucgagcuuugcgugccuggauuucauggcugggcgaccgcugcccugcucauuacguucuguuuuggguggguccugaucccggccugcacacuugcuauucugcucgugcugaaguucuuugccaauauccugcacaccagcaaccaggagaauagauucaaagcuauucuccggaagaucaaagaagaguuugaaaagaccaaaggauccaugguuugugagaucugcaaguacgaaugcgagacacugaaggagcuuaaagcccacaaccugucuugugugcaaggcgaaugccccuauuguuucacccauugcgagccuacagaaacggcgauucaggcccacuacaaggucugucaggcuacccaucgcuuuagagaggaucucaaaaagacagugacacccccuaauaucgggcccggcugcuaucggacccugaaccuguucagauacaaaagccgcuguuauauucuuaccauguggacgcuccugcugaucauugaguccauccucugggccgcuagcgccgcggaaaucccgcuggugccucuuuggaccgacaaugcccacggaguuggcucuguccccaugcauacagaccuggagcucgauuucucccugccuuccucuuccaaguacaccuauaagcggcaccugacaaaccccgugaaugaccagcaaagcgugucucuucacauugaaaucgagagccaggggauuggagcugauguccaucaccucggccauugguacgacgccagacugaaccugaaaaccuccuuucacugcuacggggcuuguacgaaguaucaguacccuuggcacacagccaaaugccauuucgaaaaggauuaugaguacgagaacagcugggccuguaaucccccggacugcccuggagugggcaccgggugcacagcuuguggcguuuaucucgaucagcugaaacccgugggaaccgcguuuaagaucgucucugugcgcuacucccggaagguuugcgugcaauucggcgaagaguaucuuuguaaaaccauugacaugaacgauugcuuugucacaagacacgccaagaucuguaucauugggacggugagcaaauucucccagggagacacccugcucuuucugggccccauggaagggggaggcaucauuuucaagcauuggugcacaucuaccugucacuuuggggauccuggcgacguuaugggaccgaaagacaagcccuucaucugcccugaguuucccggccaguuccgcaaaaaguguaauuuugcuacaaccccugugugcgaauacgaugggaacauuaucagcggauacaagaaaguccuggccacgauugacuccuuccagucuuucaauacaagcaacauccauuuuaccgaugagcggaucgaguggagagaccccgauggcaugcuucgcgaccacauuaauaucgugauuuccaaggauaucgacuucgaaaaccucgccgagaauccuuguaaaguggggcugcaagcugccaacauugaaggagcguggggcucuggggucggcuuuacccugacaugccagguuagccucaccgagugccccacauuccugacguccaucaaggcuugugauauggccaucugcuauggagccgaaagcgugacccuuucucggggccagaauacagugaaaauuaccgggaagggaggccacuccgggagcucuuuuaaguguugccauggaaaagaguguuccagcacaggccugcaggcuucugccccgcaccucgacaaggucaacggcaucuccgagcuggaaaaugagaaaguguacgaugacggggcgccugaaugcggaguuaccuguugguucaagaaaagcuccgagugggugaugggcauuaucaacgggaauugggucgugcugauuguucuuugcgugcuccugcuguuuagccucauccugcuuucuauccugugucccgucagaaagcauaagaaaagcuga

SEQ ID NO: 13486 - RNA, 3402 nt, Artificial Sequence
  derived and/or modified CDS sequence (opt5) from SEOV(HaixingRn40)__GU592924.1__GP
auguggagccuccuguuccuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaaacugaccaaggucaucuggcggaaaaaggcuaaucaagaaagcgccaaccaaaauuccuucgaggugguugagagcgaagugucuuuuaaagggcugugcaugcucaagcaccgcauggucgaggaauccuauagaaaccggcgcagcgugauuuguuacgaccuggccugcaauucuacauucuguaagccuaccguuuauaugaucgugcccauucaugcuugcaacaugaugaaauccugucuuaucggacugggcccuuacagaauccaggucguguaugagcggacauacugcaccacagggauucucaccgagggaaaguguuuugugcccgauaaagccgucguuagcgcucugaagcgcggcauguaugccaucgcgucuauugaaacgaucugcuucuuuauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuucagagcgauggaaguguuuucuggcaucauuacgagcccccauggggaggaccacgaucuuccuggagaagagaucgccacauaucagauuuccggccagaucgaggcuaagaucccccacaccguuagcucuaaaaaucugaagcucacagccuucgcuggcauuccuuccuacagcucuaccagcauccuggccgccuccgaagacgggcgguuuauuuucucucccggacuguucccgaaccucaaccagagcgugugcgauaauaacgcucugccucuuaucuggcgcggccugauugaccucaccggguauuacgaggcgguccaucccuguaauguguuuugcguucuguccggaccuggcgccagcugugaggcuuucucugaagggggaaucuuuaacaucacaucccccaugugccuugugagcaaacaaaauagauuccgggccgccgaacagcagauuucuuuugucugucaacgcguggauauggacaucauugucuauugcaacggccagaagaaaacgauccugaccagaacacucgugauuggccaguguaucuacaccauuacaucccuguucagccugcuccccgggguugcucacuccaucgccaucgagcugugcgugccuggauuucauggcugggcgaccgcugcccuucugauuacguucuguuuuggguggguccucaucccggccugcacacuggcuauucuucuggugcucaaguucuuugccaauauccugcacaccucuaaccaggagaaucgguucaaggcuauucugcgcaaaaucaaggaagaguuugaaaagaccaagggaagcaugguuugugagaucugcaaauacgaaugcgagacacucaaggagcugaaggcccacaaccuuuccugugugcaaggcgaaugccccuauuguuucacccauugcgagccuacagaaacggcgauucaggcccacuacaaagucugucaggcuacccauagauuccgggaggaucugaagaaaacagugacaccccagaauaucgggccuggcugcuauagaacccucaaccuguuucgcuacaagucucgguguuauauucugaccauguggacgcuucuccugaucauugagagcauccugugggccgcuuccgccgcggaaaucccccucgugccgcuguggaccgacaaugcccacggaguuggcagcgucccuaugcauacagaccuugagcuggauuucucucuccccuccagcucuaaauacaccuauaagagacaccugacaaacccugugaaugaccaacaguccgugagccugcacauugaaaucgagucucaggggauuggagcugauguccaucaccuuggccauugguacgacgcccgccucaaccugaagaccagcuuucacugcuacggggcuuguacgaaauaucaguaccccuggcacacagccaagugccauuucgaaaaagauuaugaguacgagaacuccugggccuguaauccucccgacugcccgggagugggcaccgggugcacagcuuguggccuguaucucgaucaacugaagccuguuggaaccgcguuuaaaaucauuagcgugcgguacucuagaaaggucugcgugcaguucggcgaagaguaucuuuguaagaccaucgacaugaacgauugcuuuguuacacgccacgccaaaaucuguauuaucgggacgguguccaaguucagccagggagacacccugcucuuucugggccccauggaagggggaggcauuaucuucaaacauuggugcacauccaccugucacuuuggggaucccggcgacgucaugggaccuaaggacaaaccguucauuugccccgaguuuccuggccaguuccggaagaaauguaauuucgcuacaacccccgugugcgaauacgaugggaacaucauuucuggauacaagaagguucuggccacgaucgacagcuuucaauccuucaauacaucuaacauccauuuuaccgaugagagaauugaguggcgcgacccugauggcaugcuucgggaccacaucaauauugugaucagcaaagauauugacuucgaaaaccucgggcagaaucccuguaaggucggacugcaggccgcuaacaucgagggcgccuggggguccggcgugggauuuacccugacaugccaagugucucucaccgaaugcccuacauuccugacgagcaucaaagcgugugauauggcuauuugcuauggcgccgaguccgucacccuuagcagagggcagaauacaguuaagaucaccggaaaaggcgggcacucuggauccagcuuuaaguguugccauggcaaggaauguucuuccacaggccugcaggccagcgcuccccaccucgacaaagugaacgggauuucugaucuggagaaugagaagguguacgacgauggagccccggaaugcggcgucaccuguugguucaaaaaguccggggagugggugaugggaaucauuaacggcaauuggguugugcugaucguccuuugcgugcuccugcuguuuagccucauccugcuuuccauucuguguccuguucgcaaacauaaaaagagcuga

SEQ ID NO: 13487 - RNA, 3402 nt, Artificial Sequence
  derived and/or modified CDS sequence (opt5) from SEOV(HBQ17)__KM233655.1__GP
auguggagccugcucuuuguggccgcucugaucggccagggguuugcccuugagaacgcguucgacaugcggauuagaugcccccacuccguccauuuuggagaaaccucuguuagcggcuacacagagcugccuccgcucucccugcaagaagcugagcagcuugugcccgaaucuagcuguaauauggauaaccaccagucccugucuacgaucaauaagcucaccaaagugauuuggcgcaagaaagccaaccaggagagcgccaaucaaaacuccuucgaggucguggaaagcgcucugaagaucaaagggcugugcaugcucaagcauagaaugguugaggaaucuuaucggaaucgcagauccgugauuuguuacgaccuggccugcaacagcacauuuuguaagccuaccgucuauaugaucgugcccauccacgcuugcaauaugaugaaaucuugucuuauuggacugggcccuuaccggauccagguuguguaugagcgcacauacugcaccacagggauucucaccgagggaaaguguuucguccccgauaaagccgugguguccgcgcugaagagaggcauguaugccaucgcuagcauugaaacgaucugcuuuuucauucaucagaaaggcaacaccuacaagaucgucacagccaucaccucugcuaugggguccaaguguaauaacacagacaccaaaguucagggauacuauauuugcaucauuggcgggaauagcgccccuguguacgcgccggccggagaggauuuucgggcuauggaaguguucuccggcaucauuacgucuccccacggggaggaccacgaucuuccuggagaagagaucgccacauaucaaaucagcggccagauugaggcuaagaucccccauaccgucuccagcaaaaaccugaagcucacagccuuugccggcauuccuucuuacuccagcaccucuauccuggcugcgagcgaagacgggcgcuucauuuucucccccggacuguucccgaaucucaaccagucugugugcgauaacaaugcccugccucuuaucuggagaggccugaucgaccucaccggguauuacgaggcuguucaccccuguaacguguucugcguccugagcggaccuggcgccuccugugaagccuuuagcgaagggggaauuuucaauaucacaucucccaugugccuuguguccaaacagaaccgguuucgcgcugccgagcaacagauuagcuucguuugucagagaguggauauggacaucauugucuauugcaauggccaaaagaaaacgauccugaccaagacacucgugauuggccaguguaucuacaccaucacaucucuguuuucccugcuccccggggucgcgcauagcauugcuaucgagcugugcgugccuggauuccacggcugggccaccgccgcucugcugauuacguuuuguuucggguggguucucaucccggccugcacacuggcuauucuucuggugcucaaguuuuucgccaacauccugcacaccuccaaucaggagaaccgguuuaaagcgauccugcgcaagauuaaagaagaguucgaaaagaccaaaggaucuauggucugugagaucugcaaguacgaaugcgagacacucaaggagcugaaagcccauaaucuuagcugugugcagggcgaaugccccuauuguuuuacccacugcgagccuacagaaacggcuauucaagcccauuacaagguuugucaggcuacccacagauuccgggaggaucugaaaaagacagugacaccccagaacaucgggccuggcugcuauagaacccucaaucuguuccgcuacaaaucccgguguuauauucugaccauguggacgcuucuccugaucaucgagucuauucugugggccgcgagcgccgcugaaaucccccucgucccgcuguggaccgacaacgcccauggagugggcuccgugccuaugcacacagaccuugagcuggauuuuagccuccccucuuccagcaaguacaccuauaagagacaccugacaaauccuguuaacgaccagcaaucugucucccugcauauugaaaucgagagccaggggauuggagcugaugugcaccaucuuggccacugguacgacgcccgccucaaucugaaaaccucuuuccacugcuacggggccuguacgaaguaucaguaccccuggcauacagcuaaaugccacuuugaaaaggauuaugaguacgagaacagcugggcguguaacccucccgacugcccgggagugggcaccgggugcacagccuguggccuguaucucgaucagcugaaaccugucggaaccgcuuucaagaucaucuccgugcgguacagcagaaagguuugcgugcaauuuggcgaagaguaucuuuguaaaaccauugacaugaaugauugcuucgucacacgccaugccaagaucuguauuaucgggacggugucuaaauuuucccagggagacacccuucucuuccugggccccauggaagggggaggcauuaucuuuaagcacuggugcacaagcaccugucauuucggggaucccggcgacguuaugggaccuaaagacaagccguuuauuugccccgaguucccuggccaguuucggaaaaaguguaacuucgccacaacccccgugugcgaauacgaugggaauaucaucuccggauacaagaaaguccuggcuacgauugacucuuuccagagcuuuaacacauccaauauccacuucaccgaugagagaauugaguggcgcgacccugauggcaugcuucgggaccacaucaacauugugaucucuaaggauaucgacuuugaaaaucucgccgagaaccccuguaaaguugggcugcaagcggcuaauauugaaggagccuggggcagcggggugggcuucacccugacaugccaggucucccucaccgagugcccuacauuucugacgucuaucaaggccugugauauggcuauuugcuauggagccgaaagcgugacccuuuccagaggccagaacacagugaaaaucaccgggaagggaggccauagcgggucuuccuucaaguguugccacggaaaagaguguagcucuacaggccugcaagcguccgcuccccaucucgacaaggucaauggcauuagcgagcuggaaaacgagaaaguuuacgaugacggggccccggaaugcggagugaccuguugguuuaagaaaucuggcgagugggugauggggaucaucaauggaaacugggucgugcugauuguucuuugcgugcuccugcuguucucccucauccugcuuagcauucuguguccuguccgcaagcacaagaaauccuga

SEQ ID NO: 13488 - RNA, 3402 nt, Artificial Sequence
  derived and/or modified CDS sequence (opt5) from SEOV(HBQ20)__KM233656.1__GP
auguggagccugcucuuucuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaaacugaccaaggucaucuggcggaaaaaggcuaaucaagaaagcgccaaccaaaauuccuucgaggugguugagagcgaagugucuuuuaaagggcugugcaugcucaagcaccgcauggucgaggaauccuauagaaaccggcgcagcgugauuuguuacgaccuggccugcaauucuacauucuguaagccuaccguuuauaugaucgugcccauucaugcuugcaacaugaugaaauccugucuuaucggacugggcccuuacagaauccaggucguguaugagcggacauacugcaccacagggauucucaccgagggaaaguguuuugugcccgauaaagccgucguuagcgcucugaagcgcggcauguaugccaucgcgucuauugaaacgaucugcuucuuuauucaccagaaaggcaauaccuacaagaucgugacagugauuaccuccgccauggggagcaaguguaacaauacagacaccaaaguccagggauacuauaucugcaucauuggcgggaacuccgcuccuguguacgccccggcuggagaggauuucagagccauggaaguuuucucuggcaucauuacgagcccccauggggaggaccacgaucuuccuggagaagagaucgcgacauaucagauuuccggccagaucgaggccaagaucccccacaccgugagcucuaaaaaucugaagcucacagcuuucgccggcauuccuuccuacagcucuaccagcauccuggcugccuccgaagacgggcgguuuauuuucucucccggacuguucccgaaccucaaccagagcgucugcgauaauaacgcccugccucuuaucuggcgcggccugauugaccucaccggguauuacgaggcugugcaucccuguaauguguuuugcguucuguccggaccuggcgcgagcugugaagccuucucugaagggggaaucuuuaacaucacaucccccaugugccuugucagcaaacaaaauagauuccgggcugccgagcagcagauuucuuuugugugucaacgcgucgauauggacaucauuguguauugcaacggccagaagaaaacgauccugaccaagacacucguuauuggccaguguaucuacaccauuacaucccuguucagccugcuccccgggguggcccacuccaucgcuaucgagcugugcgucccuggauuucauggcugggccaccgcggcccuucugauuacguucuguuuugggugggugcucaucccggcuugcacacuggccauucuucugguucucaaguucuuugcuaauauccugcacaccucuaaccaggagaauagauucaaagccauucugcggaagaucaaagaagaguuugaaaagaccaaaggaagcauggugugugagaucugcaaguacgaaugcgagacacucaaggagcugaaagcucacaaccuuuccuguguccaaggcgaaugccccuauuguuucacccauugcgagccuacagaaacggccauucaggcgcacuacaaggugugucaggccacccaucgcuucagagaggaucugaaaaagacagugacaccccagaauaucgggccuggcugcuaucggacccucaaccuguuuagauacaaaucucgcuguuauauucugaccauguggacgcuucuccugaucauugagagcauccugugggcugccuccgcugccgaaaucccccucguuccgcuguggaccgacaaugcgcacggagucggcagcgugccuaugcauacagaccuugagcuggauuucucucuccccuccagcucuaaguacaccuauaagcggcaccugacaaacccugugaaugaccaacaguccgucagccugcacauugaaaucgagucucaggggauuggagccgaugugcaucaccuuggccauugguacgacgcuagacucaaccugaaaaccagcuuucacugcuacggggccuguacgaaguaucaguaccccuggcacacagcuaaaugccauuucgaaaaggauuaugaguacgagaacuccugggccuguaauccucccgacugcccgggaguuggcaccgggugcacagccuguggccuguaucucgaucaacugaaaccugugggaaccgcuuuuaagaucauuagcguccgcuacucucggaaggugugcguucaguucggcgaagaguaucuuuguaaaaccaucgacaugaacgauugcuuugugacaagacacgcgaagaucuguauuaucgggacggucuccaaauucagccagggagacacccugcucuuucugggccccauggaagggggaggcauuaucuucaagcauuggugcacauccaccugucacuuuggggaucccggcgacgugaugggaccuaaagacaagccguucauuugccccgaguuuccuggccaguuccgcaaaaaguguaauuucgccacaacccccguuugcgaauacgaugggaacaucauuucuggauacaagaaagugcuggcuacgaucgacagcuuucaauccuucaauacaucuaacauccauuuuaccgaugagcggauugaguggagagacccugauggcaugcuucgcgaccacaucaauauugucaucagcaaggauaccgacuucgaaaaccucgccgagaaucccuguaaaguggggcugcaggccgcuaacauugaaggagccuggggcuccggggugggcuuuacacugaccugccaggucucucucacagagugcccuacguuccugaccagcaucaaggcgugugauauggcuaucugcuauggagccgaauccguuacacuuagccggggccaaaauaccgugaaaauuacagggaagggaggccacucuggguccagcuuuaaguguugccauggaaaagaguguucuuccaccggccugcaggccagcgcuccccaccucgacaaggugaacggcaucucugagcuggaaaaugagaaagucuacgaugacggggccccggaaugcggagugacguguugguucaagaaauccggcgaguggguuauggggauuaucaacggaaauugggugguccugauugugcuuugcguucuccugcuguuuagccucauccugcuuuccauccuguguccugugagaaagcauaagaaaagcuga

SEQ ID NO: 13489 - RNA, 3402 nt, Artificial Sequence
  derived and/or modified CDS sequence (opt5) from SEOV(HBQ43)__KM233657.1__GP
auguggagccugcuguuccuggccgcucuugugggccagggggucgcccugaagaacguuuuugacaugagaauccaaugcccccacuccgugaauuucggagagaccucugugagcggcuacacagaacucccuccgcugucccuucaggaggcggaacagcugguccccgagucuagcuguaacauggauaaucaucagucccucucuacgauuaacaaacugaccaaggugaucuggcggaaaaaggcuaaucaagaaagcgccaaccaaaauuccuuugagguuguggagagcgaagucucuuucaaagggcugugcaugcucaagcaccgcaugguggaggaauccuauagaaaccggcgcagcguuauuuguuacgaccuggccugcaauucuacauuuuguaagccuaccguguauaugaucguccccauucaugcuugcaacaugaugaaauccugucuuaucggacugggcccuuacagaauccaggugguguaugagcggacauacugcaccacagggauucucaccgagggaaaguguuucguccccgauaaagccguugugagcgcucugaagcgcggcauguaugccaucgcgucuauugaaacgaucugcuuuuucauucaccagaaaggcaauaccuacaagaucgugacagccauuaccuccgcuauggggagcaaguguaacaauacagacaccaaaguccagggauacuauaucugcaucauuggcgggaacuccgccccuguguacgcuccggccggagaggauuuuagagcgauggaaguuuucucuggcaucauuacgagcccccauggggaggaccacgaucuuccuggagaagagaucgccacauaucagauuuccggccagaucgaggcuaagaucccccacaccgugagcucuaaaaaucugaagcucacagccuuugcuggcauuccuuccuacagcucuaccagcauccuggccgccuccgaagacgggcgguucaucuuuucucccggacuguucccgaaccucaaccagagcgucugcgauaauaacgcucugccucuuauuuggcgcggccugauugaccucaccggguauuacgaggcggugcaucccuguaauguuuucugcgugcuguccggaccuggcgccagcugugaggcuuuuucugaagggggaaucuucaacaucacaucccccaugugccuugucagcaaacaaaauagauuucgggccgccgaacagcagauuucuuucgugugucaacgcgucgauauggacaucauuguguauugcaacggccagaagaaaacgauccugaccaagacacucguuauuggccaguguaucuacaccauuacaucccuguuuagccugcuccccgggguggcucacuccaucgccaucgagcugugcgucccuggauuccauggcugggcgaccgcugcccuucugauuacguuuuguuucgggugggugcucaucccggccugcacacuggcuauucuucugguucucaaguuuuucgccaauauccugcacaccucuaaccaggagaauagauuuaaagcuauucugcggaagaucaaagaagaguucgaaaagaccaaaggaagcauggugugugagaucugcaaguacgaaugcgagacacucaaggagcugaaagcccacaaccuuuccuguguccaaggcgaaugccccuauuguuuuacccauugcgagccuacagaaacggcgauucaggcccacuacaaggugugucaggcuacccaucgcuucagagaggaucugaaaaagacagugacaccccagaauaucgggccuggcugcuaucggacccucaaccuguucagauacaaaucucgcuguuauauucugaccauguggacgcuucuccugaucauugagagcauccugugggccgcuuccgccgcggaaaucccccucguuccgcuguggaccgacaaugcccacggagucggcagcgugccuaugcauacagaccuugagcuggauuuuucucuccccuccagcucuaaguacaccuauaagcggcaccugacaaacccugugaaugaccaacaguccgucagccugcacauugaaaucgagucucaggggauuggagcugaugugcaucaccuuggccauugguacgacgccagacucaaccugaaaaccagcuuccacugcuacggggcuuguacgaaguaucaguaccccuggcacacagccaaaugccauuuugaaaaggauuaugaguacgagaacuccugggccuguaauccucccgacugcccgggaguuggcaccgggugcacagcuuguggccuguaucucgaucaacugaaaccugugggaaccgcguucaagaucauuagcguccgcuacucucggaaggugugcguucaguuuggcgaagaguaucuuuguaaaaccaucgacaugaacgauugcuucgugacaagacacgccaagaucuguauuaucgggacggucuccaaauuuagccagggagacacccuccucuuccugggccccauggaagggggaggcauuaucuuuaagcauuggugcacauccaccugucacuucggggaucccggcgacgugaugggaccuaaagacaagccguuuauuugccccgaguucccuggccaguuucgcaaaaaguguaauuucgcuacaacccccguuugcgaauacgaugggaacaucauuucuggauacaagaaagugcuggccacgaucgacagcuuccaauccuuuaauacaucuaacauccauuucaccgaugagcggauugaguggagagacccugauggcaugcuucgcgaccacaucaauauugucaucagcaaggauauugacuuugaaaaccucgccgagaaucccuguaaaguggggcugcaggcugccaacaucgaaggagcguggggcuccggggugggcuucacccugacaugccaggucucucucaccgagugcccuacauuucugacgagcaucaaggcuugugauauggccauuugcuauggagccgaauccguuacccuuagccggggccaaaauacagugaaaaucaccgggaagggaggccacucuggguccagcuucaaguguugccauggaaaagaguguucuuccacaggccugcaggcuagcgcgccccaccucgacaaggugaacggcuuuucugagcuggaaaaugagaaagucuacgaugacggggccccggaaugcggagugaccuguugguucaagaaauccggcgaguggguuauggggauuaucaacggaaauugggugguccugauugugcuuugcauccuccugcuguuuagccucauccugcuuuccauucuguguccuguuagaaagcauaagaaaagcuga

SEQ ID NO: 13490 - RNA, 3402 nt, Artificial Sequence
  derived and/or modified CDS sequence (opt5) from SEOV(HBQ5)__KM233653.1__GP
auguggagccuccuguuccuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaaacugaccaaggucaucuggcggaaaaaggcuaaucaagaaagcgccaaccaaaauuccuucgaggugguugagagcgaagugucuuuuaaagggcugugcaugcucaagcaccgcauggucgaggaauccuauagaaaccggcgcagcgugauuuguuacgaccuggccugcaauucuacauucuguaagccuaccguuuauaugaucgugcccauucaugcuugcaacaugaugaaauccugucuuaucggacugggcccuuacagaauccaggucguguaugagcggacauacugcaccacagggauucucaccgagggaaaguguuuugugcccgauaaagccgucguuagcgcucugaagcgcggcauguaugccaucgcgucuauugaaacgaucugcuucuuuauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuucagagcgauggaaguguuuucuggcaucauuacgagcccccauggggaggaccacgaucuuccuggagaagagaucgccacauaucagauuuccggccagaucgaggcuaagaucccccacaccguuagcucuaaaaaucugaagcucacagccuucgcuggcauuccuuccuacagcucuaccagcauccuggccgccuccgaagacgggcgguuuauuuucucucccggacuguucccgaaccucaaccagagcgugugcgauaauaacgcucugccucuuaucuggcgcggccugauugaccucaccggguauuacgaggcgguccaucccuguaauguguuuugcguucuguccggaccuggcgccagcugugaggcuuucucugaagggggaaucuuuaacaucacaucccccaugugccuugugagcaaacaaaauagauuccgggccgccgaacagcagauuucuuuugucugucaacgcguggauauggacaucauugucuauugcaacggccagaagaaaacgauccugaccaagacacucgugauuggccaguguaucuacaccauuacaucccuguucagccugcuccccgggguugcucacuccaucgccaucgagcugugcgugccuggauuucauggcugggcgaccgcugcccuucugauuacguucuguuuuggguggguccucaucccggccugcacacuggcuauucuucuggugcucaaguucuuugccaauauccugcacaccucuaaccaggagaauagauucaaagcuauucugcggaagaucaaagaagaguuugaaaagaccaaaggaagcaugguuugugagaucugcaaguacgaaugcgagacacucaaggagcugaaagcccacaaccuuuccugugugcaaggcgaaugccccuauuguuucacccauugcgagccuacagaaacggcgauucaggcccacuacaaggucugucaggcuacccaucgcuucagagaggaucugaaaaagacagugacaccccagaauaucgggccuggcugcuaucggacccucaaccuguuuagauacaaaucucgcuguuauauucugaccauguggacgcuucuccugaucauugagagcauccugugggccgcuuccgccgcggaaaucccccucgugccgcuguggaccgacaaugcccacggaguuggcagcgucccuaugcauacagaccuugagcuggauuucucucuccccuccagcucuaaguacaccuauaagcggcaccugacaaacccugugaaugaccaacaguccgugagccugcacauugaaaucgagucucaggggauuggagcugauguccaucaccuuggccauugguacgacgccagacucaaccugaaaaccagcuuucacugcuacggggcuuguacgaaguaucaguaccccuggcacacagccaaaugccauuucgaaaaggauuaugaguacgagaacuccugggccuguaauccucccgacugcccgggagugggcaccgggugcacagcuuguggccuguaucucgaucaacugaaaccuguuggaaccgcguuuaagaucauuagcgugcgcuacucucggaaggucugcgugcaguucggcgaagaguaucuuuguaaaaccaucgacaugaacgauugcuuuguuacaagacacgccaagaucuguauuaucgggacgguguccaaauucagccagggagacacccugcucuuucugggccccauggaagggggaggcauuaucuucaagcauuggugcacauccaccugucacuuuggggaucccggcgacgucaugggaccuaaagacaagccguucauuugccccgaguuuccuggccaguuccgcaaaaaguguaauuucgcuacaacccccgugugcgaauacgaugggaacaucauuucuggauacaagaaaguucuggccacgaucgacagcuuucaauccuucaauacaucuaacauccauuuuaccgaugagcggauugaguggagagacccugauggcaugcuucgcgaccacaucaauauugugaucagcaaggauauugacuucgaaaaccucgccgagaaucccuguaaagucgggcugcaggcugccaacaucgaaggagcguggggcuccggggugggcuuuacccugacaugccaggugucucucaccgagugcccuacauuccugacgagcaucaaggcuugugauauggccauuugcuauggagccgaauccgucacccuuagccggggccaaaauacaguuaaaaucaccgggaagggaggccacucuggguccagcuuuaaguguugccauggaaaagaguguucuuccacaggccugcaggcuagcgcgccccaccucgacaaggugaacggcauuucugagcuggaaaaugagaaaguguacgaugacggggccccggaaugcggagucaccuguugguucaagaaauccggcgagugggugauggggaucauuaacggaaauuggguugugcugaucguccuuugcgugcuccugcuguuuagccucauccugcuuuccauucuguguccuguuagaaagcauaagaaaagcuga

SEQ ID NO: 13491 - RNA, 3402 nt, Artificial Sequence
  derived and/or modified CDS sequence (opt5) from SEOV(HBT14)__KM233658.1__GP
auguggagccuccuguuccuggccgcucuugugggccagggguuugcccugaagaacgucuucgacaugagaauccaaugcccccacuccguuaauuuuggagagaccucugugagcggcuacacagggcucccuccgcugucccuucaggaagcggagcagcuggugcccgaaucuagcuguaacauggauaaucaucagucccucucuauuaucaacaaacugacgaaggucauuuggcggaaaaaggcuaaucaagagagcgccaaccagaauagcuucgaagugguugagagcgaggugucuuuuaaaggacugugcaugcucaagcaccgcauggucgaagaguccuauagaaaccggcgcagcgugaucuguuacgaccuggccugcaauucuaccuucuguaagccuacaguuuauaugauugugcccauccaugcuugcaacaugaugaaauccugucuuaucggccuggggccuuaccggauucaggucguguaugaaagaaccuacugcacaaccggaauccucacagagggcaaguguuuugugcccgauaaagccgucguuagcgcucugaagcgcggcauguaugccauugcgucuaucgagaccauuugcuucuuuauccaccagaaagggaauacguacaagauugugaccgccaucacauccgcuaugggaagcaaguguaacaauaccgacacaaaagugcaaggcuacuauaucugcauuaucgggggaaacuccgccccugucuacgcuccggccggcgaagauuucagagcgauggagguguuuucugggauuaucaccagcccccauggagaagaccacgaucuuccuggcgaggaaauugccacguaucagaucuccggccagaucgaggcuaagauuccccacacaguuagcucuaaaaaucugaagcucaccgccuucgcugggaucccuuccuacagcucuacaagcauucuggccgccuccgaggacggacgguuuaucuucucucccggccuguucccgaaccucaaccagagcgugugcgauaauaacgcucugccucuuauuuggcgcgggcugaucgaccucaccggauauuacgaagcgguccaucccuguaauguguuuugcguucuguccggcccuggggccagcugugaggcuuucucugaaggaggcaucuuuaacauuaccucccccaugugccuugugagcaaacaaaauagauuccgggccgccgagcagcagaucucuuuugucugucaacgcguggauauggacauuaucgucuauugcaacggccagaagaaaacaauucugacgaagacccucgugaucgggcaguguauuuacacaaucaccucccuguucagccugcuccccggaguugcucacuccaucgccauugaacugugcgugccuggcuuucaugggugggcgacagcugcccuucugaucaccuucuguuuuggauggguccucauuccggccugcacgcuggcuauccuucuggugcucaaguucuuugccaauauucugcacacaucuaaccaggagaauagauucaaagcuauccugcggaagaucaaagaggaauuugagaagaccaaaggcagcaugguuugugaaauuugcaaguacgagugcgaaacccucaaggagcugaaagcccacaaccuuuccugugugcaaggggagugccccuauuguuucacacauugcgaaccuaccgagacagcgauccaggcccacuacaaggucugucaggcuacgcaucgcuucagagaagaucugaaaaagaccgugacaccccagaauauuggcccuggaugcuaucggacccucaaccuguuuagauacaaaucucgcuguuauauccugacaauguggacccuucuccugauuaucgagagcauccugugggccgcuuccgccgcggagauuccccucgugccgcuguggacggacaaugcccacggcguugggagcgucccuaugcauaccgaccuugaacuggauuucucucuccccuccagcucuaaguacacauauaagcggcaccugaccaacccugugaaugaccaacaguccgugagccugcacaucgagauugaaucucagggaaucggcgcugauguccaucaccuugggcauugguacgacgccagacucaaccugaaaacauccuuucacugcuacggagcuuguaccaaguaucaguaccccuggcacacggccaaaugccauuucgagaaggauuaugaauacgagaacuccugggccuguaauccucccgacugcccgggcguggggacaggcugcaccgcuuguggacuguaucucgaucaacugaaaccuguuggcacagcguuuaagauuaucagcgugcgcuacucucggaaggucugcgugcaguucggggaggaauaucuuuguaaaaccaucgacaugaacgauugcuuuguuaccagacacgccaagauuuguaucauuggaacaguguccaaauucagccagggcgacacgcugcucuuucuggggcccauggagggaggcgggaucauuuucaagcauuggugcaccuccacaugucacuuuggcgaucccggagacgucaugggcccuaaagacaagccguucaucugccccgaauuuccugggcaguuccgcaaaaaguguaauuucgcuaccacacccgugugcgaguacgauggaaacauuaucucuggcuacaagaaaguucuggccaccaucgacagcuuucaauccuucaauacgucuaacauucauuuuacagaugaacggaucgaguggagagacccugaugggaugcuucgcgaccacauuaauaucgugauuagcaaggauaucgacuucgagaaccucgccgaaaaucccuguaaagucggacugcaggcugccaacaucgagggcgcguggggguccggcgugggauuuacccugaccugccaggugucucucacagaaugcccuaccuuccugacaagcauuaaggcuugugauauggccaucugcuauggcgccgaguccgucacgcuuagccgggggcaaaauaccguuaaaauuacaggaaagggcgggcacucuggauccagcuuuaaguguugccauggcaaagaauguucuuccaccggccugcaggcuagcgcgccccaccucgacaaggugaacgggaucucugagcuggagaaugaaaaaguguacgaugacggagccccggagugcggcgucacauguugguucaagaaauccggggaaugggugaugggaauuaucaacggcaauuggguugugcugaucguccuuugcgugcuccugcuguuuagccucauucugcuuuccauccuguguccuguuagaaagcauaagaaaagcuga

SEQ ID NO: 13492 - RNA, 3402 nt, Artificial Sequence
  derived and/or modified CDS sequence (opt5) from SEOV(HBT-3)__KM233661.1__GP
auguggagccuucucuuccuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaaacugaccaaggucaucuggcggaaaaaggcuaaucaagaaagcgccaaccaaaauuccuucgaggugguugagagcgaagugucuuuuaaagggcugugcaugcucaagcaccgcauggucgaggaauccuauagaaaccggcgcagcgugauuuguuacgaccugccuugcaauucuacauucuguaagcccaccguuuauaugaucgugccuauucaugccugcaacaugaugaaauccugucuuaucggacugggccccuacagaauccaggucguguaugagcggacauacugcaccacagggauucucaccgagggaaaguguuuugugccugauaaagcugucguuagcgcccugaagcgcggcauguaugcuaucgccucuauugaaacgaucugcuucuuuauucaccagaaaggcaauaccuacaagaucgugacagcgauuaccuccgccauggggagcaaguguaacaauacagacaccaaagugcagggauacuauaucugcaucauuggcgggaacuccgcuccggucuacgcccccgcuggagaggauuucagagccauggaaguguuuucuggcaucauuacgagcccucauggggaggaccacgaucuucccggagaagagaucgcgacauaucagauuuccggccagaucgaggccaagaucccucacaccguuagcucuaaaaaucugaagcucacagcuuucgccggcauucccuccuacagcucuaccagcauccuggcugccuccgaagacgggcgguuuauuuucucuccgggacuguucccuaaccucaaccagagcgugugcgauaauaacgcccugccccuuaucuggcgcggccugauugaccucaccggguauuacgaggcuguccauccuuguaauguguuuugcguucuguccggacccggcgcgagcugugaagccuucucugaagggggaaucuuuaacaucacaucccccaugugccuugugagcaaacaaaauagauuccgggcugccgagcagcagauuucuuuugucugucaacgcguggauauggacaucauugucuauugcaacggccagaagaaaacgauccugaccaagacacucgugauuggccaguguaucuacaccauuacaucccuguucagccugcucccugggguugcccacuccaucgcuaucgagcugugcgugccgggauuucauggcugggccaccgcggcucugcugauuacguucuguuuuggguggguccucauccccgccugcacacuggccauucuucuggugcucaaguucuuugcuaauauccugcacaccucuaaccaggagaauagauucaaagccauucugcggaagaucaaagaagaguuugaaaagaccaaaggaagcaugguuugugagaucugcaaguacgaaugcgagacauucaaggagcucaaagcucacaaccuguccugugugcaaggcgaaugcccuuauuguuucacccauugcgagcccacagaaacggccauucaggcgcacuacaaggucugucaggccacccaucgcuuuagagaggaucuuaaaaagacagugaccccucagaauaucgggcccggcugcuaucggacacugaaccucuucagauacaaaucucgcuguuauauucugaccauguggacgcugcuucucaucauugagagcauccugugggcugccuccgcugccgaaaucccgcuggugccucucuggaccgacaaugcgcacggaguuggcagcguccccaugcauacagaccuggagcuugauuuuucucugccuuccagcucuaaguacaccuauaagcggcaccucacaaaccccgugaaugaccaacaguccgugagccugcacauugaaaucgagucucaggggauuggagccgauguccaucaccugggccauugguacgacgcuagacuuaaccucaaaaccagcuuccacugcuacggggccuguacgaaguaucaguacccuuggcacacagcuaaaugccauuuugaaaaggauuaugaguacgagaacuccugggccuguaaucccccggacugcccuggagugggcaccgggugcacagccuguggccuguaucuggaucaacucaaacccguuggaaccgcuuucaagaucauuagcgugcgcuacucucggaaggucugcgugcaguuuggcgaagaguaucuguguaaaaccaucgacaugaacgauugcuucguuacaagacacgcgaagaucuguauuaucgggacgguguccaaauuuagccagggagacacccuucuguuccucggccccauggaagggggaggcauuaucuuuaagcauuggugcacauccaccugucacuucggggauccuggcgacgucaugggaccgaaagacaagcccuuuauuugcccugaguuccccggccaguuccgcaaaaaguguaauuuugccacaaccccugugugcgaauacgaugggaacaucauuucuggauacaagaaaguucuggcuacgaucgacagcuuccaauccuuuaauacaucuaacauccauuucaccgaugagcggauugaguggagagaccccgauggcaugcugcgcgaccacaucaauauugugaucagcaaggauauugacuuugaaaaccuugccgagaauccuuguaaagucgggcuccaggccgcuaacaucgaaggagccuggggcuccggggugggcuucacccugacaugccaggugucucugaccgagugccccacauuucucacgagcaucaaggcgugugauauggcuauuugcuauggagccgaauccgucacccugagccggggccaaaauacaguuaaaaucaccgggaagggaggccacucuggguccagcuucaaguguugccauggaaaagaguguucuuccacaggccuucaggccagcgcuccgcaccuggacaaggugaacggcauuucugagcucgaaaaugagaaaguguacgaugacggggccccugaaugcggagucaccuguugguuuaagaaauccggcgagugggugauggggaucauuaacggaaauuggguugugcugaucguccugugcgugcuucuccuguucagccugauccuccuguccauucuuugucccguuagaaagcauaagaaaagcuga

SEQ ID NO: 13493 - RNA, 3402 nt, Artificial Sequence
  derived and/or modified CDS sequence (opt5) from SEOV(HBT49)__KM233659.1__GP
auguggagccuccuguuccuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaaacugaccaaggucaucuggcggaaaaaggcuaaucaagaaagcgccaaccaaaauuccuucgaggugguugagagcgaagugucuuuuaaagggcugugcaugcucaagcaccgcauggucgaggaauccuauagaaaccggcgcagcgugauuuguuacgaccuggccugcaauucuacauucuguaagccuaccguuuauaugaucgugcccauucaugcuugcaacaugaugaaauccugucuuaucggacugggcccuuacagaauccaggucguguaugagcggacauacugcaccacagggauucucaccgagggaaaguguuuugugcccgauaaagccgucguuagcgcucugaagcgcggcauguaugccaucgcgucuauugaaacgaucugcuucuuuauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuucagagcgauggaaguguuuucuggcaucauuacgagcccccauggggaggaccacgaucuuccuggagaagagaucgccacauaucagauuuccggccagaucgaggcuaagaucccccacaccguuagcucuaaaaaucugaagcucacagccuucgcuggcauuccuuccuacagcucuaccagcauccuggccgccuccgaagacgggcgguuuauuuucucucccggacuguucccgaaccucaaccagagcgugugcgauaauaacgcucugccucuuaucuggcgcggccugauugaccucaccggguauuacgaggcgguccaucccuguaauguguuuugcguucuguccggaccuggcgccagcugugaggcuuucucugaagggggaaucuuuaacaucacaucccccaugugccuugugagcaaacaaaauagauuccgggccgccgaacagcagauuucuuuugucugucaacgcguggauauggacaucauugucuauugcaacggccagaagaaaacgauccugaccaagacacucgugauuggccaguguaucuacaccauuacaucccuguucagccugcuccccgggguugcucacuccaucgccaucgagcugugcgugccuggauuucauggcugggcgaccgcugcccuucugauuacguucuguuuuggguggguccucaucccggccugcacacuggcuauucuucuggugcucaaguucuuugccaauauccugcacaccucuaaccaggagaauagauucaaagcuauucugcggaagaucaaagaagaguuugaaaagaccaaaggaagcaugguuugugagaucugcaaguacgaaugcgagacacucaaggagcugaaagcccacaaccuuuccugugugcaaggcgaaugccccuauuguuucacccauugcgagccuacagaaacggcgauucaggcccacuacaaggucugucaggcuacccaucgcuucagagaggaucugaaaaagacagugacaccccagaauaucgggccuggcugcuaucggacccucaaccuguuuagauacaaaucucgcuguuauauucugaccauguggacgcuucuccugaucauugagagcauccugugggccgcuuccgccgcggaaaucccccucgugccgcuguggaccgacaaugcccacggaguuggcagcgucccuaugcauacagaccuugagcuggauuucucucuccccuccagcucuaaguacaccuauaagcggcaccugacaaacccugugaaugaccaacaguccgugagccugcacauugaaaucgagucucaggggauuggagcugaugucuaccaucuuggccacugguacgacgccagacucaaccugaaaaccagcuuucauugcuauggggcuuguacgaaguaccaguaucccuggcacacagccaaaugccacuucgaaaaggauuacgaguaugagaacuccugggccuguaauccucccgacugcccgggagugggcaccgggugcacagcuuguggccuguaccucgaucaacugaaaccuguuggaaccgcguuuaagaucauuagcgugcgcuauucucggaaggucugcgugcaguucggcgaagaguaccuuuguaaaaccaucgacaugaacgauugcuuuguuacaagacaugccaagaucuguauuaucgggacgguguccaaauucagccagggagacacccugcucuuucugggccccauggaagggggaggcauuaucuucaagcacuggugcacauccaccugucauuuuggggaucccggcgacgucaugggaccuaaagacaagccguucauuugccccgaguuuccuggccaguuccgcaaaaaguguaauuucgcuacaacccccgugugcgaauacgaugggaacaucauuucuggauauaagaaaguucuggccacgaucgacagcuuucaauccuucaauacaucuaacauccacuuuaccgaugagcggauugaguggagagacccugauggcaugcuucgcgaccauaucaauauugugaucagcaaggauauugacuucgaaaaccucgccgagaaucccuguaaagucgggcugcaggcugccaacaucgaaggagcguggggcuccggggugggcuuuacccugacaugccaggugucucucaccgagugcccuacauuccugacgagcaucaaggcuugugauauggccauuugcuacggagccgaauccgucacccuuagccggggccaaaauacaguuaaaaucaccgggaagggaggccacucuggguccagcuuuaaguguugccacggaaaagaguguucuuccacaggccugcaggcuagcgcgccccaucucgacaaggugaacggcauuucugagcuggaaaaugagaaaguguaugaugacggggccccggaaugcggagucaccuguugguucaagaaauccggcgagugggugauggggaucauuaacggaaauuggguugugcugaucguccuuugcgugcuccugcuguuuagccucauccugcuuuccauucuguguccuguuagaaagcacaagaaaagcuga

SEQ ID NO: 13494 - RNA, 3402 nt, Artificial Sequence
  derived and/or modified CDS sequence (opt5) from SEOV(HBT50)__KM233660.1__GP
auguggagccuccuguuccuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaaacugaccaaggucaucuggcggaaaaaggcuaaucaagaaagcgccaaccaaaauuccuucgaggugguugagagcgaagugucuuuuaaagggcugugcaugcucaagcaccgcauggucgaggaauccuauagaaaccggcgcagcgugauuuguuacgaccuggccugcaauucuacauucuguaagccuaccguuuauaugaucgugcccauucaugcuugcaacaugaugaaauccugucuuaucggacugggcccuuacagaauccaggucguguaugagcggacauacugcaccacagggauucucaccgagggaaaguguuuugugcccgauaaagccgucguuagcgcucugaagcgcggcauguaugccaucgcgucuauugaaacgaucugcuucuuuauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuucagagcgauggaaguguuuucuggcaucauuacgagcccccauggggaggaccacgaucuuccuggagaagagaucgccacauaucagauuuccggccagaucgaggcuaagaucccccacaccguuagcucuaaaaaucugaagcucacagccuucgcuggcauuccuuccuacagcucuaccagcauccuggccgccuccgaagacgggcgguuuauuuucucucccggacuguucccgaaccucaaccagagcgugugcgauaauaacgcucugccucuuaucuggcgcggccugauugaccucaccggguauuacgaggcgguccaucccuguaauguguuuugcguucuguccggaccuggcgccagcugugaggcuuucucugaagggggaaucuuuaacaucacaucccccaugugccuugugagcaaacaaaauagauuccgggccgccgaacagcagauuucuuuugucugucaacgcguggauauggacaucauugucuauugcaacggccagaagaaaacgauccugaccaagacacucgugauuggccaguguaucuacaccauuacaucccuguucagccugcuccccgggguugcucacuccaucgccaucgagcugugcgugccuggauuucauggcugggcgaccgcugcccuucugauuacguucuguuuuggguggguccucaucccggccugcacacuggcuauucuucuggugcucaaguucuuugccaauauccugcacaccucuaaccaggagaauagauucaaagcuauucugcggaagaucaaagaagaguuugaaaagaccaaaggaagcaugguuugugagaucugcaaguacgaaugcgagacacucaaggagcugaaagcccacaaccuuuccugugugcaaggcgaaugccccuauuguuucacccauugcgagccuacagaaacggcgauucaggcccacuacaaggucugucaggcuacccaucgcuucagagaggaucugaaaaagacagugacaccccagaauaucgggccuggcugcuaucggacccucaaccuguuuagauacaaaucucgcuguuauauucugaccauguggacgcuucuccugaucauugagagcauccugugggccgcuuccgccgcggaaaucccccucgugccgcuguggaccgacaaugcccacggaguuggcagcgucccuaugcauacagaccuugagcuggauuucucucuccccuccagcucuaaguacaccuauaagcggcaccugacaaacccugugaaugaccaacaguccgugagccugcacauugaaaucgagucucaggggauuggagcugauguccaucaccuuggccauugguacgacgccagacucaaccugaaaaccagcuuucacugcuacggggcuuguacgaaguaucaguaccccuggcacacagccaaaugccauuucgaaaaggauuaugaguacgagaacuccugggccuguaauccucccgacugcccgggagugggcaccgggugcacagcuuguggccuguaucucgaucaacugaaaccuguuggaaccgcguuuaagaucauuagcgugcgcuacucucggaaggucugcgugcaguucggcgaagaguaucuuuguaaaaccaucgacaugaacgauugcuuuguuacaagacacgccaagaucuguauuaucgggacgguguccaaauucagccagggagacacccugcucuuucugggccccauggaagggggaggcauuaucuuccgccauuggugcacauccaccugucacuuuggggaucccggcgacgucaugggaccuaaggacaaaccguucauuugccccgaguuuccuggccaguuccggaagaaauguaauuucgcuacaacccccgugugcgaauacgaugggaacaucauuucuggauacaagaagguucuggccacgaucgacagcuuucaauccuucaauacaucuaacauccauuuuaccgaugagagaauugaguggcgcgacccugauggcaugcuucgggaccacaucaauauugugaucagcaaagauauugacuucgaaaaccucgccgagaaucccuguaaggucgggcugcaggcugccaacaucgaaggagcguggggcuccggggugggcuuuacccugacaugccaggugucucucaccgagugcccuacauuccugacgagcaucaaggcuugugauauggccauuugcuauggagccgaauccgucacccuuagcagaggccaaaauacaguuaagaucaccgggaaaggaggccacucuggguccagcuuuaaguguugccauggaaaggaguguucuuccacaggccugcaggcuagcgcgccccaccucgacaaagugaacggcauuucugagcuggaaaaugagaagguguacgaugacggggccccggaaugcggagucaccuguugguucaaaaaguccggcgagugggugauggggaucauuaacggaaauuggguugugcugaucguccuuugcgugcuccugcuguuuagccucauccugcuuuccauucuguguccuguucgcaaacauaaaaagagcuga

SEQ ID NO: 13495 - RNA, 3402 nt, Artificial Sequence
  derived and/or modified CDS sequence (opt5) from SEOV(HuludaoRn101)__GU592923.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucguguggcggaaaaaggcuaaucaagaaagcgccaaccagaauagcuuugagguuguggagagcgaagucucuuucaaagggcucugcaugcugaagcaccgcaugguggaggaauccuauagaaaccggcgcagcguuaucuguuacgaccuugccugcaauucuacauuuuguaagccuaccguguauaugauuguccccauccaugcuugcaacaugaugaaauccugucugauuggacucggcccuuacagaauccaggugguguaugagcggacauacugcaccacagggauccugaccgagggaaaguguuucguccccgauaaagccguugugagcgcucuuaagcgcggcauguaugccauugcgucuaucgaaacgauuugcuuuuucauccaccagaaaggcaauaccuacaagauugugacagccaucaccuccgcuauggggagcaaguguaacaauacagacaccaaaguccaaggauacuauauuugcaucaucggcgggaacuccgccccuguguacgcuccggccggagaggauuuuagagcgauggaaguuuucucuggcauuaucacgagcccccauggggaggaccacgaucugccuggagaagagauugccacauaucagaucuccggccagauugaggcuaagaucccccacaccgugagcucuaaaaaucucaagcugaucgccuuugcuggcauuccuuccuacagcucuacaagcauccuggccgccuccgaagacucucgguucauuuuuagccccgggcuguucccgaaccugaaccaguccgucugcgauaauaacgcgcuuccucugaucuggcgcggacucauugaccugaccggcuauuacgagaccgugcaucccuguaauguuuucugcgugcuuagcgggccuggagcuucuugugaagccuuuuccgagggcgggaucuucaacaucacaagccccaugugccuggucucuaaacaaaauagauuucgggcugccgaacagcagauuuccuucaucugucaacgcguggauauggacauuaucgucuauugcaacggacagaagaaaacgauucucaccaagacacuggugaucggccaguguauuuacaccaucacaagccuguuuucccuccugcccggcguugcccacucuaucgcuauugagcuuugcgugccuggguuccauggaugggccaccgcggcucugcucaucacguuuuguuucggcuggguccugauuccggccugcacacuugccauccugcucgugcugaaguuuuucgcuaauauucugcacaccagcaaccaggagaauagauuuaaagccauccuccggaagaucaaagaagaguucgaaaagaccaaaggguccaugguuugugagauuugcaaguacgaaugcgagacacugaaggagcuuaaagcucacaaccugucuugugugcaaggagaaugccccuauuguuuuacccauugcgagccuacagaaacggccauccaggcgcacuacaaggucugucaggccacccaucgcuucagagaggaucucaaaaagacagugacaccccagaauauuggcccugggugcuaucggacccugaaccuguucagauacaaaagccgcuguuauauccuuaccauguggacgcuccugcugauuaucgaguccauccucugggcugccagcgcugccgaaauuccccuggugccgcuuuggaccgacaaugcgcacggcguuggaucuaucccuaugcauacagaccuggagcucgauuuuucccugcccuccucuuccaaguacaccuauaagcggcaccugacaaacccugucaaugaccaacagagcgugucucuucacauugaaaucgagagccagggcauuggggccgaugugcaucaccucggacauugguacgacgcuagacugaaccugaaaaccuccuuccacugcuacggcgccuguacgaaguaucaguaccccuggcacacagcuaaaugccauuuugaaaaggauuaugaguacgagaacagcugggccuguaauccucccgacugcccgggggucggaaccggcugcacagccugugggcucuaucuggaucaacuuaaaccugugggcaccgcuuucaagaucaucucuguucgcuacucccggaaggugugcguccaguuuggagaagaguaucuguguaaaaccauugacaugaacgauugcuucgugacaagacacgcgaagaucuguauuaucggcacgguuagcaaauuuucccagggggacacccuccuguuccugggacccauggaaggcgggggaauuaucuuuaagcauuggugcacaucuaccugucacuucggcgaucccggggacgugaugggcccuaaagacaagccguuuauuugccccgaguucccuggacaguuucgcaaaaaguguaauuucgccacaacccccaucugcgaauacgauggcaacaucauuagcggguacaagaaaguccuugcuacgaucgacuccuuccaaucuuuuaauacaagcaacauucauuucaccgaugagcggaucgaguggagagacccugauggaaugcuccgcgaccacauuaaugugguuaucuccaaggauaucgacuuugaaaaccuggccgagaaucccuguaaagugggccugcaggccgcuaacauugaaggggccuggggaucuggcgucggguucacccucacaugccaggugagccugaccgagugcccuacauuucuuacguccaucaaggcgugugauauggcuauuugcuauggcgccgaaagcgugacccugucucggggacaaaauacagucagaaucaccggcaaagggggacacuccggcagcucuuucaaguguugccaugggaaggaguguuccagcacaggacuccaggccucugcuccccaccuggacaaaguuaacggcauuuccgagcuggaaaaugagaagguguacgaugacggcgccccggaaugcggggugaccuguugguuuaaaaagagcggagagugggucaugggcaucaucaacgggaauugggugguucuuauugugcucugcguccugcuccucuucucccugauccuucugagcauucucuguccugugcgcaaacauaagaagucuuga

SEQ ID NO: 13496 - RNA, 3402 nt, Artificial Sequence
  derived and/or modified CDS sequence (opt5) from SEOV(Humber)__JX879768.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucgugcaccagaaaggcaauaccuacaagauugugacagccaucaccuccgcuauggggagcaaguguaacaauacagacaccaaaguccagggauacuauauuugcaucaucggcgggaacuccgccccuguguacucuccggcuggagaggauuuuagagccauggaaguuuucagcggcauuaucacgagcccccauggggaggaccacgaucugccuggagaagagauugcgacauaucagaucagcggccagauugaggccaagaucccccacaccgugucuuccaaaaaucucaagcugacagcuuuugccggcaucccuagcuacucuagcaccuccauucuggcugccucugaagacgggcgguucaucuuuagccccggacucuucccgaaccugaaccaguccgucugcgauaauaacgcccuuccucugauuuggcgcggccucaucgaccugaccggguauuacgaggcugugcaucccuguaauguuuucugcgugcuuagcggaccuggcgcgucuugugaagccuuuuccgaagggggaauuuucaacaucacaagccccaugugccuggucucuaaacaaaauagauuucgggcugccgagcagcagaucuccuucauuugucaacgcguggauauggacaucauugucuauugcaacggccagaagaaaacgauccucaccaagacacuggugauuggccaguguaucuacaccauuacaagccuguuuucccuccugcccgggguugcccacucuaucgcuaucgagcuuugcgugccuggauuccauggcugggccaccgcggcucugcucauuacguuuuguuucggguggguccugaucccggccugcacacuugccgugcugcucguucugaaguuuuucgcuaauauucugcacaccagcaaccaggagaauagauuuaaagccauccuccggaagauuaaagaagaguucgaaaagaccaaaggauccauggugugugagaucugcaaguacgaaugcgagacacugaaggagcuuaaagcucacaaccugucuuguauccaaggcgaaugccccuauuguuuuacccauugcgagccuacagaaacggccauucaggcgcacuacaaggucugucaggccacccaucgcuucagagaggaucucaaaaagacagugacacccccuaauaucgggcccggcugcuaucggacccugaaccuguucagauacaaaagccgcuguuauauucuuaccauguggacgcuccugcugaucauugaguccauccucugggcugccagcgcugccgaaaucccgcuggugccucuuuggaccgacaaugcgcacggaguuggcucuguccccaugcauacagaccuggagcucgauuuuucccugccuuccucuuccaaguacaccuauaagcggcaccugacaaaccccgugaaugaccagcaaagcgugucucuucacauugaaaucgagagccaggggauuggagccgauguccaucaccucggccauugguacgacgcuagacugaaccugaaaaccuccuuccacugcuacggggccuguacgaaguaucaguacccuuggcacacagcuaaaugccauuuugaaaaggauuaugaguacgagaacagcugggccuguaaucccccggacugcccuggagugggcaccgggugcacagccuguggccucuaucuggaucagcuuaaacccguuggaaccgcuuucaagaucauuucugugcgcuacucccggaaggucugcgugcaauuuggcgaagaguaucuguguaaaaccaucgacaugaacgauugcuucguuacaagacacgcgaagaucuguauuaucgggacggugagcaaauuuucccagggagacacccuccuguuccugggccccauggaagggggaggcauuaucuuuaagcauuggugcacaucuaccugucacuucggggauccuggcgacgucaugggaccgaaagacaagcccuuuauuugcccugaguuccccggccaguuucgcaaaaaguguaauuucgccacaaccccugugugcgaauacgaugggaacaucauuagcggauacaagaaaguucuugcuacgaucgacuccuuccagucuuuuaauacaagcaacauccauuucaccgaugagcggauugaguggagagaccccgauggcaugcuccgcgaccacaucaauauuaucauuuccaaggauaucgacuuugaaaaccuggccgagaauccuuguaaaguggggcugcaagccgcuaacaucgaaggagccuggggcucuggggucggcuucacccucacaugccaggugagccugaccgagugccccacauuucuuacguccauuaaggcgugugauauggcuaucugcuauggagccgaaagcgugacccugucucggggccagaauacagucaaaauuaccgggaagggaggccacuccgggagcucuuucaaguguugccauggaaaagaguguuccagcaacggccuccaagccucugcuccgcaccuggacaagguuaauggcaucuccgagcuggaaaacgagaaaguguacgaugacggggccccugaaugcggagugacauguugguuuaagaaaagcggcgagugggucauggggauuaucaauggaaacugggugguucuuaucgugcucugcguccugcuccuguucucccugauucuucugagcauccucugucccgugagaaagcauaagaaaucuuga

SEQ ID NO: 13497 - RNA, 3402 nt, Artificial Sequence
  derived and/or modified CDS sequence (opt5) from SEOV(Humber)__KM948597.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucgugcaccagaaaggcaauaccuacaagauugugacagccaucaccuccgcuauggggagcaaguguaacaauacagacaccaaaguccagggauacuauauuugcaucaucggcgggaacuccgccccuguguacucuccggcuggagaggauuuuagagccauggaaguuuucagcggcauuaucacgagcccccauggggaggaccacgaucugccuggagaagagauugcgacauaucagaucagcggccagauugaggccaagaucccccacaccgugucuuccaaaaaucucaagcugacagcuuuugccggcaucccuagcuacucuagcaccuccauucuggcugccucugaagacgggcgguucaucuuuagccccggacucuucccgaaccugaaccaguccgucugcgauaauaacgcccuuccucugauuuggcgcggccucaucgaccugaccggguauuacgaggcugugcaucccuguaauguuuucugcgugcuuagcggaccuggcgcgucuugugaagccuuuuccgaagggggaauuuucaacaucacaagccccaugugccuggucucuaaacaaaauagauuucgggcugccgagcagcagaucuccuucauuugucaacgcguggauauggacaucauugucuauugcaacggccagaagaaaacgauccucaccaagacacuggugauuggccaguguaucuacaccauuacaagccuguuuucccuccugcccgggguugcccacucuaucgcuaucgagcuuugcgugccuggauuccauggcugggccaccgcggcucugcucauuacguuuuguuucggguggguccugaucccggccugcacacuugccgugcugcucguucugaaguuuuucgcuaauauucugcacaccagcaaccaggagaauagauuuaaagccauccuccggaagauuaaagaagaguucgaaaagaccaaaggauccauggugugugagaucugcaaguacgaaugcgagacacugaaggagcuuaaagcucacaaccugucuuguauccaaggcgaaugccccuauuguuuuacccauugcgagccuacagaaacggccauucaggcgcacuacaaggucugucaggccacccaucgcuucagagaggaucucaaaaagacagugacacccccuaauaucgggcccggcugcuaucggacccugaaccuguucagauacaaaagccgcuguuauauucuuaccauguggacgcuccugcugaucauugaguccauccucugggcugccagcgcugccgaaaucccgcuggugccucuuuggaccgacaaugcgcacggaguuggcucuguccccaugcauacagaccuggagcucgauuuuucccugccuuccucuuccaaguacaccuauaagcggcaccugacaaaccccgugaaugaccagcaaagcgugucucuucacauugaaaucgagagccaggggauuggagccgauguccaucaccucggccauugguacgacgcuagacugaaccugaaaaccuccuuccacugcuacggggccuguacgaaguaucaguacccuuggcacacagcuaaaugccauuuugaaaaggauuaugaguacgagaacagcugggccuguaaucccccggacugcccuggagugggcaccgggugcacagccuguggccucuaucuggaucagcuuaaacccguuggaaccgcuuucaagaucauuucugugcgcuacucccggaaggucugcgugcaauuuggcgaagaguaucuguguaaaaccaucgacaugaacgauugcuucguuacaagacacgcgaagaucuguauuaucgggacggugagcaaauuuucccagggagacacccuccuguuccugggccccauggaagggggaggcauuaucuuuaagcauuggugcacaucuaccugucacuucggggauccuggcgacgucaugggaccgaaagacaagcccuuuauuugcccugaguuccccggccaguuucgcaaaaaguguaauuucgccacaaccccugugugcgaauacgaugggaacaucauuagcggauacaagaaaguucuugcuacgaucgacuccuuccagucuuuuaauacaagcaacauccauuucaccgaugagcggauugaguggagagaccccgauggcaugcuccgcgaccacaucaauauuaucauuuccaaggauaucgacuuugaaaaccuggccgagaauccuuguaaaguggggcugcaagccgcuaacaucgaaggagccuggggcucuggggucggcuucacccucacaugccaggugagccugaccgagugccccacauuucuuacguccauuaaggcgugugauauggcuaucugcuauggagccgaaagcgugacccugcuccggggccagaauacagucaaaauuaccgggaagggaggccacucuggguccagcuucaaguguugccauggaaaagaguguucuuccaacggccugcaagccagcgcuccgcaccuggacaagguuaauggcaucucugagcuugaaaacgagaaaguguacgaugacggggccccugaaugcggagugacauguugguuuaagaaauccggcgagugggucauggggauuaucaauggaaacugggugguucucaucgugcugugcguccugcuccuguucagccuuauucugcucuccauccugugucccgugagaaagcauaagaaaagcuga

SEQ ID NO: 13498 - RNA, 3402 nt, Artificial Sequence
  derived and/or modified CDS sequence (opt5) from SEOV(K24-e7)__AF288652.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucguguggcggaaaaaggcuaaucaagaaagcgccaaccaaaauuccuuugagguuguggagagcgaagucucuuucaaagggcucugcaugcugaagcaccgcaugguggaggaauccuauagaaaccggcgcagcguuaucuguuacgaccuugccugcaauucuacauuuuguaagccuaccguguauaugauuguccccauccaugcuugcaacaugaugaaauccugucugauuggacucggcccuuacagaauccaggugguguaugagcggacauacugcaccacagggauccugaccgagggaaaguguuucguccccggcaaagccguugugagcgcucuuaagcgcggcauguaugccauugcgucuaucgaaacgauuugcuuuuucauccaccagaaagggaauaccuacaagauugugacagccaucaccuccgcuaugggaagcaaguguaacaauacagauaccaaaguccagggcuacuauauuugcaucaucgggggaaacuccgccccuguguacgcuccggccggcgaggacuuuagagcgauggaaguuuucucugggauuaucacgagcccccauggagaggaucacgaccugccuggcgaagagauugccacauaucagaucuccggccagauugaggcuaagaucccccacaccgugagcucuaaaaaucucaagcugaucgccuuugcugggauuccuuccuacagcucuacaagcauccuggccgccuccgaagauggacgguucauuuuuagccccggccucuucccgaaccugaaccagagcgucugcgacaauaacgcucugccucugaucuggcgcgggcucauugaucugaccggauauuacgaggcggugcaucccuguaauguuuucagagugcuuuccggcccuggggccagcugcgaagccuuuucugagggaggcaucuucaacaucaccucccccaugugucuggucagcaaacaaaaucgguuucgcgccgccgaacagcagauuucuuucaucugccaaagaguggacauggauauuaucgucuauuguaacggccagaagaaaacaauucucacgaagacccuggugaucgggcagugcauuuacacaaucaccucccuguuuagccuccugcccggaguugcucacuccaucgccauugagcuuugugugccuggcuuccaugggugggcgacagcugcccugcucaucaccuuuugcuucggauggguccugauuccggccuguacgcuugcuauccugcucgugcugaaguuuuucgccaauauucugcacacaucuaaccaggagaaucgguuuaaagcuauccuccgcaagaucaaagaagaguucgaaaagaccaaaggcagcaugguuugcgagauuuguaaguacgaaugcgagacccugaaggagcuuaaagcccacaaccuguccugcgugcaaggggaaugucccuauugcuuuacacauugugagccuaccgaaacagcgauccaggcccacuacaaggucugccaggcuacgcauagauuccgggaggaccucaaaaagaccgugacaccccagaauauuggcccuggauguuauagaacccugaaccuguuccgcuacaaaucucggugcuauauccuuacaauguggacccuccugcugauuaucgagagcauccucugggccgcuuccgccgcggaaauuccccuggugccgcuuuggacggauaaugcccacggcguugggagcgucccuaugcauaccgaccuggagcucgacuuuucucugcccuccagcucuaaguacacauauaagagacaccugaccaacccugugaaugaucaacaguccgugagccuucacaucgaaauugagucucagggaaucggcgcugacguccaucaccucgggcauugguacgaugcccgccugaaccugaaaacaucuuuccacuguuacggagcuugcaccaaguaucaguaccccuggcacacggccaaaugucauuuugaaaaggacuaugaguacgagaacuccugggccugcaauccucccgauuguccgggcguggggacaggcugcaccgcuugcggacucuaucuggaccaacuuaaaccuguuggcacagcguucaagauuaucagcgugcgguacucuagaaaggucuguaugcaguuuggggaagaguaucugugcaaaaccaucgauaugaacgacuguuucgugacccgccacgccaagauuugcaucauuggaacaguuuccaaauuuagccagggcgauacgcuccuguuccuggggcccauggaaggaggcgggaucauuuuuaagcauugguguaccuccacaugccacuucggcgaccccggagaugugaugggcccuaaagacaagccguuuaucugucccgaguucccugggcaguuucggaaaaagugcaauuucgcuaccacacccauuugugaauacgacggaaacaucaucucuggcuacaagaaaguccuugccaccauugauagcuuccaauccuuuaauacgucuaacauccauuucacagacgagagaauugaguggcgcgauccugacgggaugcuccgggaucacaucaauauugugaucagcaaggacaucgauuuugaaaaccuggccgagaaucccugcaaaguuggacugcaggcugccaacauugaaggcgcguggggguccggcgugggauucacccucaccugucaggucucucugacagagugcccuaccuuucuuacaagcaucaaggcuugcgacauggccauuuguuauggcgccgaauccgugacgcugagcagagggcaaaauaccgugcgcaucacaggacggggcgggcacucuggauccagcuucaaaugcugucauggcaaggaguguucuuccaccggccuccaggcuagcgcuccccaccuggauaaggucaacgggauuucugagcuggaaaaugagaaaguuuacgacgauggagcgccggaaugcggcgugacaugcugguuuaagaaauccggggagugggugaugggaaucaucaacggcaauugggucgugcuuauuguucucugugugcugcuucucuucagccugauccuucuguccauucucugcccugucagaaagcauaaaaagagcuga

SEQ ID NO: 13499 - RNA, 3402 nt, Artificial Sequence
  derived and/or modified CDS sequence (opt5) from SEOV(K24-v2)__AF288654.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucguguggcggaaaaaggcuaaucaagaaagcgccaaccagaauagcuuugagguuguggagagcgaagucucuuucaaagggcucugcaugcugaagcaccgcaugguggaggaauccuauagaaaccggcgcagcguuaucuguuacgaccuugccugcaauucuacauuuuguaagccuaccguguauaugauuguccccauccaugcuugcaacaugaugaaauccugucugauuggacucggcccuuacagaauccaggugguguaugagcggacauacugcaccacagggauccugaccgagggaaaguguuucguccccgauacggccguugugagcgcucuuaaacgcggcauguaugccauugcgucuaucgaaaccauuugcuuuuucauccaccagaagggcaauacauacaaaauugugaccgccaucacauccgcuauggggagcaaguguaacaauaccgacacgaagguccaaggauacuauauuugcaucaucggcgggaacuccgccccuguguacgcuccggccggagaggauuuuagagcgauggaaguuuucucuggcauuaucacaagcccccauggggacgaucacgaccugccuggagaggaaauugcccccuaucagaucuccggccagauugaggcuaaaaucccucacaccgugagcucuaagaaucucaaacugaucgccuuugcuggcauucccuccuacagcucuacaagcauccuggccgccuccgaggaugggcgguucauuuucucuccgggacucuucccuaaccugaaccagagcgucugcgacaauaacgcgcuuccccugaucuggcgcggccucauugaucugaccggguauuacgaagcugugcauccuuguaauguuuucugcgugcuuuccggacccggcgccagcugugaggcuuuuucugaagggggaaucuucaacaucaccucccccaugugccuggucagcaagcaaaauagauuucgggccgccgagcagcagauuucuuucaucugucaacgcguggacauggauauuaucgucuauugcaacgaccagaaaaagacaauucucacgaaaacccuggugaucggccaguguauuuacacaaucaccucccuguuuagccuccugccuggcguugcucacuccaucgccauugaacuuugcgugccgggguuccauggaugggcgacagcugcccugcucaucaccuuuuguuucggcuggguccugauucccgccugcacgcuugcuauccugcucgugcugaaguuuuucgccaauauucugcacacaucuaaccaggagaauagauuuaaggcuauccuccggaaaaucaaggaggaauuugagaaaaccaaggggagcaugguuugugaaauuugcaaauacgagugcgaaacccugaaggagcuuaaggcccacaaccuguccugugugcaaggagagugcccuuauuguuuuacacauugcgaacccaccgagacagcgauccaggcccacuacaaagucugucaggcuacgcaucgcuucagagaagaccucaagaaaaccgugacaccucagaauauuggccccgggugcuaucggacccugaaccuguucagauacaagucucgcuguuauauccuuacaauguggacccuccugcugauuaucgagagcauccucugggccgcuuccgccgcggagauuccgcuggugccucuuuggacggauaaugcccacggcguuggaagcguccccaugcauaccgaccuggaacucgauuuuucucugccuuccagcucuaaauacacauauaagcggcaccugaccaaccccgugaaugaccaacaguccgugagccuucacaucgagauugaaucucagggcaucggggcugauguccaucaccucggacauugguacggcgccagacugaaccugaagacauccuuccacugcuacggggcuuguaccaaauaucaguacccuuggcacacggccaagugccauuuugagaaagacuaugaauacgagaacuccugggccuguaaucccccggauugcccuggagugggcacagggugcaccgcuuguggccucuaucuggaccaacuuaagcccguuggaacagcguucaaaauuaucagcgugcgcuacucucggaaggucugcaugcaguuuggcgaggaauaucuguguaagaccaucgauaugaacgacugcuucgugaccagacacgccaaaauuuguaucauugggacaguuuccaaguuuagccagggagauacgcuccuguuccugggccccauggaagggggaggcaucauuuuuaaacauuggugcaccuccacaugucacuucggggacccuggcgacgugaugggaccgaaggauaaacccuuuaucugcccugaguuccccggccaguuucgcaagaaauguaauuucgcuaccacaccuauuugcgaguacgacgggaacaucaucucuggauacaagaagguccuugccaccauugauagcuuccaauccuuuaauacgucuaacauccauuucacagacgaacggauugaguggagagaucccgacggcaugcuccgcgaucacaucaauauugugaucagcaaagacaucgauuuugagaaccuggccgaaaauccuuguaagguugggcugcaggcugccaacauugagggagcguggggcuccggggugggcuucacccugaccugccaggucucucugacagaaugccccaccuuucuuacaagcaucaaggcuugugacauggccauuugcuauggagccgaguccgugacgcugagccggggccaaaauaccgugagaaucacagggaaaggaggccacucuggguccagcuucaaauguugccauggaaaggaauguucuuccaccggccuccaggcuagcgccccgcaccuggauaaggucaacggcauuucugagcuggagaaugaaaaaguuuacgacgauggggcgccugagugcggagugacauguugguuuaagaaauccggcgaaugggugauggggaucaucaacggaaauugggucgugcuuauuguucucugcgugcugcuccucuucagccugauccuucuguccauucucugucccguccgcaagcauaaaaagagcuga

SEQ ID NO: 13500 - RNA, 3402 nt, Artificial Sequence
  derived and/or modified CDS sequence (opt5) from SEOV(KI-83-262)__D17592.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucauuuuuagccccggacucuucccgaaccugaaccagagcgugugcgauaauaacgcccuuccucugaucuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucauuacguuuuguuucggguggguccugaucccggccugcacacuugcuauucugcucgugcugaaguuuuucgccaauauccugcacaccucuaaccaggagaauagauuuaaagcuauucuccggaagaucaaagaagaguucgaaaagaccaaaggaagcaugguuugugagaucugcaaguacgaaugcgagacacugaaggagcuuaaagcccacaaccuguccugugugcaaggcgaaugccccuauuguuuuacccauugcgagccuacagaaacggcgauucaggcccacuacaaggucugucaggcuacccaucgcuucagagaggaucucaaaaagacagugacaccccagaauaucgggccuggcugcuaucggacccugucucuguucagauacaaaagccgcuguuauauucuuaccauguggacgcuccugcugaucauugaguccauccucugggccgcuagcgccgcggaaaucccccuggugccgcuuuggaccgacaacgcccacggaguuggcucugucccuaugcauacagaccuggagcucgauuuuucccugcccucuucuuccaaguacaccuauaagcggcaccugacaaauccugugaacgaccaacagagcgugucucuucacauugaaaucgagagccaggggauuggagcugauguccaucaccucggccauugguacgacgccagacugaaucugaaaaccuccuuccacugcuacggggcuuguacgaaguaucaguaccccuggcacacagccaaaugccauuuugaaaaggauuaugaguacgagaacagcugggccuguaacccucccgacugcccgggagugggcaccgggugcacagcuuguggccucuaucuggaucaacuuaaaccuguuggaaccgcguucaagaucauuucugugcgcuacucccggaaggucugcgugcaguuuggcgaagaguaucuguguaaaaccaucgacaugaaugauugcuucguuacaagacacgccaagaucuguauuaucgggacggugagcaaauuuucccagggagacacccuccuguuccugggccccauggaagggggaggcauuaucuuuaagcauuggugcacaucuaccugucacuucggggaucccggcgacgucaugggaccuaaagacaagccguuuauuugccccgaguucccuggccaguuucgcaaaaaguguaacuucgcuacaacccccgugugcgaauacgaugggaauaucauuagcggauacaagaaaguucuugccacgaucgacuccuuccaaucuuuuaacacaagcaauauccauuucaccgaugagcggauugaguggagagacccugauggcaugcuccgcgaccacaucaacauugugaucuccaaggauauugacuuugaaaaucuggccgagaaccccuguaaagucgggcugcaggcugccaauaucgaaggagcguggggcucuggggugggcuucacccucacaugccaggugagccugaccgagugcccuacauuucuuacguccaucaaggcuugugauauggccauuugcuauggagccgaaagcgucacccugucucggggccaaaacacaguuaaaaucaccgggaagggaggccacuccgggagcucuuucaaguguugccauggaaaagaguguuccagcacaggccuccaggcuucugcuccccaccuggacaaggugaauggcauuuccgagcuggaaaacgagaaaguguacgaugacggggcgccggaaugcggaaucaccuguugguuuaagaaaagcggcgagugggucauggggauuaucaauggaaacugggugguucuuaucgugcucugcguccugcuccuguucucccugauucuucugagcauccucuguccugugagaaagcauaagaaaucuuga

SEQ ID NO: 13501 - RNA, 3402 nt, Artificial Sequence
  derived and/or modified CDS sequence (opt5) from SEOV(KI-85-1)__D17593.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcgcuuccucugauuuggcgcggccucauugaccugaccggguauuacgaggcuguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucauuacguuuuguuucggguggguccugaucccggccugcacacuugcuauucugcucgugcugaaguuuuucgccaauauccugcacaccucuaaccaggagaauagauuuaaagcuauucuccggaagaucaaagaagaguucgaaaagaccaaaggaagcaugguuugugagaucugcaaguacgaaugcgagacacugaaggagcuuaaagcccacaaccuguccugugugcaaggcgaaugccccuauuguuuuacccauugcgagccuacagaaacggcgauucaggcccacuacaaggucugucaggcuacccaucgcuucagagaggaucucaaaaagacagugacaccccagaauaucgggccuggcugcuaucggacccugaaccuguucagauacaaaucucgcuguuauauucuuaccauguggacgcuccugcugaucauugagagcauccucugggccgcuuccgccgcggaaaucccccuggugccgcuuuggaccgacaaugcccacggaguuggcagcgucccuaugcauacagaccuggagcucgauuuuucucugcccuccagcucuaaguacaccuauaagcggcaccugacaaacccugugaaugaccaacaguccgugagccuucacauugaaaucgagucucaggggauuggagcugauguccaucaccucggccauugguacgacgccagacugaaccugaaaaccagcuuccacugcuacggggcuugugccaaguaucaguaccccuggcacacggccaaaugccauuuugaaaaggauuaugaguacgagaacuccugggcuuguaauccucccgacugcccgggagugggcacagggugcaccgcguguggccucuaucuggaucaacuuaaaccuguuggaacagccuucaagaucauuagcgugcgcuacucucggaaggucugcgugcaguuuggcgaagaguaucuguguaaaaccaucgacaugaacgauugcuucguuaccagacacgcuaagaucuguauuaucgggacaguguccaaauuuagccagggagacacgcuccuguuccugggccccauggaagggggaggcauuaucuuuaagcauuggugcaccuccacaugucacuucggggaucccggcgacgucaugggaccuaaagacaagccguuuauuugccccgaguucccuggccaguuucgcaaaaaguguaauuucgccaccacacccgugugcgaauacgaugggaacaucauuucuggauacaagaaaguucuugccaccaucgacagcuuccaauccuuuaauacgucuaacauccauuucacagaugagcggauugaguggagagacccugauggcaugcuccgcgaccacaucaauauugugaucagcaaggauauugacuuugaaaaccuggcugagaaucccuguaaagucgggcugcaggccgcgaacaucgaaggagcuuggggcuccggggugggcuucacccugaccugccaggugucucugacagagugcccuaccuuucuuacaagcaucaaggccugugauauggccauuugcuauggagcugaauccgucacgcugagccggggccaaaauaccguuaaaaucacagggaagggaggccacucuggguccagcuucaaguguugccauggaaaagaguguucuuccaccggccuccaggccagcgcgccccaccuggacaaggugaacggcauuucugagcuggaaaaugagaaaguguacgaugacggggcuccggaaugcggaaucacauguugguuuaagaaauccggcgagugggucauggggauuaucaacggaaauugggugguucuuaucgugcucugcguccugcuccucuucagcuuuauucugcuuuccauccuguguccugugagaaagcauaagaaaagcuga

SEQ ID NO: 13502 - RNA, 3402 nt, Artificial Sequence
  derived and/or modified CDS sequence (opt5) from SEOV(KI-88-15)__D17594.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugagauuguggagagcgaaguuucuuucaaagggcucugcaugcugaagcaccgcaugguggaggaauccuauagaaaccggcgcagcgucaucuguuacgaccuugccugcaauucuacauuuuguaagccuaccguguauaugauuguucccauccaugcuugcaacaugaugaaauccugucugaucggacucggcccuuaccggauucagguggucuaugagagaacauacugcaccacagggauccugaccgagggaaaguguuucgugcccgauaaagccguggucagcgcucuuaagcgcggcauguaugccauugcgucuaucgaaacgauuugcuuuuucauccaccagaaaggcaauaccuacaagauuguuacagccaucaccuccgcuauggggagcaaguguaacaauacagacaccaaagugcagggauacuauaucugcauuaucggcgggaacuccgccccuguguacgcuccggccggagaggauuuuagagcgauggaagucuucucuggcauuaucacgagcccccauggggaggaccacgaucugccuggagaagagauugccacauaucagaucuccggccagaucgaggcuaagauuccccacaccgugagcucuaaaaaucucaagcugacagccuuugcuggcaucccuuccuacagcucuaccagcauucuggccgccuccgaagacgggcgguucaucuuuucucccggacucuucccgaaccugaaccagagcguuugcgauaauaacgcccuuccucugauuuggcgcggccucaucgaccugaccggguauuacgaggcggugcaucccuguaaugucuucugcgugcuuuccggaccuggcgccagcugugaggcuuuuucugaagggggaaucuucaacauuacaucccccaugugccugguuagcaaacaaaauagauuucgggccgccgaacagcagaucucuuucgugugucaacgcgucgauauggacauuaucguguauugcaacggccagaagaaaacgauucucaccaagacacuggucaucggccaguguauuuacaccaucacaucccuguuuagccuccugcccgggguggcucacuccaucgccauugagcuuugcguuccuggauuccauggcugggcgaccgcugcccugcucaucacguuuuguuucgggugggugcugauuccggccugcacacuugcuauccugcucguccugaaguuuuucgccaauauucugcacaccucuaaccaggagaauagauuuaaagcuauccuccggaagaucaaagaagaguucgaaaagaccaaaggaagcauggugugugagauuugcaaguacgaaugcgagacacugaaggagcuuaaagcccacaaccuguccuguguucaaggcgaaugccccuauuguuuuacccauugcgagccuacagaaacggcgauccaggcccacuacaaggugugucaggcuacccaucgcuucagagaggaucucaaaaagacagucacaccccagaauauugggccuggcugcuaucggacccugaaccuguucagauacaaaucucgcuguuauauccuuaccauguggacgcuccugcugauuaucgagagcauccucugggccgcuuccgccgcggaaauuccccuggugccgcuuuggaccgacaaugcccacggagugggcagcguuccuaugcauacagaccuggagcucgauuuuucucugcccuccagcucuaaguacaccuauaagcggcaccugacaaacccugucaaugaccaacaguccgugagccuucacaucgaaauugagucucaggggaucggagcugaugugcaucaccucggccauugguacgacgccagacugaaccugaaaaccagcuuccacugcuacggggcuuguacgaaguaucaguaccccuggcacacagccaaaugccauuuugaaaaggauuaugaguacgagaacuccugggccuguaauccucccgacugcccgggagucggcaccgggugcacagcuuguggccucuaucuggaucaacuuaaaccugugggaaccgcguucaagauuaucagcguucgcuacucucggaaggugugcguccaguuuggcgaagaguaucuguguaaaaccaucgacaugaacgauugcuucgugacaagacacgccaagauuuguaucauugggacgguuuccaaauuuagccagggagacacccuccuguuccugggccccauggaagggggaggcaucauuuuuaagcauuggugcacauccaccugucacuucggggaucccggcgacgugaugggaccuaaagacaagccguuuaucugccccgaguucccuggccaguuucgcaaaaaguguaauuucgcuacaacccccgucugcgaauacgaugggaacauuaucucuggauacaagaaagugcuugccacgaucgacagcuuccaauccuuuaauacaucuaacauucauuucaccgaugagcggaucgaguggagagacccugauggcaugcuccgcgaccacauuaauaucguuauuagcaaggauaucgacuuugaaaaccuggccgagaaucccuguaaaguggggcugcaggcugccaacaucgaaggagcguggggcuccggggucggcuucacccucacaugccaggugucucugaccgagugcccuacauuucuuacgagcauuaaggcuugugauauggccaucugcuauggagccgaauccgugacccugagccggggccaaaauacagucaaaauuaccgggaagggaggccacucuggguccagcuucaaguguugccauggaaaagaguguucuuccacaggccuccaggcuagcgcuccccaccuggacaagguuaacggcaucucugagcugaaaaaugaaaagguguacgaugacggggcgccggagugcggaauuaccuguugguuuaaaaaguccggcgaaugggugauggggaucaucaacggaaauugggucgugcuuauuguucucugcgugcugcuccuguucagcuuuauccugcuuuccauucuguguccugucagaaagcauaaaaagagcuga

SEQ ID NO: 13503 - RNA, 3402 nt, Artificial Sequence
  derived and/or modified CDS sequence (opt5) from SEOV(LongwanRn581)__GU592930.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcccuuccucugauuuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucauuacguuuuguuucggguggguccugaucccggccugcacacuugcuauucugcucgugcugaaguuuuucgccaauauccugcacaccucuaaccaggagaauagauuuaaagcuauucuccggaagaucaaagaagaguucgaaaagaccaaaggaagcaugguuugugagaucugcaaguacgaaugcgagacacugaaggagcuuaaagcccacaaccuguccugugugcaaggcgaaugccccuauuguuuuacccauugcgagccuacagaaacggcgauucaggcccacuacaaggucugucaggcuacccaucgcuucagagaggaucucaaaaagacagugacaccccagaauaucgggccuggcugcuaucggacccugaaccuguucagauacaaaucucgcuguuauauucuuaccauguggacgcuccugcugaucauugagagcauccucugggccgcuuccgccgcggaaaucccccuggugccgcuuuggaccgacaaugcccacggaguuggcagcgucccuaugcauacagaccuggagcucgauuuuucucugcccuccagcucuaaguacaccuauaagcggcaccugacaaacccugugaaugaccaacaguccgugagccuucacauugaaaucgagucucaggggauuggagcugauguccaucaccucggccauugguacgacgccagacugaaccugaaaaccagcuuccacugcuacggggcuuguacgaaguaucaguaccccuggcacacagccaaaugccauuuugaaaaggauuaugaguacgagaacuccugggccuguaauccucccgacugcccgggagugggcaccgggugcacagcuuguggccucuaucuggaucaacuuaaaccuguuggaaccgcguucaagaucauuagcgugcgcuacucucggaaggucugcgugcaguuuggcgaagaguaucuguguaaaaccaucgacaugaacgauugcuucguuacaagacacgccaagaucuguauuaucgggacgguguccaaauuuagccagggagacacccuccuguuccugggccccauggaagggggaggcauuaucuuuaagcauuggugcacauccaccugucacuucggggaucccggcgacgucaugggaccuaaagacaagccguuuauuugccccgaguucccuggccaguuucgcaaaaaguguaauuucgcuacaacccccgugugcgaauacgaugggaacaucauuucuggauacaagaaaguucuugccacgaucgacagcuuccaauccuuuaauacaucuaacauccauuucaccgaugagcggauugaguggagagacccugauggcaugcuccgcgaccacaucaauauugugaucagcaaggauauugacuuugaaaaccuggccgagaaucccuguaaagucgggcugcaggcugccaacaucgaaggagcguggggcuccggggugggcuucacccucacaugccaggugucucugaccgagugcccuacauuucuuacgagcaucaaggcuugugauauggccauuugcuauggagccgaauccgucacccugagccggggccaaaauacaguuaaaaucaccgggaagggaggccacucuggguccagcuucaaguguugccauggaaaagaguguucuuccacaggccuccaggcuaacgcuccccaccuggacaaggugaauggcauuagcgagcuggaaaacgagaaaguguacgaugacggggcgccggaaugcggagucaccuguugguuuaagaaaucuggcgagugggugauggggaucauuaauggaaacuggguugugcuuaucguccucugcgugcugcuccuguucucccugauccuucugagcauucucuguccuguuagaaagcauaagaaauccuga

SEQ ID NO: 13504 - RNA, 3402 nt, Artificial Sequence
  derived and/or modified CDS sequence (opt5) from SEOV(RuianRn180)__GU592931.1__GP
auguggagccugcucaucguggccgcucuggucggccagggguucgcccuuaagaacguuuuugacaugagaauccaaugcccccacuccgugaauuucggagagaccucugugagcggcuacacagaacugccuccgcucucccugcaggaggcggaacagcuuguccccgagucuagcuguaacauggauaaucaucagucccugucuacgauuaacaaacucaccaaggugauuuggcggaaaaaggcuaaucaagaaagcgccaaccaaaauuccuuugagguuguggagagcgaagucucuuucaaagggcugugcaugcugaagcaccgcaugguggaggaauccuauagaaaccggcgcagcguuaucuguuacgaccucgccugcaauucuacauuuuguaagccuaccguguauaugauuguccccauccaugcuugcaacaugaugaaauccugucugaucggacuuggcccuuaccggauucaggugguguaugagagaacauacugcaccacagggauccugaccgagggaaaguguuucguccccgauaaagccguugugagcgcucucaagcgcggcauguaugccauugcgucuaucgaaacgauuugcuuuuucauccaccagaaaggcaauaccuacaagauugugacagccaucaccuccgcuauggggagcaaguguaacaauacagacaccaaaguccagggauacuauaucugcauuaucggcgggaacuccgccccuguguacgcuccggccggagaggauuuuagagcgauggaaguuuucucuggcauuaucacgagcccccauggggaggaccacgaucugccuggagaagagauugccacauaucagaucuccggccagaucgaggcuaagauuccccacaccgugagcucuaaaaaucuuaagcugacagccuuugcuggcaucccuuccuacagcucuaccagcauucucgccgccuccgaagacgggcgguucaucuuuucucccggacuguucccgaaccugaaccagagcgucugcgauaauaacgcucucccucugauuuggcgcggccuuaucgaccugaccggguauuacgaggcggugcaucccuguaauguuuucugcgugcucuccggaccuggcgccagcugugaggcuuuuucugaagggggaaucuucaacauuacaucccccaugugccuggucagcaaacaaaauagauuucgggccgccgaacagcagaucucuuucauuugucaacgcguggauauggacaucauugucuauugcaacggccagaagaaaacgauccuuaccaagacacuggugauuggccaguguaucuacaccaucacaucccucuuuagccugcugcccgggguugcucacuccauugccaucgagcucugcgugccuggauuccauggcugggcgaccgcugcccugcuuauuacguuuuguuucggguggguccugaucccggccugcacacucgcuauucugcuugugcugaaguuuuucgccaauauccuccacaccucuaaccaggagaauagauuuaaagcuauccugcggaagauuaaagaagaguucgaaaagaccaaaggaagcaugguuugugagaucugcaaguacgaaugcgagacacugaaggagcucaaagcccacaaccuguccugugugcaaggcgaaugccccuauuguuuuacccauugcgagccuacagaaacggcgauucaggcccacuacaaggucugucaggcuacccaucgcuucagagaggaucuuaaaaagacagugacaccccagaauaucgggccuggcugcuaucggacccugaaccucuucagauacaaaucucgcuguuauauucugaccauguggacgcugcuucucaucaucgagagcauucugugggccgcuuccgccgcggaaaucccccuggugccgcucuggaccgacaaugcccacggaguuggcagcgucccuaugcauacagaccuggagcuugauuuuucucugcccuccagcucuaaguacaccuauaagcggcaccucacaaacccugugaaugaccaacaguccgugagccugcacauugaaaucgagucucaggggauuggagcugauguccaucaccugggccauugguacgacgccagacuuaaccucaaaaccagcuuccacugcuacggggcuuguacgaaguaucaguaccccuggcacacagccaaaugccauuuugaaaaggauuaugaguacgagaacuccugggccuguaauccucccgacugcccgggagugggcaccgggugcacagcuuguggccuguaucuggaucaacucaaaccuguuggaaccgcguucaagaucaucagcgugcgcuacucucggaaggucugcgugcaguuuggcgaagaguaucuguguaaaaccauugacaugaacgauugcuucguuacaagacacgccaagaucuguauuaucgggacgguguccaaauuuagccagggagacacccuucuguuccucggccccauggaagggggaggcauuaucuuuaagcauuggugcacauccaccugucacuucggggaucccggcgacgucaugggaccuaaagacaagccguuuauuugccccgaguucccuggccaguuucgcaaaaaguguaauuucgcuacaacccccgugugcgaauacgaugggaacaucaucucuggauacaagaaaguucuggccacgauugacagcuuccaauccuuuaauacaucuaacauccauuucaccgaugagcggauugaguggagagacccugauggcaugcugcgcgaccacaucaauauugugaucagcaaggauaucgacuuugaaaaccuugccgagaaucccuguaaagucgggcuccaggcugccaacauugaaggagcguggggcuccggggugggcuucacccugacaugccaggugucucugaccgagugcccuacauuucucacgagcaucaaggcuugugauauggccauuugcuauggagccgaauccgucacccugagccggggccaaaauacaguuaaaaucaccgggaagggaggccacucuggguccagcuucaaguguugccauggaaaagaguguucuuccacaggccuucaggcuagcgcgccccaccuggacaaggugaacggcauuucugagcucgaaaaugagaaaguguacgaugacggggccccggaaugcggagucaccuguugguuuaagaaauccggcgagugggugauggggaucaucaacggaaauuggguugugcugauuguccugugcgugcuucuccuguucagccugauccuccuguccauucuuuguccuguuagaaagcauaagaaaagcuga

SEQ ID NO: 13505 - RNA, 3402 nt, Artificial Sequence
  derived and/or modified CDS sequence (opt5) from SEOV(ShuangyangRn470)__GU592925.1__GP
auguggagccuucucuuccuggccgcucuugugggccagggguuugcccugaagaacgucuucgacaugagaauccaaugcccccacuccguuaauuuuggagagaccucugugagcggcuacacagaacucccuccgcugucccuucaggagucugaacagcuggugcccgagagcuccuguaacauggauaaucaucagucucucagcacgauuaacaaacugaccaaggucaucuggcggaaaaaggcgaaucaagaauccgcuaaccagaauagcuucgaggugguugagucugaaguguccuuuaaagggcugugcaugcucaagcaccgcauggucgaggaaagcuauagaaaccggcgcucugugauuuguuacgaccuggccugcaauuccacauucuguaagccuaccguuuauaugaucgugcccauucaugccugcaacaugaugaaaagcugucuuaucggacugggcccuuacagaauccaggucguguaugagcggacauacugcaccacagggauucucaccgagggaaaguguuuugugcccgauaaagcugucguuucugcccugaagcgcggcauguaugcuaucgccuccauugaaacgaucugcuucuuuauucaccagaaaggcaauaccuacaagaucgugacagcgauuaccagcgccaugggguccaaguguaacaauacagacaccaaagugcaaggauacuauaucugcaucauuggcgggaacucugcuccugucuacgccccggcuggagaggauuucagagccauggaaguguuuagcggcaucauuacgagcccccauggggaggaccacgaucuuccuggagaagagaucgcgacauaucagauuagcggccagaucgaggccaagaucccccacaccguuucuuccaaaaaucugaagcucacagcuuucgccggcauuccuagcuacucuagcaccuccauccuggcugccucugaagacgggcgguuuauuuucagccccggacuguucccgaaccucaaccaguccgugugcaauaacaaugcccugccucuuaucuggcgcggccugauugaucucaccggguauuacgaggcuguccaucccuguaacguguuuugcguucugagcggaccuggcgcgucuugugaagccuucuccgaagggggaaucuuuaauaucacaagccccaugugccuugugucuaaacaaaacagauuccgggcugccgagcagcagauuuccuuugucugucaacgcguggacauggauaucauugucuauugcaauggccagaagaaaacgauccugaccaagacacucgugauuggccaguguaucuacaccauuacaagccuguucucccugcuccccgggguugcccacucuaucgcuaucgagcugugcgugccuggauuucauggcugggccaccgcggcucugcugauuacguucuguuuuggguggguccucaucccggccugcacacuggccauucuucuggugcucaaguucuuugcuaacauccugcacaccagcaaucaggagaacagauucaaagccauucugcggaagaucaaagaagaguuugaaaagaccaaaggauccaugguuugugagaucugcaaguacgaaugcgagacacucaaggagcugaaagcucacaaucuuucuugugugcaaggcgaaugccccuauuguuucacccauugcgagccuacagaaacggccauucaggcgcacuacaaggucugucaggccacccaucgcuucagagaggaccugaaaaagacagugacaccccagaacaucgggccuggcugcuaucggacccucaaucuguuuagauacaaaagccgcuguuauauucugaccauguggacgcuucuccugaucguggaguccauucugugggcugccagcgcugccgaaaucccccucguuccgcuguggaccgauaacgcgcacggagucggcucugugccuaugcauacagaccuugagcuggacuucucccuccccuccucuuccaaguacaccuauaagcggcaccugacaaauccugugaacgaucaacagagcgucucucugcacaucgaaauugagagccaggggaucggagccgacgugcaucaccuuggccauugguacgaugcuagacucaaccugaaaaccuccuuucacugcuacggggccuguacgaaguaucaguaccccuggcacacagcuaaaugccauuucgaaaaggacuaugaguacgagaauagcugggccuguaacccucccgauugcccgggaguuggcaccgggugcacagccuguggccuguaucucgaccaacugaaaccugugggaaccgcuuuuaagauuaucucuguccgcuacucccggaaggugugcguucaguucggcgaagaguaucuuuguaaaaccauugauaugaaugacugcuuugugacaagacacgcgaagaucuguaucauugggacggucagcaaauucucccagggagauacccugcucuuucugggccccauggaagggggaggcaucauuuucaagcauuggugcacaucuaccugucacuuuggggaccccggcgaugugaugggaccuaaagacaagccguucaucugccccgaguuuccuggccaguuccgcaaaacauguaacuucgccaccacgcccguuugcgaauacgacgggaauauuaucagcggauacaagaaggugcuggcuacaauugauuccuuucaaucuuucaacaccagcaauauccauuuuaccgacgagcggaucgaguggagagauccugacggcaugcuucgcgaucacauuaacaucgucauuuccaaagacaucgauuucgaaaaucucgccgagaaccccuguaagguggggcugcaggccgcuaauauugaaggagccuggggcucuggggugggcuuuacacugaccugccaggucagccucacagagugcccuacguuccugaccuccaucaaagcgugugacauggcuaucugcuauggagccgaaagcguuacacuuucucggggccaaaacaccgugaagauuacagggaaaggaggccacuccgggagcucuuuuaaguguugccauggaaaggaguguuccagcaccggccugcaggccucugcuccccaccucgauaaagugaauggcaucuccgagcuggaaaacgagaaggucuacgacgauggggccccggaaugcggagugacguguugguucaaaaagagcggcgaguggguuauggggauuaucaauggaaacugggugguccugauugugcuuugcguucuccugcuguuuucccucauccugcuuagcauccuguguccugugagaaaacauaagaagucuuga

SEQ ID NO: 13506 - RNA, 3402 nt, Artificial Sequence
  derived and/or modified CDS sequence (opt5) from SEOV(WuhanMm13)__JQ665886.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugauugagagcgaaguuucuuucaaagggcucugcaugcugaagcaccgcaugguggaggaauccuauagaaaccggcgcagcgucaucuguuacgaccuugccugcaauucuacauuuuguaagccuaccguguauaugauuguucccauccaugcuugcaacaugaugaaauccugucugaucggacucggcccuuaccggauucagguggucuaugagagaacauacugcaccacagggauccugaccgagggaaaguguuucgugcccgauaaagccguggucagcgcucuuaagcgcggcauguaugccguugcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcccuuccucugauuuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucacgacauuuuguuucggguggguccugauuccggccugcacccuugcuauccugcucgugcugaaguuuuucgccaauauucugcacaccucuaaccaggagaauagauuuaaagcuauccuccggaagauuaaagaagaguucgaaaagacaaaaggaagcaugguuugugagaucugcaaguacgaaugcgagacccugaaggagcuuaaagcccacaaccuguccugugugcaaggcgaaugccccuauuguuuuacacauugcgagccuacggaaaccgcgauccaggcccacuacaaggucugucaggcuacacaucgcuucagagaggaucucaaaaagaccgugacaccccagaauauugggccuggcugcuaucggacccugaaccuguucagauacaaaucucgcuguuauauccuuacgauguggaccauucuccugaucauugagagcauccugugggccgcuuccgccgcggaaaucccccucgugccgcuguggacagacaaugcccacggaguuggcagcgucccuaugcauaccgaccuugagcuggauuuuucucuccccuccagcucuaaguacacauauaagcggcaccugaccaacccugugaaugaccaacaguccgugagccugcacauugaaaucgagucucaggggauuggagcugauguccaucaccuuggccauugguacgacgccagacucaaccugaaaacgagcuuccacugcuacggggcuuguacaaaguaucaguaccccuggcacaccgccaaaugccauuuugaaaaggauuaugaguacgagaacuccugggccuguaauccucccgacugcccgggagugggcacagggugcaccgcuuguggccuguaucucgaucaacugaaaccuguuggaaccgcguucaagaucauuagcgugcgcuacucucggaaggucugcgugcaguuuggcgaagaguaucuuuguaaaacaaucgacaugaacgauugcuucguuacgagacacgccaagaucuguauuaucgggaccguguccaaauuuagccagggagacacacuccuguuccugggccccauggaagggggaggcauuaucuuuaagcauuggugcaccuccacaugucacuucggggaucccggcgacgucaugggaccuaaagacaagccguuuauuugccccgaguucccuggccaguuucgcaaaaaguguaauuucgcuaccacgcccgugugcgaauacgaugggaacaucauuucuggauacaagaaaguucuggccacaaucgacagcuuccaauccuuuaauaccucuaacauccauuucaccgaugagcggauugaguggagagacccugauggcaugcuucgcgaccacaucaauauugugaucagcaaggauauugacuuugaaaaccucgccgagaaucccuguaaagucgggcugcaggcugccaacaucgaaggagcguggggcuccggggugggcuucacacugaccugccaggugucucucacagagugcccuacguuucugaccagcaucaaggcuugugauauggccauuugcuauggagccgaauccgucacacuuagccggggccaaaauaccguuaaaaucacagggaagggaggccacucuggguccagcuucaaguguugccauggaaaagaguguucuuccaccggccugcaggcuagcgcuccccaccucgacaaggugaacggcauuucugagcuggaaaaugagaaaguguacgaugacggggcgccggaaugcggaaucacguguugguuuaagaaauccggcgagugggucauggggauuaucaacggaaauugggugguucugaucgcucuuugcgugcuccugcuguucagccucauucugcuuuccauccuguguccugucagaaagcauaagaaaagcuga

SEQ ID NO: 13507 - RNA, 3402 nt, Artificial Sequence
  derived and/or modified CDS sequence (opt5) from SEOV(WuhanMm24)__JQ665887.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugauggagagcgaaguuucuuucaaagggcucugcaugcugaagcaccgcaugguggaggaauccuauagaaaccggcgcagcgucauuuguuacgaccuugccugcaauucuacauuuuguaagccuaccguguauaugaucguucccauucaugcuugcaacaugaugaaauccugucugaucggacucggcccuuacagaauccagguggucuaugagcggacauacugcaccacagggauucugaccgagggaaaguguuucgugcccgauaaagccguggucagcgcucuuaagcgcggcauguaugccaucgcgucuauugaaacgaucugcuuuuucauucaccagaaaggcaauaccuacaagaucguuacagccauuaccuccgcuauggggagcaaguguaacaauacagacaccaaagugcagggauacuauaucugcaucauuggcgggaacuccgccccuguguacgcuccggccggagaggauuuuagagcgauggaagucuucucuggcaucauuacgagcccccauggggaggaccacgaucugccuggagaagagaucgccacauaucagauuuccggccagaucgaggcuaagaucccccacaccgugagcucuaaaaaucucaagcugacagccuuugcuggcauuccuuccuacagcucuaccagcauccuggccgccuccgaagacgggcgguucaucuuuucucccggacucuucccgaaccugaaccagagcguuugcgauaauaacgcccuuccucugauuuggcgcggccucauugaccugaccggguauuacgaggcggugcaucccuguaaugucuucugcgugcuuuccggaccuggcgccagcugugaggcuuuuucugaagggggaaucuucaacaucacaucccccaugugccugguuagcaaacaaaauagauuucgggccgccgaacagcagauuucuuucgugugucaacgcgucgauauggacaucauuguguauugcaacggccagaagaaaacgauccucaccaagacacuggucauuggccaguguaucuacaccauuacaucccuguuuagccuccugcccgggguggcucacuccaucgccaucgagcuuugcguuccuggauuccauggcugggcgaccgcugcccugcucauuacguuuuguuucgggugggugcugaucccggccugcacacuugcuauucugcucguccugaaguuuuucgccaauauccugcacaccucuaaccaggagaauagauuuaaagcuauucuccggaagaucaaagaagaguucgaaaagaccaaaggaagcauggugugugagaucugcaaguacgaaugcgagacacugaaggagcuuaaagcccacaaccuguccuguguucaaggcgaaugccccuauuguuuuacccauugcgagccuacagaaacggcgauucaggcccacuacaaggugugucaggcuacccaucgcuucagagaggaucucaaaaagacagucacaccccagaauaucgggccuggcugcuaucggacccugaaccuguucagauacaaaucucgcuguuauauucuuaccauguggacgcuccugcugaucauugagagcauccucugggccgcuuccgccgcggaaaucccccuggugccgcuuuggaccgacaaugcccacggagugggcagcguuccuaugcauacagaccuggagcucgauuuuucucugcccuccagcucucgguacaccuauaagagacaccugacaaacccugucaaugaccaacaguccgugagccuucacauugaaaucgagucucaggggauuggagcugaugugcaucaccucggccauugguacgacgcccgccugaaccugaagaccagcuuccacugcuacggggcuuguacgaaauaucaguaccccuggcacacagccaagugccauuuugaaaaagauuaugaguacgagaacuccugggccuguaauccucccgacugcccgggagucggcaccgggugcacagcuuguggccucuaucuggaucaacuuaagccugugggaaccgcguucaaaaucauuagcguucgguacucuagaaaggugugcguccaguuuggcgaagaguaucuguguaagaccaucgacaugaacgauugcuucgugacacgccacgccaaaaucuguauuaucgggacgguuuccaaguuuagccagggagacacccuccuguuccugggccccauggaagggggaggcauuaucuuuaaacauuggugcacauccaccugucacuucggggaucccggcgacgugaugggaccuaaggacaaaccguuuauuugccccgaguucccuggccaguuucggaagaaauguaauuucgcuacaucucccgucugcgaauacgaugggaacaucauuagcggauacaagaaggugcuugccaccaucgacuccuuccaaucuuuuaauacgagcaacauccauuucacagaugagagaauugaguggcgcgacccugauggcaugcuccgggaccacaucaauauuguuaucuccaaagauauugacuuugaaaaccuggccgagaaucccuguaagguggggcugcaggcugccaacaucgaaggagcguggggcucuggggucggcuucacccugaccugccaggugagccucacagagugcccuaccuuucuuacauccaucaaggcuugugauauggccauuugcuauggagccgaaagcgugacgcugucuagaggccaaaauaccgucaagaucacagggaaaggaggccacuccgggagcucuuucaaguguugccauggaaaggaguguucccucaccggccugcaggcuagcgcuccccaccuggacaaaguuaacggcauuucugagcuugaaaaugagaagguguacgaugacggggcgccggaaugcggaaucacauguugguuuaaaaaguccggcgagugggugauggggauuaucaacggaaauugggucgugcucaucgcucugugcguucugcuccuguucagccuuauucugcucuccauccuguguccugugcgcaaacauaaaaagagcuga

SEQ ID NO: 13508 - RNA, 3402 nt, Artificial Sequence
  derived and/or modified CDS sequence (opt5) from SEOV(WuhanRf02)__JQ665888.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccagaacuccuuugaggugauugagagcgaaguuucuuucaaagggcucugcaugcugaagcaccgcaugguggaggaauccuauagaaaccggcgcagcgucaucuguuacgaccuugccugcaauucuacauuuuguaagccuaccguguauaugauuguucccauccaugcuugcaacaugaugaaauccugucugaucggacucggcccuuaccggauucagguggucuaugagagaacauacugcaccacagggauccugaccgagggaaaguguuucgugcccgauaaagccguggucagcgcucuuaagcgcggcauguaugccguugcgucuauugaaacgaucugcuuuuucauucaccagaaaggcaauaccuacaagaucgugacagccauuaccuccgcuauggggagcaaguguaacaauacagacaccaaagugcaaggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucauuuuuagccccggacucuucccgaaccugaaccagagcgugugcgauaauaacgcucugccucugaucuggcgcggccucauugaccugaccggguauuacgaggcgguccaucccuguaauguguucugcguucuuuccggaccuggcgccagcugugaggcuuuuucugagggcggaaucuucaacaucacaucccccaugugccuggugagcaaacaaaauagauuucgggccgccgaacagcgcauuucuuucgucugucagagaguggauauggacaucauugucuauugcaacggccaaaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucacgacauuuuguuucggguggguccugauuccggccugcacccuugcuauccugcucgugcugaaguuuuucgccaauauucugcacaccucuaaccaggagaaucgguuuaaagcuauccuccgcaagauuaaagaagaguucgaaaagacaaaaggaagcguugugugugagaucugcaaguacgaaugcgagacccugaaggagcuuaaagcccacaaccuguccuguguccagggcgaaugccccuauuguuuuacacauugcgagccuacggaaaccgcgauccaagcccacuacaaggugugucaggcuacacauagauuccgggaggaucucaaaaagaccgugacaccccagaauauugggccuggcugcuauagaacccugaaccuguuccgcuacaauucucggcccgacggacuuacgauguggacccuccugcugaucauugagagcauccucugggccgcuuccgccgcggaaauuccgcugguuccucuuugggccgacaacgcucacggcgucgggagcgugcccaugcauacagaucuggagcucgacuuuucucugccuuccagcucuaaauauaccuacaagagacaccugacaaaucccgugaacgaucagcaauccgucagccuucacaucgaaaucgagucucagggaauuggcgccgacgugcaucaccucgggcauugguaugaugcucgccugaaccugaagaccagcuuccacuguuacggagccugcacgaaauaccaguauccuuggcacacagccaagugucauuuugaaaaagacuacgaguaugaaaauuccugggcuugcaaucccccggauuguccuggcguugggaccggcugcacagcgugcggacucuaccuggaccagcuuaagcccgugggcaccgccuucaaaaucauuagcguccgguauucuagaaagguguguguucaauuuggggaagaguaccugugcaagaccaucgauaugaaugacuguuucgugacacgccacgcuaaaauuugcaucaucggaacgguccccaaguuuucccagggcgauacccuccuguuccuggggccuauggaaggaggcgggauuaucuuuaaacauugguguacaucuaccugccacuucggcgacccgggagacgugaugggccccaaggauaaaccuuuuauucggcccgaguucccugggcaguuuagaaagaaauguaacuucgccacaacccccguuugcggauaugacggcaauaucauuuccggguacaagaaggugcuugccacgaucgauucuuuccagagcuuuaacacauccaauauucauuucaccgacgaacgcaucgaguggcgggauccugacggaaugcucagagaucacaucaacauugucaucucuaaagacauugauuuugagaaucuggcugaaaaccccuguaaggugggccugcaagccgcgaauaucgagggggcuuggggcagcggagugggcuucacccucacaugccaggucucccugaccgaauguccgacauuucuuacgucuauuaaagccugcgacauggccaucugcuacggggcugagagcguuacccugucccgcggacagaacacagugaagaucaccggcaaagggggacacagcgggucuuccuucaaguguugccauggcaaggaauguagcucuacagggcuccaagccuccgcgccucaccuggauaaagugaauggaauuagcgagcuggagaacgaaaaggucuaugacgauggcgcucccgagugcgggaucaccuguugguuuaaaaagucuggagaaugggugaugggcauuaucaaugggaacuggguugugcuuauugcccucugcguccugcuucucuucucccugauccuucugagcauccucuguccugugcggaaacauaagaaguccuga

SEQ ID NO: 13509 - RNA, 3402 nt, Artificial Sequence
  derived and/or modified CDS sequence (opt5) from SEOV(WuhanRf07)__JQ665889.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugauugagagcgaaguuucuuucaaagggcucugcaugcugaagcaccgcaugguggaggaauccuauagaaaccggcgcagcgucaucuguuacgaccuugccugcaauucuacauuuuguaagccuaccguguauaugauuguucccauccaugcuugcaacaugaugaaauccugucugaucggacucggcccuuaccggauucagguggucuaugagagaacauacugcaccacagggauccugaccgagggaaaguguuucgugcccgauaaagccguggucagcgcucuuaagcgcggcauguaugccguugcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcucugccucugauuuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucacgacauuuuguuucggguggguccugauuccggccugcacccuugcuauccugcucgugcugaaguuuuucgccaauauucugcacaccucuaaccaggagaauagauuuaaagcuauccuccggaagauuaaagaagaguucgaaaagacaaaaggaagcaugguuugugagaucugcaaguacgaaugcgagacccugaaggagcuuaaagcccacaaccuguccugugugcaaggcgaaugccccuauuguuuuacacauugcgagccuacggaaaccgcgauccaggcccacuacaaggucugucaggcuacacaucgcuucagagaggaucucaaaaagaccgugacaccccagaauauugggccuggcugcuaucggacccugaaccuguucagauacaaaucucgccccuauauccuuacgauguggaccauucuccugaucauugagagcauccugugggccgcuuccgccgcggaaaucccgcucgugccucuguggacagacaaugcccacggaguuggcagcguccccaugcauaccgaccuugagcuggauuuuucucucccuuccagcucuaaguacacauauaagcggcaccugaccaaccccgugaaugaccaacaguccgugagccugcacauugaaaucgagucucaggggauuggagcugauguccaucaccuuggccauugguacgacgccagacucaaccugaaaacgagcuuccacuguuacggggcuugcacaaaguaucaguacccuuggcacaccgccaaaugucauuuugaaaaggauuaugaguacgagaacuccugggccugcaaucccccggacuguccuggagugggcacagggugcaccgcuugcggccuguaucucgaucaacugaaacccguuggaaccgcguucaagaucauuagcgugcgcuacucucggaaggucugugugcaguuuggcgaagaguaucuuugcaaaacaaucgacaugaacgauuguuucguuacgagacacgccaagaucugcauuaucgggaccguguccaaauuuagccagggagacacacuucucuuccugggccccauggaagggggaggcauuaucuuuaagcauugguguaccuccacaugccacuucggggauccuggcgacgucaugggaccgaaagacaagcccuuuauuuguccugaguuccccggccaguuucgcaaaaagugcaauuucgcuaccacgccugugugugaauacgaugggaacaucauuucuggauacaagaaaguucuggccacaaucgacagcuuccaauccuuuaauaccucuaacauccauuucaccgaugagcggauugaguggagagaccccgauggcaugcuucgcgaccacaucaauauugugaucagcaaggauauugacuuugaaaaccucgccgagaauccuugcaaagucgggcugcaggcugccaacaucgaaggagcguggggcuccggggugggcuucacacugaccugucaggugucucucacagagugccccacguuucugaccagcaucaaggcuugcgauauggccauuuguuauggagccgaauccgucacacuuagccggggccaaaauaccguuaaaaucacagggaagggaggccacucuggguccagcuucaagugcugucauggaaaagaguguucuuccaccggccugcaggcuagcgccccgcaccucgacaaggugaacggcauuucugagcuggaaaaugagaaaguguacgaugacggggcgccugaaugcggaaucacgugcugguuuaagaaauccggcgagugggucauggggauuaucaacggaaauugggugguucugaucgcucuuugugugcuccugcuguucagccucauucugcuuuccauccugugccccgucagaaagcauaagaaaagcuga

SEQ ID NO: 13510 - RNA, 3402 nt, Artificial Sequence
  derived and/or modified CDS sequence (opt5) from SEOV(WuhanRf18)__JQ665893.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugauugagagcgaaguuucuuucaaagggcucugcaugcugaagcaccgcaugguggaggaauccuauagaaaccggcgcagcgucaucuguuacgaccuugccugcaauucuacauuuuguaagccuaccguguauaugauuguucccauccaugcuugcaacaugaugaaauccugucugaucggacucggcccuuaccggauucagguggucuaugagagaacauacugcaccacagggauccugaccgagggaaaguguuucgugcccgauaaagccguggucagcgcucuuaagcgcggcauguaugccguugcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcccuuccucugauuuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcgcauuucuuucgucugucagagaguggauauggacaucauugucuauugcaacggccaaaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucacgacauuuuguuucggguggguccugauuccggccugcacccuugcuauccugcucgugcugaaguuuuucgccaauauucugcacaccucuaaccaggagaaucgguuuaaagcuauccuccgcaagauuaaagaagaguucgaaaagacaaaaggaagcaugguuugugagaucugcaaguacgaaugcgagacccugaaggagcuuaaagcccacaaccuguccugugugcagggcgaaugccccuauuguuuuacacauugcgagccuacggaaaccgcgauccaagcccacuacaaggucugucaggcuacacauagauuccgggaggaucucaaaaagaccgugacaccccagaauauugggccuggcugcuauagaacccugaaccuguuccgcuacaaaucucgguguuauauccuuacgauguggaccauucuccugaucauugagagcauccugugggccgcuuccgccgcggaaaucccccucgugccgcuguggacagacaaugcccacggaguuggcagcgucccuaugcauaccgaccuugagcuggauuuuucucuccccuccagcucuaaguacacauauaagagacaccugaccaacccugugaaugaccagcaauccgugagccugcacauugaaaucgagucucaggggauuggagcugauguccaucaccuuggccauugguacgacgcccgccucaaccugaaaacgagcuuccacugcuacggggcuuguacaaaguaucaguaccccuggcacaccgccaaaugccauuuugaaaaggauuaugaguacgagaacuccugggccuguaauccucccgacugcccgggagugggcacagggugcaccgcuuguggccuguaucucgaucagcugaaaccuguuggaaccgcguucaagaucauuagcgugcgguacucuagaaaggucugcgugcaauuuggcgaagaguaucuuuguaaaacaaucgacaugaacgauugcuucguuacgcgccacgccaagaucuguauuaucgggaccguguccaaauuuagccagggagacacacuccuguuccugggccccauggaagggggaggcauuaucuuuaagcauuggugcaccuccacaugucacuucggggaucccggcgacgucaugggaccuaaagacaagccguuuauuugccccgaguucccuggccaguuucggaaaaaguguaauuucgcuaccacgcccgugugcgaauacgaugggaacaucauuucuggauacaagaaaguucuggccacaaucgacagcuuccaguccuuuaauaccucuaacauccauuucaccgaugagagaauugaguggcgcgacccugauggcaugcuucgggaccacaucaauauugugaucagcaaggauauugacuuugaaaaccucgccgagaaucccuguaaagucgggcugcaagcugccaacaucgaaggagcguggggcuccggggugggcuucacacugaccugccaggugucucucacagagugcccuacguuucugaccagcaucaaggcuugugauauggccauuugcuauggagccgaauccgucacacuuagcagaggccagaauaccguuaaaaucacagggaagggaggccacucuggguccagcuucaaguguugccauggaaaagaguguucuuccaccggccugcaagcuagcgcuccccaccucgacaaggugaacggcauuucugagcuggaaaaugagaaaguguacgaugacggggcgccggaaugcggaaucacguguugguuuaagaaauccggcgagugggucauggggauuaucaacggaaauugggugguucugaucgcucuuugcgugcuccugcuguucagccucauucugcuuuccauccuguguccuguccgcaagcauaagaaaagcuga

SEQ ID NO: 13511 - RNA, 3402 nt, Artificial Sequence
  derived and/or modified CDS sequence (opt5) from SEOV(WuhanRn10)__JQ665896.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugauugagagcgaaguuucuuucaaagggcucugcaugcugaagcaccgcaugguggaggaauccuauagaaaccggcgcagcgucaucuguuacgaccuugccugcaauucuacauuuuguaagccuaccguguauaugauuguucccauccaugcuugcaacaugaugaaauccugucugaucggacucggcccuuaccggauucagguggucuaugagagaacauacugcaccacagggauccugaccgagggaaaguguuucgugcccgauaaagccguggucagcgcucuuaagcgcggcauguaugccguugcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcccuuccucugauuuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucacgacauuuuguuucggguggguccugauuccggccugcacccuugcuauccugcucgugcugaaguuuuucgccaauauucugcacaccucuaaccaggagaauagauuuaaagcuauccuccggaagauuaaagaagaguucgaaaagaacaaaggaagcguugugugugagaucugcaaguacgaaugcgagacacugaaggagcuuaaagcccacaaucuguccuguguccaaggcgaaugccccuauuguuuuacccauugcgagccuacagaaacggcgauccaggcccacuacaaggugugucaggcuacccaucgcuucagagaggaucucaaaaagacagugacaccccagaacauugggccuggcugcuaucggacccugaaucuguucagauacaaaucucgcuguuauauccuuaccauguggacgauucuccugaucauugagagcauccugugggccgcuuccgccgcggaaaucccccucguuccgcuguggaccgacaacgcccacggagucggcagcgugccuaugcauacagaccuugagcuggauuuuucucuccccuccagcucuaaguacaccuauaagcggcaccugacaaauccugugaacgaccaacaguccgucagccugcacauugaaaucgagucucaggggauuggagcugaugugcaucaccuuggccauugguacgacgccagacucaaccugaaaaccagcuuccacugcuacggggcuuguacgaaguaucaguaccccuggcacacagccaaaugccauuuugaaaaggauuaugaguacgaaaauuccugggccuguaacccucccgacugcccgggaguuggcaccgggugcacagcuuguggccuguaucucgaucaacugaaaccugugggaaccgcguucaagaucauuagcguccgcuacucucggaaggugugcguucaguuuggcgaggaguaucuuuguaaaaccaucgacaugaaugauugcuucgugacaagacacgccaagaucuguauuaucgggacggucuccaaauuuagccagggagacacccuccuguuccugggccccauggaagggggaggcauuaucuuuaagcauuggugcacauccaccugucacuucggggaucccggcgacgugaugggaccuaaagacaagccguuuauuugccccgaguucccuggccaguuucgcaaaaaguguaacuucgcuacaacccccguuugcgaauacgaugggaauaucauuucuggauacaagaaagugcuggccacgaucgacagcuuccaauccuuuaacacaucuaauauccauuucaccgaugagcggauugaguggagagacccugauggcaugcuucgcgaccacaucaacauugucaucagcaaggauauugacuuugaaaaucucgccgagaaccccuguaaaguggggcugcaggcugccaauaucgaaggagcguggggcuccggggugggcuucacccugacaugccaggucucucucaccgagugcccuacauuucugacgagcaucaaggcuugugauauggccauuugcuauggagccgaauccguuacccuuagccggggccaaaacacagugaaaaucaccgggaagggaggccacucuggguccagcuucaaguguugccauggaaaagaguguucuuccacaggccugcaggcuagcgcuccccaccucgacaaggugaauggcauuucugagcuggaaaacgagaaagucuacgaugacggggcgccggaaugcggaaucaccuguugguuuaagaaauccggcgagugggugauggggauuaucaauggaaacuggguugugcugaucgcucuuugcguccuccugcuguucagccucauucugcuuuccauccuguguccugugagaaagcauaagaaaagcuga

SEQ ID NO: 13512 - RNA, 3402 nt, Artificial Sequence
  derived and/or modified CDS sequence (opt5) from SEOV(WuhanRn25)__JQ665897.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugauugagagcgaaguuucuuucaaagggcucugcaugcugaagcaccgcaugguggaggaauccuauagaaaccggcgcagcgucaucuguuacgaccuugccugcaauucuacauuuuguaagccuaccguguauaugauuguucccauccaugcuugcaacaugaugaaauccugucugaucggacucggcccuuaccggauucagguggucuaugagagaacauacugcaccacagggauccugaccgagggaaaguguuucgugcccgauaaagccguggucagcgcucuuaagcgcggcauguaugccguugcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcccuuccucugauuuggcgcggccucauugaccugaccggguauuacgaggcgguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucgucugucaacgcguggauauggacaucauugucuauugcaacggccagaagaaaacgauccucaccaagacacuggugauuggccaguguaucuacaccauuacaucccuguuuagccuccugcccgggguugcucacuccaucgccaucgagcuuugcgugccuggauuccauggcugggcgaccgcugcccugcucacgacauuuuguuucggguggguccugauuccggccugcacccuugcuauccugcucgugcugaaguuuuucgccaauauucugcacaccucuaaccaggagaauagauuuaaagcuauccuccggaagauuaaagaagaguucgaaaagaacaaaggaagcaugguuugugagaucugcaaguacgaaugcgagacacugaaggagcuuaaagcccacaaucuguccugugugcaaggcgaaugccccuauuguuuuacccauugcgagccuacagaaacggcgauccaggcccacuacaaggucugucaggcuacccaucgcuucagagaggaucucaaaaagacagugacaccccagaacauugggccuggcugcuaucggacccugaaucuguucagauacaaaucucgcuguuauauccuuaccauguggacgauucuccugaucauugagagcauccugugggccgcuuccgccgcggaaaucccccucgugccgcuguggaccgacaacgcccacggaguuggcagcgucccuaugcauacagaccuugagcuggauuuuucucuccccuccagcucuaaguacaccuauaagcggcaccugacaaauccugugaacgaccaacaguccgugagccugcacauugaaaucgagucucaggggauuggagcugauguccaucaccuuggccauugguacgacgccagacucaaccugaaaaccagcuuccacugcuacggggcuuguacgaaguaucaguaccccuggcacacagccaaaugccauuuugaaaaggauuaugaguacgaaaauuccugggccuguaacccucccgacugcccgggagugggcaccgggugcacagcuuguggccuguaucucgaucaacugaaaccuguuggaaccgcguucaagaucauuagcgugcgcuacucucggaaggucugcgugcaguuuggcgaggaguaucuuuguaaaaccaucgacaugaaugauugcuucguuacaagacacgccaagaucuguauuaucgggacgguguccaaauuuagccagggagacacccuccuguuccugggccccauggaagggggaggcauuaucuuuaagcauuggugcacauccaccugucacuucggggaucccggcgacgucaugggaccuaaagacaagccguuuauuugccccgaguucccuggccaguuucgcaaaaaguguaacuucgcuacaacccccgugugcgaauacgaugggaauaucauuucuggauacaagaaaguucuggccacgaucgacagcuuccaauccuuuaacacaucuaauauccauuucaccgaugagcggauugaguggagagacccugauggcaugcuucgcgaccacaucaacauugugaucagcaaggauauugacuuugaaaaucucgccgagaaccccuguaaagucgggcugcaggcugccaauaucgaaggagcguggggcuccggggugggcuucacccugacaugccaggugucucucaccgagugcccuacauuucugacgagcaucaaggcuugugauauggccauuugcuauggagccgaauccgucacccuuagccggggccaaaacacaguuaaaaucaccgggaagggaggccacucuggguccagcuucaaguguugccauggaaaagaguguucuuccacaggccugcaggcuagcgcuccccaccucgacaaggugaauggcauuucugagcuggaaaacgagaaaguguacgaugacggggcgccggaaugcggaaucaccuguugguuuaagaaauccggcgagugggucauggggauuaucaauggaaacugggugguucugaucgcucuuugcgugcuccugcuguucagccucauucugcuuuccauccuguguccugucagaaagcauaagaaaagcuga

SEQ ID NO: 13513 - RNA, 3402 nt, Artificial Sequence
  derived and/or modified CDS sequence (opt5) from SEOV(XiaotangshanRn7)__GU592929.1__GP
auguggagccuccuguuccuggccgcucuugugggccagggguuugcccugaagaacgucuucgacaugagaauccaaugcccccacuccguuaauuuuggagagaccucugugagcggcuacacagaacucccuccgcugucccuucaggaggcggaacagcuggugcccgagucuagcuguaacauggauaaucaucagucccucucuacgauuaacaaacugaccaaggucaucuggcggcgcaaagcuaaucaagaaagcgccaaccaaaauuccuucgaggugguugagagcgaagugucuuuuaaggggcugugcaugcucaaacacagaauggucgaggaauccuaucggaaccgcagaagcgugauuuguuacgaccuggccugcaauucuacauucuguaagccuaccguuuauaugaucgugcccauucaugcuugcaacaugaugaaguccugucuuaucggacugggcccuuaccggauccaggucguguaugagcgcacauacugcaccacagggauucucaccgagggaaaauguuuugugcccgauaaggccgucguuagcgcucugaaaagaggcauguaugccaucgcgucuauugaaacgaucugcuucuuuauucaccagaagggcaauaccuacaaaaucgugacagccauuaccuccgcuauggggagcaaguguaacaauacagacaccaaggugcagggauacuauaucugcaucauuggcgggaacuccgccccugucuacgcuccggccggagaggauuuccgggcgauggaaguguuuucuggcaucauuacgagcccccauggggaggaccacgaucuuccuggagaagagaucgccacauaucagauuuccggccagaucgaggcuaaaaucccccacaccguuagcucuaagaaucugaaacucacagccuucgcuggcauuccuuccuacagcucuaccagcauccuggccgccuccgaagacgggcgcuuuauuuucucucccggacuguucccgaaccucaaccagagcgugugcgauaauaacgcucugccucuuaucuggagaggccugauugaccucaccggguauuacgaggcgguccaucccuguaauguguuuugcguucuguccggaccuggcgccagcugugaagccuucucugaagggggaaucuuuaacaucacaucccccaugugccuugugagcaagcaaaaucgguuccgcgccgccgaacagcagauuucuuuugucugucaaagaguggauauggacaucauugucuauugcaacggccagaaaaagacgauccugaccaaaacacucgugauuggccaguguaucuacaccauuacaucccuguucagccugcuccccgggguugcucacuccaucgccaucgagcugugcgugccuggauuucauggcugggcgaccgcugcccuucugauuacguucuguuuuggguggguccucaucccggccugcacacuggcuauucuucuggugcucaaguucuuugccaauauccugcacaccucuaaccaggagaaucgguucaaggcuauucugcgcaaaaucaaggaagaguuugagaaaaccaagggaagcaugguuugugagaucugcaaauacgaaugcgagacacucaaggagcugaaggcccacaaccuuuccugugugcaaggcgaaugccccuauuguuucacccauugcgagccuacagaaacggcgauucaggcccacuacaaagucugucaggcuacccauagauuccgggaggaucugaagaaaacagugacaccccagaauaucgggccuggcugcuauagaacccucaaccuguuucgcuacaagucucgguguuauauucugaccauguggacgcuucuccugaucauugagagcauccugugggccgcuuccgccgcggaaaucccccucgugccgcuguggaccgacaaugcccacggaguuggcagcgucccuaugcauacagaccuugagcuggauuucucucuccccuccagcucuaaauacaccuauaagagacaccugacaaacccugugaaugaccaacaguccgugagccugcacauugaaaucgagucucaggggauuggagcugauguccaucaccuuggccauugguacgacgcccgccucaaccugaagaccagcuuucacugcuacggggcuuguacgaaauaucaguaccccuggcacacagccaagugccauuucgaaaaagauuaugaguacgagaacuccugggccuguaauccucccgacugcccgggagugggcaccgggugcacagcuuguggccuguaucucgaucaacugaagccuguuggaaccgcguuuaaaaucauuagcgugcgguacucuagaaaggucugcgugcaguucggcgaagaguaucuuuguaagaccaucgacaugaacgauugcuuuguuacacgccacgccaaaaucuguauuaucgggacgguguccaaguucagccagggagacacccugcucuuucugggccccauggaagggggaggcauuaucuucaaacauuggugcacauccaccugucacuuuggggaucccggcgacgucaugggaccuaaggacaaaccguucauuugccccgaguuuccuggccaguuccggaagaaauguaauuucgcuacaacccccgugugcgaauacgaugggaacaucauuucuggauacaagaagguucuggccacgaucgacagcuuucaauccuucaauacaucuaacauccauuuuaccgaugagagaauugaguggcgcgacccugauggcaugcuucgggaccacaucaauauugugaucagcaaagauauugacuucgaaaaccucgccgagaaucccuguaaggucgggcugcaggcugccaacaucgaaggagcguggggcuccggggugggcuuuacccugacaugccaggugucucucaccgagugcccuacauuccugacgagcaucaaggcuugugauauggccauuugcuauggagccgaauccgucacccuuagcagaggccaaaauacaguuaagaucaccgggaaaggaggccacucuggguccagcuuuaaguguugccauggaaaggaguguucuuccacaggccugcaggcuagcgcuccccaccucgacaaagugaacggcauuucugagcuggaaaaugagaagguguacgaugacggggcgccggaaugcggagucaccuguugguucaaaaaguccggcgagugggugauggggaucauuaacggaaauuggguugugcugaucguccuuugcgugcuccugcuguuuagccucauccugcuuuccauucuguguccuguucgcaaacauaaaaagagcuga

SEQ ID NO: 13514 - RNA, 3402 nt, Artificial Sequence
  derived and/or modified CDS sequence (opt5) from SEOV(YongjiaRf45)__GU592926.1__GP
auguggggccugcuccugcuugccgcuaugguggggcagggaagcgcccugaagaacgucuucgacaugaaaauccaaugcccccacuccguuaauuuuggcgagaccucugugagcggguacacagaacucccuccgcugccccuucaggaggcggaacagcuggugccugaguccucuuguaacauggauaaucaucagagccucuccacgauuaacaagcugaccaaagucaucuggagaaagaaagcuaaucaagaaucugccagccagaacuccuucgaggugguugagagcgaagugucuuuuaagggacugugcaugcucaagcaccggauggucgaggaauccuaucgcaauagacggagcgugauuuguuacgaccuggccugcaacacaaccuucuguaaacccacaguuuauaugaucgugccuauucaugcuugcaauaugaugaagucuugucuuaucggccuggggcccuaccgcauccaggucauuuaugagagaaccuacugcuccacaggaauccucaccgagggcaaauguuuugugcacgauaagacgguggucagcgcccugaaacggggcauguaugcuauugccucuaucgaaaccguuugcuucuuugugcaucagaaggggaacacauacaagauugugaccgcgaucacauccgccaugggaagcaaauguaauaacaccgacuccaagguccaaggcuacuauauuugcaucaucgggggaaauucugcuccuguguacgccccggcuggcgaggauuuccgcgccauggaaguuuuuagcgggauuaucacgagcccccacggagaggaccacgaucuuccuggcgaagagguggcgacauaucagauuagcggccagaucgaggccaaaauuccccauaccgucucuuccaagaaccugaaacucacagcuuucgccgggaucccuagcuacucuagcaccucccugcuggcugccucugaagacggaagauuuaucuucagccccggccucuuuccgaaucugaaccaguccgugugcgauaacaaugcccuuccucugauuuggcgggggcucaucgaccugaccggauauuacgaggcuguucaccccuguaacguguucugcguccuuagcggcccuggggcgucuugugaagccuucuccgagggaggcauuuuuaauaucacaagccccaugugccuggugucuaagcaaaaccgcuucagagcugccgaacagcagauuuccuuuaucugucaacgggucgauauggacaucauuguguauugcaauggccagaaaaagacgauccucaccaagacacugguuauugggcaguguaucuacaccauuacaagccuguucucccuccugcccggaguggcccauucuaucgcuauugagcuuugcgucccuggcuuucacgggugggccaccgcggcucugcucaucacguucuguuuuggaugggugcugaucccggccugcacacuugccguucuccucuuccugaaauuuuucgcuaacauucugcacaccagcaaucaggagaaccgcuuuaaggccauccucagaaaaauuaaggaagaguucgagaaaaccaagggcuccauggugugugaaaucugcaaguacgaaugcgagacacugaaagagcuuaaggcucauaaucugucuuguguccaaggggaaugccccuauuguuuuacccacugcgagccuacagaaacggccauucaggcgcauuacaaagugugucaggccacccaccgguuccgcgaggaucucaagaaaacagugacaccccagaacaucggcccuggaugcuauagaacccugaaucuguuccgguacaagagcagauguuauauccuuaccauguggauucuccugcugguuaucgaguccauucucugggcugccagcgcugccgaaaucccccuggucccgcuuuggacggacaacgcgcauggcguggggucugugccuaugcacaccgaccuggagcucgauuuuucccugcccuccucuuccaaguacacauauaaacgccaccugaccaauccugucaacgaccaacagagcgugucucuucauauugaaaucgagagccagggaaucggcgccgauguucaccaucucgggcacugguacgacgcucggcugaaucugaagacauccuuccacugcuacggagccuguaccaaauaucaguaccccuggcauacggcuaagugcuauuuugaaaaagauuacgaguaugagaacagcugggccuguaacccucccgacugcccgggcguggggauuggcugcacagccuguggacucuaccuggaucaacuuaagccugucggcaccgcuuucaagaucauuucugugagauauucccgcaaaguuugcgugcaguuuggggaagaguaccuguguaagacaaucgacaugaaugauugcuucgucacccggcacgcgaaaauuuguaucaucggaaccgugagcaaguuuucccagggcgacacacuccuguuccuggggcccauggaaggaggcgggauuaucuuuaaacauuggugcacgucuaccugucacuucggcgaucccggagacguuaugggcccuaaggacaaaccguuuauuugccccgaguucccugggcaguuuagaaagaaguguaacuucgccacaacccccgugugcgaauacgauggaaaugucuucagcggcuaucgcaaauuucuugcuacaaucgacuccuuccaaucuuuuaacaccagcaaugugcauuucacggaugagcggauugaguggagagacccugaugggaugcuccgcgaccacaucaacauugugaucuccaaggauaucgacuuugaaaaucuggccgauaaccccuguaaagucggacugcaggccgcuaauauugagggcgccugggggucuggcguuggauucacacugaccugccaggugagccugaccgaaugcccuacauuucuuaccuccaucaaggcgugugacauggcuauuugcuacggcgccgagagcgugacacugucucgggggcaaaacacggucaaaaucaccggaaagggcgggcacuccggaagcucuuucaaguguugccauggcaaagaauguuccagcaauggccuccaggccucugcuccccaccuggauaaggugaacgggauuuccgagcuggagaaugaaaaaguuuaugacgauggagccccggagugcggcaucacauguugguuuaagaaaagcggggaaugggugaugggaaucauuaacggcaauuggaucguccuuauugugcucugcguucugcuccuguucucccugauccuucugagcauucucuguccugugagaaagcauaagaaaucuuga

SEQ ID NO: 13515 - RNA, 3402 nt, Artificial Sequence
  derived and/or modified CDS sequence (opt5) from SEOV(YongjiaRn14)__GU592927.1__GP
auguggggccugcuccugcuugccgcuaugguggggcagggaagcgcccugaagaacgucuucgacaugaaaauccaaugcccccacuccguuaauuuuggcgagaccucugugagcggguacacagaacucccuccgcugccccuucaggaggcggaacagcuggugccugaguccucuuguaacauggauaaucaucagagccucuccacgauuaacaagcugaccaaagucaucuggagaaagaaagcuaaucaagaaucugccagccagaacuccuucgaggugguugagagcgaagugucuuuuaagggacugugcaugcucaagcaccggauggucgaggaauccuaucgcaauagacggagcgugauuuguuacgaccuggccugcaacacaaccuucuguaaacccacaguuuauaugaucgugccuauucaugcuugcaauaugaugaagucuugucuuaucggccuggggcccuaccgcauccaggucauuuaugagagaaccuacugcacaaccggaauccucacggagggcaaauguuuugugccugauaaggccguggucuccgcucugaaacggggcauguaugccauugcgagcaucgaaaccguuugcuucuuugugcaccagaaggggaacacauacaagauugugaccgccaucacaucugcuaugggauccaaauguaauaacaccgacagcaagguccaaggcuacuauauuugcaucaucgggggaaauuccgccccgguguacgcucccgccggcgaggauuuccgcgcgauggaaguuuuuagcgggauuaucacgagcccucauggagaggaccacgaucuucccggcgaagagguggccacauaucagauuuccggccagaucgaggcuaaaauuccucacaccgucagcucuaagaaccugaaacucacagccuucgcugggauccccuccuacagcucuaccagccugcuggccgccuccgaagacggaagauuuaucuucucuccgggccucuuuccuaaucugaaccagagcgugugcgauaacaaugcucucccccugauuuggcgggggcucaucgaccugaccggauauuacgaggcgguucauccuuguaacguguucugcguccuuuccggccccggggccagcugugaggcuuucucugaaggaggcauuuuuaauaucacaucccccaugugccuggugagcaagcaaaaccgcuucagagccgccgaacagcagauuucuuuuaucugucaacgggucgauauggacaucauuguguauugcaauggccagaaaaagacgauccucaccaagacacugguuauugggcaguguaucuacaccauuacaucccuguucagccuccugccuggaguggcucacuccaucgccauugagcuuugcgucccgggcuuucaugggugggcgaccgcugcccugcucaucacguucuguuuuggaugggugcugauccccgccugcacacuugcuguucugcuuuuccugaaauuuuucgccaacauucugcacaccucuaaucaggagaaccgcuuuaaggcuauccucagaaaaauuaaggaagaguucgagaaaaccaagggcagcauggugugugaaaucugcaaguacgaaugcgagacacugaaagagcuuaaggcccacaaucuguccuguguccaaggggaaugcccuuauuguuuuacccauugcgagcccacagaaacggcgauucaggcccacuacaaagugugucaggcuacccaucgguuccgcgaggaucucaagaaaacagugaccccucagaacaucggccccggaugcuauagaacacugaaucuguuccgguacaagucuagauguuauauccuuaccauguggauucuccugcugguuaucgagagcauucucugggccgcuuccgccgcggaaaucccgcuggucccucuuuggacggacaacgcccacggcguggggagcgugcccaugcauaccgaccuggagcucgauuuuucucugccuuccagcucuaaguacacauauaaacgccaccugaccaaucccgucaacgaccaacaguccgugagccuucacauugaaaucgagucucagggaaucggcgcugauguucaucaccucgggcauugguacgacgcccggcugaaucugaagacaucuuuccacugcuacggagcuuguaccaaauaucaguacccuuggcacacggccaagugccauuuugaaaaagauuaugaguacgagaacuccugggccuguaaucccccggacugcccuggcguggggacaggcugcaccgcuuguggacucuaucuggaucaacuuaagcccgucggcacagcguucaagauuaucagcgugagauacucucgcaaaguuugcgugcaguuuggggaagaguaucuguguaagaccauugacaugaacgauugcuucgucacccggcacgccaaaaucuguauuaucggaacaguguccaaguuuagccagggcgacacgcuccuguuccuggggcccauggaaggaggcgggaucauuuuuaaacauuggugcaccuccacaugucacuucggcgauccuggagacguuaugggcccgaaggacaaacccuuuaucugcccugaguuccccgggcaguuuagaaagaaguguaacuucgcuaccacaccugugugcgaauacgauggaaaugucauuucuggcuaccgcaaagugcuugccaccaucgacagcuuccaauccuuuaacacgucuaaugugcauuucacagaugagcggauugaguggagagaccccgaugggaugcuccgcgaccacaucaacauugucaucagcaaggauaucgacuuugaaaaucuggccgagaacccuuguaaaguuggacugcaggcugccaauauugaaggcgcguggggguccggcgugggauucacccugaccugccaggugucucugacagagugccccaccuuucuuacaagcaucaaggcuugugauauggccauuugcuauggcgccgaauccgucacgcugagccgggggcaaaacaccgugaaaaucacaggaaagggcgggcacucuggauccagcuucaaguguugccauggcaaagaguguucuuccaauggccuccaggcuagcgccccgcaccuggacaagguuaacgggauuucugagcuggaaaaugagaaaguguacgaugacggagcgccugaaugcggcaucaccuguugguuuaagaaauccggggagugggucaugggaaucauuaacggcaauuggaucgugcuuauuguucucugcgugcugcuccucuucagccugauccuucuguccauucucugucccgucagaaagcauaagaaaagcuga

SEQ ID NO: 13516 - RNA, 3402 nt, Artificial Sequence
  derived and/or modified CDS sequence (opt5) from SEOV(ZT10)__DQ159911.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaaguacaagaucgugaccgccauuacauccgcuauggggagcaaauguaacaauaccgacacaaaggugcagggauacuauaucugcaucauuggcgggaacuccgccccugucuacgcuccggccggagaggauuuuagagcgauggaaguguucucuggcaucauuaccagcccccauggggaggaccacgaucugccuggagaagagaucgccacguaucagauuuccggccagaucgaggcuaaaaucccccacacaguuagcucuaagaaucucaaacugaccgccuuugcuggcauuccuuccuacagcucuacaagcauccuggccgccuccgaagacgggcgguucauuuuuagccccggacucuucccgaaccugaaccagagcgugugcgauaauaacgcccuuccucugaucuggcgcggccucauugaccugaccggguauuacgaggcgguccaucccuguaauguguucugcguucuuuccggaccuggcgccagcugugaggcuuuuucugaagggggaaucuucaacaucaccucccccaugugccuggugagcaagcaaauuagauuucgggccgccgaacagcagaucucuuucauuugucaacgcgucgauauggacaucauuguguauugcaauggccagaaaaagacaauccucacgaagacccuggucauuggccaguguaucuacacaaucaccucccuguuuagccuccugcccgggguggcucacuccauugccaucgagcuuugcguuccuggauuccauggcugggcgacagcugcccugcucauuaccuuuuguuucgggugggugcugaucccggccugcacgcuugcuauucugcucguccugaaauuuuucgccaacauccugcacacaucuaaucaggagaacagauuuaaggcuauccuccggaaaauuaaggaagaguucgagaaaaccaagggaagcauggugugugaaaucugcaaguacgaaugcgagacccugaaagagcuuaaggcccacaaucuguccuguguucaaggcgaaugccccuauuguuuuacacauugcgagccuaccgaaacagcgauucaggcccacuacaaagugugucaggcuacgcaucgcuucagagaggaucucaagaaaaccgucacaccccagaacaucgggccuggcugcuaucggacccugaaucuguucagauacaagucucgcuguuauauucuuacaauguggacccuccugcugaucaucgagagcauucucugggccgcuuccgccgcggaaaucccccuggugccgcuuuggacggacaacgcccacggagugggcagcguuccuaugcauaccgaccuggagcucgauuuuucucugcccuccagcucuaaguacacauauaaacggcaccugaccaauccugucaacgaccaacaguccgugagccuucacauugaaaucgagucucaggggauuggagcugaugugcaucaccucggccauugcuacgacgccagacugaaucugaagacaucuuuccacuguuacggggcuugcaccaaauaucaguaccccuggcacacggccaagugucauuuugaaaaagauuaugaguacgagaacuccugggccugcaacccucccgacugcccgggagucggcacaggguguaccgcuugcggccucuaucuggaucaacuuaagccugugggaacagcguucaagaucaucagcguucgcuacucucggaaaguguguguccaguuuggcgaagaguaucugugcaagaccauugacaugaaugauuguuucgugaccagacacgccaaaaucugcauuaucgggacaguuuccaaguuuagccagggagacacgcuccuguuccugggccccauggaagggggaggcauuaucuuuaaacauugguguaccuccacaugccacuucggggaucccggcgacgugaugggaccuaaggacaaaccguuuauuugucccgaguucccuggccaguuucgcaagaagugcaacuucgcuaccacacccgucugugaauacgaugggaauaucaucucuggauacaaaaaggugcuugccaccauugacagcuuccaauccuuuaacacgucuaauauccauuucacagaugagcggauugaguggagagacccugauggcaugcuccgcgaccacaucaacauuguuaucagcaaagauaucgacuuugaaaaucuggccgagaaccccugcaagguggggcugcaggcugccaauauugaaggagcguggggccucggggucggcuucacccugaccugccaggugucccuuacagaguguccuaccuuucugacaucuaucaaggcuugcgauauggccauuuguuauggagccgaaagcgugacgcucucccggggccaaaacaccgucaaaaucacagggaagggaggccacagcgggucuuccuucaaaugcugucauggaaaggagugcagcucuaccggccugcaggcuuccgcuccccaccuggacaaaguuaauggcauuagcgagcuugaaaacgagaagguguacgaugacggggcgccggaauguggaaucacaugcugguuuaaaaagucuggcgagugggugauggggaucauuaauggaaacugggucgugcucaucguucugugugugcugcuccuguucucccuuauucugcucagcauccugugcccugucagaaagcauaaaaaguccuga

SEQ ID NO: 13517 - RNA, 3402 nt, Artificial Sequence
  derived and/or modified CDS sequence (opt5) from SEOV(ZT71)__EF117248.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucuggccgagggaaaguguuucgugcccgauaaagcugucguuagcgcccuuaagcgcggcauguaugcgaucgccucuauugaaaccaucugcuuuuucauucaccagaaaggcaauaaguacaagaucgugacggcuauuaccuccgccauggggagcaaauguaacaauacagacaccaaggugcagggauacuauaucugcaucauuggcgggaacuccgcuccugucuacgccccggcgggagaggauuuuagagccauggaaguguucucuggcaucauuacaagcccccauggggaggaccacgaucugccuggagaagagaucgcuaccuaucagauuuccggccagaucgaggccaaaaucccccacacgguuagcucuaagaaucucaaacugacagcuuuugccggcauuccuuccuacagcucuaccagcauccuggccgcuuccgaagacgggcgguucaucuuuucucccggacucuucccgaaccugaaccagagcgugugcgauaauaacgcgcuuccucugauuuggcgcggccucauugaccugacaggguauuacgaggccguccaucccuguaauguguucugcguucuuuccggaccuggcgcuagcugugaagccuuuucugaagggggaaucuucaacaucaccucccccaugugccuggugagcaagcaaaauagauuucgggccgcugaacagcagauuucuuucaucugucaacgcgucgauauggacauuaucguguauugcaacggccagaaaaagaccauucucacaaagacgcuggucaucggccaguguauuuacaccaucacaucccuguuuagccuccugcccgggguggcccacuccaucgcgauugagcuuugcguuccuggauuccauggcugggcuaccgccgcccugcucaucacauuuuguuucgggugggugcugauuccggcuugcacccuugccauccugcucguccugaaauuuuucgcuaauauucugcacacgucuaaccaggagaauagauuuaaggccauccuccggaaaaucaaggaagaguucgagaaaacaaagggaagcauggugugugagauuugcaaguacgaaugcgagacccugaaagagcuuaaggcgcacaaccuguccuguguucaaggcgaaugccccuauuguuuuacccauugcgagccuacagaaaccgccauccaggcucacuacaaagugugucaggccacacaucgcuucagagaggaucucaagaaaacggucacaccccagaauauugggccuggcugcuaucggacccugaaccuguucagauacaagucucgcuguuauauccuuaccauguggacacuccugcugauuaucgagagcauccucugggcugccuccgcggccgaaauuccccuggugccgcuuuggaccgacaaugcucacggagugggcagcguuccuaugcauacggaccuggagcucgauuuuucucugcccuccagcucuaaguacaccuauaaacggcaccugacaaacccugucaaugaccaacaguccgugagccuucacaucgaaauugagucucaggggaucggagccgaugugcaucaccucggccauugguacgacgcugggcugaaccugaagaccagcuuccacugcuacggagccuguacaaaauaucaguaccccuggcacaccgccaagugccauuuugaaaaagauuaugaguacgagaacuccugggcuuguaauccucccgacugcccgggcgucgggacgggcugcacagcguguggacucuaucuggaucaacuuaagccugugggcaccgccuucaagauuaucagcguuagauacucucgcaaagugugcguccaguuuggggaagaguaucuguguaagacaaucgacaugaacgauugcuucgugacccggcacgcuaaaauuuguaucauuggaaccguuuccaaguuuagccagggcgacacacuccuguuccuggggcccauggaaggaggcgggaucauuuuuaaacauuggugcacguccaccugucacuucggcgaucccggagacgugaugggcccuaaggacaaaccguuuaucugccccgaguucccugggcaguuuagaaagaaguguaauuucgccacaacccccgucugcgaauacgauggaaacauuaucucuggcuacaaaaaggugcuugccacaaucgacagcuuccaauccuuuaauaccucuaacauucauuucacggaugagcgcaucgaguggcgggacccugaugggaugcucagagaccacauuaauaucguuauuagcaaagauaucgacuuugaaacacuggcugagaaccccuguaaggugggacugcaggccgcgaauaucgaaggcgcuuggggguccggcgucggauucacccugaccugccaggugucucugacagagugcccuaccuuucuuacaagcauuaaagccugugauauggccaucugcuauggcgcugaauccgugacgcugagccgcgggcaaaacaccgucaagauuacaggaaagggcgggcacucuggauccagcuucaaauguugccauggcaaggaguguucuuccaccggccuccaggccagcgcgccccaccuggacaaaguuaaugggaucucugagcuggaaaacgagaagguguacgaugacggagcuccggaaugcggcauuacauguugguuuaaaaaguccggggagugggugaugggaaucaucaauggcaacugggucgugcuuauuguucucugcgugcugcuccucuucagccugauccuucuguccauucucuguccuguccggaagcauaaaaagagcuga

SEQ ID NO: 13518 - RNA, 3402 nt, Artificial Sequence
  derived and/or modified CDS sequence (opt5) from SEOV(DN2)__KX289953.1__GP
auguggagccugcuccugcuugccgcucuggccggccagggguucgcgcucaagaacguguuugacaugagaauccaaugcccccacuccgucaauuucggagagaccucuguuagcggcuacacagaacugccuccgcuuucccugcaggaggcugaacagcucgugcccgagucuagcuguaacauggauaaucaucagucccugucuacgauuaacaaacugaccaaggugaucuggcggaaaaaggccaaucaagaaagcgccucccagaacagcuuugaggucguggagucugaaguuuccuucaaagggcucugcaugcugaagcaccgcaugguggaggaaagcuauagaaaucggcgcucugucauuuguuacgaccuugcuugcaacuccacauuuuguaagccuaccguguauaugaucguucccauucaugccugcaauaugaugaaaagcugucugaucggacucggcccuuacagaauccagguggucuaugagcggacauacugcaccacagggauucugaccgagggaaaguguuucgugcccgauaaagcuguggucucugcccuuaagcgcggcauguaugcgaucgccuccauugaaacgaucugcuuuuucauucaccagaaaggcaacaccuacaagaucguuacagcuauuaccagcgccaugggguccaaguguaauaacacagacaccaaagugcaaggauacuauaucugcaucauuggcggaaauucugcuccuguguacgccccggcgggggaggauuuuagagccauggaagucuucagcggcaucauuacgagcccccauggggaggaccacgaucugccuggagaagagaucgcuacauaucagauuagcggccagaucgaggccaagaucccccacaccgugucuuccaaaaaccucaagcugacagcuuuugccggcauuccuagcuacucuagcaccuccauccuggccgcuucugaagacgggcgguucauuuuuagccccggacucuucccgaaucugaaccaguccguuugcgauaacaaugcgcuuccucugaucuggcgcggccucauugaccugaccggguauuacgaggccgugcaucccuguaacgucuucugcgugcuuagcggaccuggcgcuucuugugaagccuuuuccgaagggggaaucuucaauaucacaagccccaugugccugguuucuaaacaaaacagauuucgggccgcugagcagcagauuuccuucgugugucaacgcaucgauauggacauuaucgucuauugcaauggccagaagaaaacgauucucaccaagacacuggugaucggccaguguauuuacaccaucacaagccuguuuucccuccugcccggggucgcccacucuaucgcgauugagcuuugcgugccuggauuccauggcugggcuaccgccgcccugcucaucacguuuuguuucggguggguucugauuccggcuugcacacuugccauccugcucgugcugaaguuuuucgcuaacauucugcacaccagcaaucaggagaacagauuuaaagccauccuccggaagaucaaagaagaguucgaaaagaccaaaggauccauggucugugagauuugcaaguacgaaugcgagacacugaaggagcuuaaagcgcacaaucugucuugugugcaaggcgaaugccccuauuguuuuacccauugcgagccuacagaaacggccauccaggcucacuacaagguuugucaggccacccaucgcuucagagaggaucucaaaaagacagugacaccccagaacauugggccuggcugcuaucggacccugaaucuguucagauacaaaagccgcuguuauauccuuaccauguggacgcuccugcugauuaucgaguccauccucugggcugccagcgcggccgaaauuccccugaucccgcuuuggaccgacaacgcucacggagucggcucugugccuaugcauacagaccuggagcucgauuuuucccugcccuccucuuccaaguacaccuauaagcggcaccugacaaauccugugaacgaccaacagagcguuucucuucacauugaaaucgagagccaggggauuggagccgauguccaucaccucggccauugguacgacgcuagacugaaucugaaaaccuccuuccacugcuacggggccuguacgaaguaucaguaccccuggcacacagccaaaugccauuuugaaaaggauuaugaguacgagaacagcugggcuuguaacccucccgacugcccgggagugggcaccgggugcacagcguguggccucuaucuggaucaacuucgcccugugggaaccgccuucaaaaucaucucuguccgguacuccagaaaggugugcguucaguuuggcgaagaguaucuguguaagaccauugacaugaaugauugcuucgugacacgccacgcuaaaaucuguauuaucgggacggucagcaaguuuucccagggagacacccuccuguuccugggccccauggaagggggaggcauuaucuuuaaacauuggugcacaucuaccugucacuucggggaucccggcgacgugaugggaccuaaggacaaaccguuuauuugccccgaguucccuggccaguuucggaagaaauguaacuucgccacaacccccguuugcgaauacgaugggaauacgaucagcggauacaagaaggugcuugccacaaucgacuccuuccaaucuuuuaacaccagcaauauucauuucaccgaugagagaaucgaguggcgcgacccugauggcaugcuccgggaccacauuaacaucgucauuuccaaagauaucgacuuugaaaaucuggcugagaaccccuguaagguggggcugcaggccgcgaauaucgaaggagcuuggggcucugggguuggcuucacacugaccugccaggugagccugacagagugcccuacguuucuuaccuccauuaaagccugugauauggccaucugcuauggagcugaaagcgucacacugucuagaggccaaaacaccgugaagauuacagggaaaggaggccacuccgggagcucuuucaaguguugccauggaaaggaguguuccagcaccggccuccaggccucugcgccccaccuggacaaagugaauggcaucuccgagcuggaaaacgagaaggucuacgaugacggggcuccggaaugcggaauuacguguugguuuaaaaagagcggcgaguggguuauggggaucaucaauggaaacuggguggugcuuauuguccucugcgugcugcuccucuucucccugauccuucugagcauucucuguccuguucgcaaacauaagaagucuuga

SEQ ID NO: 13519 - RNA, 3402 nt, Artificial Sequence
  derived and/or modified CDS sequence (opt5) from SEOV(IR162)__KX079475.1__GP
auguggagccugcuccugcuugccgcccuggugggcagaggguucacccucaagaacgucuuugacaugcggauccagugcccccacuccguuaauuucggagagacaucugugagcggcuacacggaacugccuccgcuuucccugcaagaggccgaacagcucgugcccgagucuagcuguaacauggauaaucaucagucccugucuaccauuaacaaacugacaaaggucaucuggcgcaaaaaggcgaaucaggaaagcgcuaaccaaaauuccuuugaggugguugagagcgaagugucuuucaaagggcucugcaugcugaagcacagaauggucgaggaauccuaucggaaccgcagaagcgugauuuguuacgaccuugccugcaauucuaccuuuuguaagccuacaguuuauaugaucgugcccauucaugccugcaacaugaugaaauccugucugaucggacucggcccuuaccggauccaggucguguaugagcgcaccuacugcacaaccgggauucugacggagggaaaguguuucgugcccgauaaagcugucguuagcgcccuuaagagaggcauguaugcuaucgccucuauugaaaccaucugcuuuuucauucaccagaaaggcaauacauacaagaucgugaccgcgauuacauccgccauggggagcaaguguaacaauaccgacacgaaagugcagggauacuauaucugcaucauuggcgggaacuccgcuccugucuacgccccggcuggagaggauuuucgggccauggaaguguucucuggcaucauuacaagcccccauggggaggaccacgaucugccuggagaagagaucgcgaccuaucaaauuuccggccagaucgaggccaagaucccccacacaguuagcucuaaaaaucucaagcugaccgcuuuugccggcauuccuuccuacagcucuaccagcgugcugaucgcuuccgaagacgggcgcuucauuuuuagccccggacucuucccgaaccugaaccagagcgucugcgauaauaacgcccuuccucugaucuggagaggccucauugaccugacaggguauuacgaggccgugcaucccuguaauguuuucugcgugcuuuccggaccuggcgcuagcugugaagcguuuucugaagggggaaucuucaacaucacgucccccaugugccuggucagcaaacagaaucgguuucgcgccgcugagcaacagauuucuuucgugugucagagagucgauauggacaucauuguguauugcaacggccaaaagaaaaccauccucacaaagacccugguuauuggccaguguaucuacacaauuaccucccuguuuagccuccugcccgggguggcccacuccaucgccaucgagcuuugcgucccuggauuccauggcugggcuacggccgcgcugcucauuacauuuuguuucgggugggugcugaucccggcuugcacccuugccauucugcucguucugaaguuuuucgccaauauccugcacaccucuaaccaggagaaucgguuuaaagcuauucuccgcaagaucaaagaagaguucgaaaagacaaaaggaagcauggugugugagaucugcaaguacgaaugcgagacccugaaggagcuuaaagcccacaaccuguccuguguccagggcgaaugccccuauuguuuuacacauugcgagccuacggaaaccgcuauucaagcccacuacaaggugugucaggcgacacauagauuccgggaggaucucaaaaagaccgugacaccccagaauaucgggccuggcugcuauagaacccugaaccuguuccgcuacaaaucucgguguuauauucuuacgauguggacccuccugcugaucauugagagcauccucugggccgcuuccgccacagaaaucccccugguuccgcuuuggaccgacaaugcucacggagucggcagcgugccuaugcauacagaccuggagcucgauuuuucucugcccuccagcucuaaguacaccuauaagagacaccugacgaacccugugaaugaccagcaauccgucagccuucacauugaaaucgagucucaggggauuggagccgaugugcaucaccucggccauugguacgacgcgcgccugaaccugaaaacaucuuuccacugcuacggggccuguaccaaguaucaguaccccuggcacacagcuaaaugccauuuugaaaaggauuaugaguacgagaacuccugggccuguaauccucccgacugcccgggaaucggcaccgggugcaccgcuuguggccucuaucuggaucagcuuaaaccuguuggaacagccuucaagauuaucagcgugcgguacucuagaaaggucugcgugcaauuuggcgaagaguaucuguguaaaacgaucgacaugaacgauugcuucguuacccgccacgccaagauuuguaucauugggacaguguccaaauuuagccagggagacacccuccuguuccugggccccauggaagggggaggcaucauuuuuaagcauuggugcacauccaccugucacuucggggaucccggcgacgucaugggaccuaaagacaagccguuuaucugccccgaguucccuggccaguuucggaaaaaguguaauuucgcuacgacacccgugugcgaauacgaugggaacauuaucucuggauacaagaaaguucuugcgaccaucgacagcuuccaguccuuuaauaccucuaacauucauuucacagaugagagaaucgaguggcgcgacccugauggcaugcuccgggaccacauuaauaucgugauuagcaaggauaucgacuuugaaaaccuggccgagaaucccuguaaagucgggcugcaagcugccaacaucgaaggagccuggggcuccggggugggcuucacccucacaugccaggugucucugacggagugcccuaccuuucuuacaagcauuaaggcuugugauauggccaucugcuauggagcggaauccgucacccugagcagaggccagaauacaguuaaaauuaccgggaagggaggccacucuggguccagcuucaaguguugccauggaaaagaguguucuuccacgggccuccaagcuagcgcuccccaccuggacaaggugaacggcaucucugaucuggagaaugaaaaaguguacgacgauggggccccggagugcggaauuaccuguugguuuaagaaauccggcgaaugggucauggggaucaucaacggaaauugggugguucuuauugugcucugcguccugcuccuguucagccugauccuucuguccauucucuguccugugcgcaagcauaagaaaagcuga

SEQ ID NO: 13520 - RNA, 3402 nt, Artificial Sequence
  derived and/or modified CDS sequence (opt5) from SEOV(Gou3)__AF145977.2__GP
auguggggccugcuccugcuugccgcucugguggggcagggacucgcccugaagaacgucuucgacaugaaaauccaaugcccccacagcguuaauuuuggcgagaccuccgugucuggguacacagaacuuccuccgcugccccuccaggaggcggaacagcuggugccugagagcuccuguaacauggauaaucaucagucucugagcacgauuaacaagcucaccaaagucaucuggagaaagaaagcuaaucaagaauccgccucucagaacagcuucgaggugguugagaaugaaguguccuuuaagggacugugcaugcuuaagcaccggauggucgaggaaagcuaucgcaacagacggucugugauuuguuacgaccuggccugcaauacaaccuucuguaaacccacaguuuauaugaucgugccuauucaugcuugcaacaugaugaaguccugucucaucggccuggggcccuaccgcauccaggucauuuaugagagaaccuacugcacaaccggaauccuuacggagggcaaauguuuugugccugauaaggccguggucagcgcucugaaacggggcauguaugccauugcgucuaucgaaaccauuugcuucuuuguucacaagaaggggaauacauacaaaaucguguccgccauuacccucgcuaugggaagcaaguguaacaauacagacucuaaagugcagggcuacuauaucugcaucauugggggaaacuccgccccggucuacgcucccgccggcgaggauuuccgcgcgauggaaguguuuagcgggaucauuaccuccccucauggagaggaccacgaucugcccggcgaagagaucgccacguaucaaauuucuggccagaucgaggcuaagaucccucacacaguuagcuccaaaaaucugaagcucaccgccuucgcugggauucccagcuacucuuccacaagcauccuggccgccucugaagacggaagauuuauuuucagcccgggccuuuuuccuaaccugaaccaguccgugugcgauaauaacgcucucccccugaucuggcgggggcuuauugaccugaccggauauuacgaggcgauccauccuuguaaugucuucugcgugcucucuggccccggggccagcugugaggcuuucuccgaaggaggcaucuuuaacauuaccagccccaugugccugguuucuaaacagaaucgcuucagagccgccgaacaacagaucuccuuuauuugucagcggguggauauggacaucgucguguauugcaacggccaaaagaagacaauucugacgaaaacccucgucaucgggcaguguauuuacacaaucaccagccuguucucucuucugccuggaguggcucacuccaucgccauugagcucugcguuccgggcuuucaugggugggcgacagcugcccugcuugugaccuucuguuuuggauggguccugauccccgccugcacgcucgcugugcugcuguuccucaaguuuuucgccaauauucugcacacaagcaaccaggagaaucgcuuuaaagcuauccuuagaaagauuaaagaagaguucgaaaagaccaagggcuccaugguuugugagaucugcaaauacgaaugcgagacccugaaggagcucaaagcccacaaccugucuugugugcagggggaaugcccuuauuguuuuacacauugcgagcccaccgaaacagcgauccaagcccacuacaaggucugucaggcuacgcaucgguuccgcgaggaucugaaaaagaccgugacaccucagaauauuggccccggaugcuauagaacccuuaaccucuuccgguacaagagcagauguuauauccugacaauguggauucugcuccuggugaucgaguccauucuuugggccgcuucugccgcggaaaucccgcugguuccucucuggaccgacaaugcccacggcgucgggagcgugcccaugcauacggaccuggagcuggauuuuucccuuccuucuagcuccaaauacaccuauaagcgccaccucacaaaccccgugaaugaccagcaaagcgucucucugcacaucgaaauugagucccagggaaucggcgcugaugugcaucaccuggggcauugguacgacgcccggcucaaccugaaaaccagcuuccacugcuacggagcuuguacaaaguaucaguacccuuggcacaccgccaaaugccauuuugaaaaggauuaugaguacgagaacucuugggccuguaaucccccggacugcccuggcguuggggcuggcugcacggcguguggacuuuaucuggaucagcucaagcccgugggcacagccuucaaaauuaucagcgucagauacucccgcaaggugugcguucaauuuggggaagaguaucuguguaaaaccauugacaugaacgauugcuucgugacacggcacgcuaagaucuguaucauuggaaccgucagcaaauuuucucagggcgacacccugcuuuuccucgggcccauggaaggaggcgggaucauuuuuaagcauuggugcacauccacgugucacuucggcgauccuggagacgugaugggcccgaaagacaagcccuuuaucugcccugaguuccccgggcaguuuagaaagaaauguaauuucgccaccacaccuguuugcgaauacgauggaaacgugauuagcggcuaccgcaagguccuggccaccaucgacuccuuccagucuuuuaauacaagcaacgugcauuucaccgaugagcggauugaguggaaagaccccgaugggaugcugagagaccacaucaauaucgugauuuccaaggauaucgacuuugaaaaccucgcugagaauccuuguaaagucggacugcaagccgcgaacauugaaggcgcuugggggucuggcguuggauucacgcuuacaugccaggugagccugaccgagugccccaccuuucucacauccaucgaagccugugauauggccauuugcuauggcgcugagucugugacccugagccgcgggcagaauacaaucaagaucacgggaaagggcgggcacuccggaagcucuuucaaauguugccauggcaaggaguguuccgccaacggccugcaagcgagcgcuccgcaccuugacaaagucaaugggauuucugaacucgagaacgaaaagguguacgaugacggagccccugagugcggcaucaccuguugguuuaaaaaguccggggaguggguuaugggaauuaucaauggcaacugggugguccugauugugcugugcguucuccugcuuuucagccugauccuccugucuauccugugucccgugcggaagcauaaaaaguccuga

SEQ ID NO: 13521 - RNA, 3402 nt, Artificial Sequence
  derived and/or modified CDS sequence (opt5) from SEOV(HB55)__AF035832.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucguguggcggaaaaaggcuaaucaagaaagcgccaaccaaaauuccuuugagguuguggagagcgaagucucuuucaaagggcucugcaugcugaagcaccgcaugguggaggaauccuauagaaaccggcgcagcguuaucuguuacgaccuugccugcaauucuacauuuuguaagccuaccguguauaugauuguccccauccaugcuugcaacaugaugaaauccugucugauuggacucggcccuuacagaauccaggugguguaugagcggacauacugcaccacagggauccugaccgagggaaaguguuucguccccgauaaagccguugugggcgcucuuaagcgcggcauguaugccauugcgagcaucgaaacgauuugcuuuuucauccaccagaaagggaauaaguacaagauugugaccgccaucacaucugcuaugggauccaaauguaacaauaccgacacaaagguccaaggcuacuauauuugcaucaucgggggaaacagcgccccuguguacgcuccggccggcgaggauuuuagagcgauggaaguuuucuccgggauuaucaccucuccccauggagaggaccacgaucugccuggcgaagagauugccacguaucagaucagcggccagauugaggcuaaaaucccccacacaguguccagcaagaaucucaaacugaucgccuuugcugggauuccuucuuacuccagcaccucuauccuggccgccagcgaagacggacgguucaucuuuucccccggccucuucccgaaccugaaccagucugucugcgauaauaacgcgcuuccucugauuuggcgcgggcucauugaccugacaggauauuacgaggcugugcaucccuguaauguuuucugcgugcuuagcggcccuggggccuccugugaggcuuuuagcgaaggaggcaucuucaacaucaccucucccaugugccuggucuccaagcaaaauagauuucgggccgccgaacagcagauuagcuucaucugucaacgcguggauauggacauuaucgucuauugcaacggccagaaaaagaccauucucacaaagacgcuggugaucgggcaguguauuuacaccaucacaucucuguuuucccuccugcccggaguugcucacagcaucgccauugagcuuugcgugccuggcuuccaugggugggcgaccgcugcccugcucaucacauuuuguuucggauggguccugauuccggccugcacccuugcuauccugcucgugcugaaauuuuucgccaauauucugcacacguccaaccaggagaauagauuuaaggcuauccuccggaaaaucaaggaagaguucgaaaagacaaagggcucuaugguuugugagauuugcaaguacgaaugcgagacccugaaagagcuuaaggcccacaaccugagcugugugcaaggggaaugccccuauuguuuuacccauugcgagccuacagaaaccgcgauccaggcccacuacaaagucugucaggcuacacaucgcuucagagaggaucucaagaaaacggugacaccccagaauauuggcccuggaugcuaucggacccugaaccuguucagauacaagucccgcuguuauauccuuaccauguggacacuccugcugauuaucgagucuauccucugggccgcuagcgccgcggaaauuccccuggugccgcuuuggaccgacaaugcccacggcguuggguccgucccuaugcauacggaccuggagcucgauuuuagccugcccucuuccagcaaguacaccuauaaacggcaccugacaaacccugugaaugaccaacagucugugucccuucacaucgaaauugagagccagggaaucggcgcugauguccaucaccucgggcauugguacgacgccagacugaaccugaagaccucuuuccacugcuacggagcuuguacaaaauaucaguaccccuggcacaccgccaagugccauuuugaaaaagauuaugaguacgagaacagcugggccuguaauccucccgacugcccgggcguggggacgggcugcacagcuuguggacucuaucuggaucaacuuaagccuguuggcaccgcguucaagauuaucuccgugcgcuacagccggaaagccugcguccaguuuggggaagaguaucuguguaagacaaucgacaugaacgauugcuucgugaccggacacgcuaaaauuuguaucauuggcaccguuucuaaguuuucccagggggacacacuccuguuccugggacccauggaaggcgggggcaucauuuuuaaacauuggugcacgagcaccugucacuucggagaucccggcgacgugauggggccuaaggacaaaccguuuaucugccccgaguucccuggacaguuuagaaagaaguguaauuucgccacaacccccauuugcgaauacgauggcaacaucaucuccggguacaaaaagguccuugccacaauugacucuuuccagagcuuuaauaccuccaacauccauuucacggaugagcgcauugaguggcgggacccugauggaaugcucagagaccacaucaauauugugaucucuaaagauaucgacuuugaaaaccuggcugagaaucccuguaagguuggccugcaggccgcgaacauugaaggggcuuggggcagcggagugggcuucacacugaccugccaggucucccugaccgagugcccuacauuucuuaccucuaucaaagccugugauauggccauuugcuauggggcugaaagcgugacacugucccgcggacaaaauacggugcggaucaccggcaaagggggacacagcgggucuuccuucaaguguugccauggcaaagaguguagcucuacaggccuccaggccuccgcgccccaccuggacaaggucaacggaauuagcgagcuggaaaaugagaaaguuuacgaugacggcgcuccggaaugcggggugaccuguugguuuaagaaaucuggagagugggugaugggcaucaucaacgggaauugggucgugcuuauuguucucugcgugcugcuccucuucucccugauccuucugagcauucucuguccugucagaaagcauaagaaauccuga

SEQ ID NO: 13522 - RNA, 3402 nt, Artificial Sequence
  derived and/or modified CDS sequence (opt5) from SEOV(L99)__AF035833.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucguguggcggaaaaaggcuaaucaagaacucgccaaccagaauagcuuugagguuguggaguccgaagucagcuucaaagggcugugcaugcuuaagcaccgcaugguggaggaaucuuauagaaaccggcgcuccguuaucuguuacgaccuggccugcaauagcacauuuuguaagccuaccguguauaugauuguccccauccaugcuugcaacaugaugaaaucuugucucauuggacugggcccuuacagaauccaggugguguaugagcggacauacugcaccacagggauccuuaccgagggaaaguguuucguccccgauaaagccguuguguccgcucugaagcgcggcauguaugccauugcgagcaucgaaacgauuugcuuuuucauccaccagaaaggcaauaccuacaagauugugacagccaucaccucugcuaugggguccaaguguaacaauacagacaccaaaguccaaggauacuauauuugcaucaucggcgggaacagcgccccuguguacgcuccggccggagaggauuuuagagcgauggaaguuuucuccggcauuaucacgucuccccauggggaggaccacgaucucccuggagaagagauugccacauaucagaucagcggccagauugaggcuaagaucccccacaccguguccagcaaaaaucugaagcugaucgccuuugcuggcauuccuucuuacuccagcacaucuauccucgccgccagcgaagacgggcgguucaucuuuucccccggacuguucccgaaccuuaaccagucugucugcgauaauaacgcucugccucucauuuggcgcggccugauugaccuuaccggguauuacgaggcggugcaucccuguaauguuuucugcgugcugagcggaccuggcgccuccugugaggcuuuuagcgaagggggaaucuucaacaucaccucucccaugugccucgucuccaaacaaaauagauuucgggccgccgaacagcagauuagcuucaucugucaacgcguggauauggacauuaucgucuauugcaacggccagaagaaaacaauucugacgaagacccuggugaucggccaguguauuuacacaaucaccucucucuuuucccugcuucccgggguugcucacagcaucgccauugagcugugcgugccuggauuccauggcugggcgacagcugcccuccugaucaccuuuuguuucggguggguccuuauuccggccugcacgcuggcuauccuccuggugcugaaguuuuucgccaauauucuccacacauccaaccaggagaauagauuuaaagcuauccugcggaagaucaaagaagaguucgaaaagaccaaaggaucuaugguuugugagauuugcaaguacgaaugcgagacccuuaaggagcugaaagcccacaaccucagcugugugcaaggcgaaugccccuauuguuuuacacauugcgagccuaccgaaacagcgauccaggcccacuacaaggucugucaggcuacgcaucgcuucagagaggaucugaaaaagaccgugacacccaaaaauauugggccuggcugcuaucggacccugaaccuuuucagauacaagucccgcuguuauauccucacaauguggacccugcugcucauuaucgagucuauccugugggccgcuagcgccgcggaaauuccccuugugccgcuguggacggacaaugcccacggaguuggcuccgucccuaugcauaccgaccucgagcuggauuuuagccugcccucuuccagcaaguacacauauaaacggcaccuuaccaacccugugaaugaccagcaaucugugucccuccacaucgaaauugagagccaggggaucggagcugauguccaucaccugggccauugguacgacgccagacugaaccucaagacaucuuuccacugcuacggggcuuguaccaaauaucaguaccccuggcacacggccaagugccauuuugaaaaagauuaugaguacgagaacagcugggccuguaauccucccgacugcccgggagugggcacagggugcaccgcuuguggccuguaucuugaucagcugaagccuguuggaacagcguucaagauuaucuccgugcgcuacagccggaaagucugcgugcaauuuggcgaagaguaucucuguaagaccaucgacaugaacgauugcuucguuaccagacacgccaaaauuuguaucauugggacagugucuaaguuuucccagggagacacgcugcuguuccuuggccccauggaagggggaggcaucauuuuuaaacauuggugcaccagcacaugucacuucggggaucccggcgacgucaugggaccuaaggacaaaccguuuuccugccccgaguucccuggccaguuucgcaagaaguguaauuucgcuaccacacccaucugcgaauacgaugggaacauuaucucuggauacaaaaaggugcucgccaccaucgacagcuuccaguccuuuaauacgucuaacauucauuucacagaugagcggaucgaguggagagacccugauggcaugcugcgcgaccacauuaauaucguuauuagcaaagauaucgacuuugaaaaccuggccgagaaucccuguaagguggggcuccaagcugccaacaucgaaggagcguggggcuccggggucggcuucacccugaccugccaggugucucuuacagagugcccuaccuuucugacaagcauuaaagccugugauauggccaucugcuauggagccgaauccgugacgcucagccggggccagaauaccgucagaauuacagggaagggaggccacucuggguccagcuucaaguguugccauggaaaagaguguucuuccaccggccugcaagcuagcgcuccccaccuggacaagguuaacggcaucucugagcuugaaaaugagaaaguguacgaugacggggcgccggaaugcggagugacauguugguuuaagaaauccggcgagugggucauggggauuaucaacggaaauugggugguucucaucgugcugugcguccugcuccuguucagccuuauucugcucuccauccuguguccugugcgcaagcauaagaaaagcuga

SEQ ID NO: 13523 - RNA, 3402 nt, Artificial Sequence
  derived and/or modified CDS sequence (opt5) from SEOV(Z37)__AF187081.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaaguacaagaucgugaccgccauuacauccgcuauggggagcaaauguaacaauaccgacacaaaggugcagggauacuauaucugcaucauuggcgggaacuccgccccugucuacgcuccggccggagaggauuuuagagcgauggaaguguucucuggcaucauuaccagcccccauggggaggaccacgaucugccuggagaagagaucgccacguaucagauuuccggccagaucgaggcuaaaaucccccacacaguuagcucuaagaaucucaaacugaccgccuuugcuggcauuccuuccuacagcucuacaagcauccuggccgccuccgaagacgggcgguucauuuuuagccccggacucuucccgaaccugaaccagagcgugugcgauaauaacgcgcuuccucugaucuggcgcggccucauugaccugaccggguauuacgaggcuguccaucccuguaauguguucugcguucuuuccggaccuggcgccagcugugaggcuuuuucugaagggggaaucuucaacaucaccucccccaugugccuggugagcaagcaaauuagauuucgggccgccgaacagcagaucucuuucauuugucaacgcgucgauauggacaucauuguguauugcaauggccagaaaaagacaauccucacgaagacccuggucauuggccaguguaucuacacaaucaccucccuguuuagccuccugcccgggguggcucacuccauugccaucgagcuuugcguuccuggauuccauggcugggcgacagcugcccugcucauuaccuuuuguuucgggugggugcugaucccggccugcacgcuugcuauucugcucguccugaaauuuuucgccaacauccugcacacaucuaaucaggagaacagauuuaaggcuauccuccggaaaauuaaggaagaguucgagaaaaccaagggaagcauggugugugaaaucugcaaguacgaaugcgagacccugaaagagcuuaaggcccacaaucuguccuguguucaaggcgaaugccccuauuguuuuacacauugcgagccuaccgaaacagcgauucaggcccacuacaaagugugucaggcuacgcaucgcuucagagaggaucucaagaaaaccgucacaccccagaacaucgggccuggcugcuaucggacccugaaucuguucagauacaagucucgcuguuauauucuuacaauguggacccuccugcugaucaucgagagcauucucugggccgcuuccgccgcggaaaucccccuggugccgcuuuggacggacaacgcccacggagugggcagcguuccuaugcauaccgaccuggagcucgauuuuucucugcccuccagcucuaaguacacauauaaacggcaccugaccaauccugucaacgaccaacaguccgugagccuucacauugaaaucgagucucaggggauuggagcugaugugcaucaccucggccauugguacgacgccagacugaaucugaagacaucuuuccacugcuacggggcuuguaccaaauaucaguaccccuggcacacggccaagugccauuuugaaaaagauuaugaguacgagaacuccugggccuguaacccucccgacugcccgggagucggcacagggugcaccgcuuguggccucuaucuggaucaacuuaagccugugggaacagcguucaagaucaucagcguucgcuacucucggaaagugugcguccaguuuggcgaagaguaucuguguaagaccauugacaugaaugauugcuucgugaccagacacgccaaaaucuguauuaucgggacaguuuccaaguuuagccagggagacacgcuccuguuccugggccccauggaagggggaggcauuaucuuuaaacauuggugcaccuccacaugucacuucggggaucccggcgacgugaugggaccuaaggacaaaccguuuauuugccccgaguucccuggccaguuucgcaagaaguguaacuucgcuaccacacccgucugcgaauacgaugggaauaucaucucuggauacaaaaaggugcuugccaccauugacagcuuccaauccuuuaacacgucuaauauccauuucacagaugagcggauugaguggagagacccugauggcaugcuccgcgaccacaucaacauuguuaucagcaaagauaucgacuuugaaaaucuggccgagaaccccuguaagguggggcugcaggcugccaauauugaaggagcguggggcuccggggucggcuucacccugaccugccaggugucucugacagagugcccuaccuuucuuacaagcaucaaggcuugugauauggccauuugcuauggagccgaauccgugacgcugagccggggccaaaacaccgucaaaaucacagggaagggaggccacucuggguccagcuucaaauguugccauggaaaggaguguucuuccaccggccuccaggcuagcacaccccaccuggacaaaguuaauggcauuucugagcuggaaaacgagaagguguacgaugacggggccccggaaugcggaaucaccuguugguuuaaaaaguccggcgagugggugauggggaucauuaauggaaacugggucgugcuuaucguucucugcgugcugcuccucuucagccugauucuucuguccauccucuguccugucagaaagcauaaaaagagcuga

SEQ ID NO: 13524 - RNA, 3402 nt, Artificial Sequence
  derived and/or modified CDS sequence (opt5) from SEOV(Z37)__AF190119.1__GP
auguggagccugcuccugcuugccgcucuggugggccagggguucgcccucaagaacgucuuugacaugagaauccaaugcccccacuccguuaauuucggagagaccucugugagcggcuacacagaacugccuccgcuuucccugcaggaggcggaacagcucgugcccgagucuagcuguaacauggauaaucaucagucccugucuacgauuaacaaacugaccaaggucaucuggcggaaaaaggcuaaucaagaaagcgccaaccaaaauuccuuugaggugguugagagcgaagugucuuucaaagggcucugcaugcugaagcaccgcauggucgaggaauccuauagaaaccggcgcagcgugauuuguuacgaccuugccugcaauucuacauuuuguaagccuaccguuuauaugaucgugcccauucaugcuugcaacaugaugaaauccugucugaucggacucggcccuuacagaauccaggucguguaugagcggacauacugcaccacagggauucugaccgagggaaaguguuucgugcccgauaaagccgucguuagcgcucuuaagcgcggcauguaugccaucgcgucuauugaaacgaucugcuuuuucauucaccagaaaggcaauaccuacaagaucgugacagccauuaccuccgcuauggggagcaaguguaacaauacagacaccaaagugcagggauacuauaucugcaucauuggcgggaacuccgccccugucuacgcuccggccggagaggauuuuagagcgauggaaguguucucuggcaucauuacgagcccccauggggaggaccacgaucugccuggagaagagaucgccacauaucagauuuccggccagaucgaggcuaagaucccccacaccguuagcucuaaaaaucucaagcugacagccuuugcuggcauuccuuccuacagcucuaccagcauccuggccgccuccgaagacgggcgguucaucuuuucucccggacucuucccgaaccugaaccagagcgugugcgauaauaacgcgcuuccucugauuuggcgcggccucauugaccugaccggguauuacgaggcuguccaucccuguaauguguucugcguucuuuccggaccuggcgccagcugugaggcuuuuucugaagggggaaucuucaacaucacaucccccaugugccuggugagcaaacaaaauagauuucgggccgccgaacagcagauuucuuucaucugucaacgcgucgauauggacauuaucguguauugcaacggccagaagaaaacgauucucaccaagacacuggucaucggccaguguauuuacaccaucacaucccuguuuagccuccugcccgggguggcucacuccaucgccauugagcuuugcguuccuggauuccauggcugggcgaccgcugcccugcucaucacguuuuguuucgggugggugcugauuccggccugcacacuugcuauccugcucguccugaaguuuuucgccaauauucugcacaccucuaaccaggagaauagauuuaaagcuauccuccggaagaucaaagaagaguucgaaaagaccaaaggaagcauggugugugagauuugcaaguacgaaugcgagacacugaaggagcuuaaagcccacaaccuguccuguguucaaggcgaaugccccuauuguuuuacccauugcgagccuacagaaacggcgauccaggcccacuacaaggugugucaggcuacccaucgcuucagagaggaucucaaaaagacagucacaccccagaauauugggccuggcugcuaucggacccugaaccuguucagauacaaaucucgcuguuauauccuuaccauguggacgcuccugcugauuaucgagagcauccucugggccgcuuccgccgcggaaauuccccuggugccgcuuuggaccgacaaugcccacggagugggcagcguuccuaugcauacagaccuggagcucgauuuuucucugcccuccagcucuaaguacaccuauaagcggcaccugacaaacccugucaaugaccaacaguccgugagccuucacaucgaaauugagucucaggggaucggagcugaugugcaucaccucggccauugguacgacgccagacugaaccugaaaaccagcuuccacugcuacggggcuuguacgaaguaucaguaccccuggcacacagccaaaugccauuuugaaaaggauuaugaguacgagaacuccugggccuguaauccucccgacugcccgggagucggcaccgggugcacagcuuguggccucuaucuggaucaacuuaaaccugugggaaccgcguucaagauuaucagcguucgcuacucucggaaggugugcguccaguuuggcgaagaguaucuguguaaaaccaucgacaugaacgauugcuucgugacaagacacgccaagauuuguaucauugggacgguuuccaaauuuagccagggagacacccuccuguuccugggccccauggaagggggaggcaucauuuuuaagcauuggugcacauccaccugucacuucggggaucccggcgacgugaugggaccuaaagacaagccguuuaucugccccgaguucgcuggccaguuucgcaaaaaguguaauuucgccacaaccccugucugcgaauacgaugggaacauuaucucuggauacaagaaagugcuugagacgaucgacagcuuccaauccuuuaauacaucuaacauucauuucaccgaugagcggaucgaauggagagaccccgauggcaugcuccgcgaccacauuaauaucguuauuagcaaggauaucgacuuugagaacauggccgaaaauccuuguaaaguggggcugcaggcugccaacaucgagggagcguggggcuccggggucggcuucacccugacaugccaggugucucucaccgaaugccccacaagccugacguccauuaaggcuugugauauggccaucugcuauggagccgagagcgugacccuuucucggggccaaaauacagucaaaauuaccgggaagggaggccacuccgggagcucuuuuaagagaugucauggaaaagagugcuccagcacaggccugcaggcuucugccccucaccucgacaagguuaacggcaucuccgaacuggagaaugaaaaaguguacgaugacggggcgcccgaguguggaauuaccugcugguucaagaaaagcggcgagugggugauggggaucaucaacggaaauugggucgugcugauuguucuuugugugcuccugcuguuuucccucauccugcuuagcauucugugcccgguccgcaagcauaagaaaucuuga

SEQ ID NO: 13525 - RNA, 3402 nt, Artificial Sequence
  derived and/or modified CDS sequence (opt5) from SEOV__M34882.1__GP
auguggagccugcuccugcuugccgcucuggugggccagggguucgcccucaagaacgucuuugacaugagaauccaacugccccacuccguuaauuucggagagaccucugugagcggcuacacagaauuuccuccgcuuucccugcaggaggcggaacagcucgugcccgagucuagcugcaacauggauaaucaucagucccugucuacgauuaacaaacugaccaaggucaucuggcggaaaaaggcuaaucaagaaagcgccaaccaaaauuccuucgaggugguugagagcgaagugucuuuuaaagggcucuguaugcugaagcaccgcauggucgaggaauccuauagaaaccggcgcagcgugauuugcuacgaccuugccuguaauucuacauucugcaagccuaccguuuauaugaucgugcccauucaugcuuguaacaugaugaaauccugccugaucggacucggcccuuacagaauccaggucguguaugagcggacauacuguaccacagggauucugaccgagggaaagugcuuugugcccgauaaagccgucguuagcgcucuuaagcgcggcauguaugccaucgcgucuauugaaacgaucuguuucuuuauucaccagaaaggcaauaccuacaagaucgugacagccauuaccuccgcuauggggagcaagugcaacaauacagacaccaaagugcagggauacuauaucuguaucauuggcgggaacuccgccccugucuacgcuccggccggagaggauuucagagcgauggaaguguuuucuggcaucauuacgagcccccauggggaggaccacgaucugccuggagaagagaucgccacauaucagauuuccggccagaucgaggcuaagaucccccacaccguuagcucuaaaaaucucaagcugacagccuucgcuggcauuccuuccuacagcucuaccagcauccuggccgccuccgaagacgggcgguuuauuuucucucccggacucuucccgaaccugaaccagagcgugugcgauaauaacgcgcuuccucugaucuggcgcggccucauugaccugaccggguauuacgaggcuguccaucccugcaauguguuuuguguucuuuccggaccuggcgccagcugcgaggcuuucucugaagggggaaucuuuaacaucacaucccccaugugucuggugagcaaacaaaauagauuccgggccgccgaacagcagauuucuuuugucugccaacgcguggauauggacaucauugucuauuguaacggccagaagaaaacgauccucaccaagacacuggugauuggccagugcaucuacaccauuacaucccuguucagccuccugcccgggguugcucacuccaucgccaucgagcuuugugugccuggauuucauggcugggcgaccgcugcccugcucauuacguucugcuuuggguggguccugaucccggccuguacacuugcuauucugcucgugcugaaguucuuugccaauauccugcacaccucuaaccaggagaauagauucaaagcuauucuccggaagaucaaagaagaguuugaaaagaccaaaggaagcaugguuugcgagaucuguaaguacgaaugcgagacacugaaggagcuuaaagcccacaaccuguccugcgugcaaggcgaaugucccuauugcuucacccauugugagccuacagaaacggcgauucaggcccacuacaaggucugccaggcuacccaucgcuucagagaggaucucaaaaagacagugacaccccagaauaucgggccuggcuguuaucggacccugaaccuguuuagauacaaaucucgcugcuauauucuuaccauguggacgcuccugcugaucauugagagcauccucugggccgcuuccgccgcggaaaucccccuggugccgcuuuggaccgacaaugcccacggaguuggcagcgucccuaugcauacagaccuggagcucgauuucucucugcccuccagcucuaaguacaccuauaagcggcaccugacaaacccugugaaugaccaacaguccgugagccuucacauugaaaucgagucucaggggauuggagcugccguccaucaccucggccauugguacgaugcuagacugaaccugaaaaccagcuuucacuguuacggggccugcacgaaguaucaguaccccuggcacacagccaaaugucauuucgaaaaggacuaugaguacgagaacuccugggcuugcaauccucccgauuguccgggagugggcaccgggugcacagcgugcggccucuaucuggaccaacuuaaaccuguuggaaccgccuuuaagaucauuagcgugcgcuacucucggaaggucugugugcaguucggcgaggaacaccugugcaaaaccaucgauaugaacgacuguuuuguuacaagacaugcuaagaucugcauuaucgggacgguguccaaauucagccagggagauacccuccuguuucugggccccauggaagggggaggcauuaucuucaagcacugguguacaucuaccugccauuuuggggaccccggcgaugucaugggaccuaaagacaagccguucauuugucccgaguuuccuggccaguuccgcaaaaagugcaauuucgccacaacccccgugugugaauaugacgggaacaucauuucuggauacaagaaaguucuugccacgaucgauagcuuucaauccuucaauacaucuaacauccacuuuaccgacgagcggauugaguggagagauccugacggcaugcuccgcgaucacaucaauauugugaucagcaaggacauugauuucgaaaaccuggcugagaaucccugcaaagucgggcugcaggccgcgaacaucgaaggagcuuggggcuccggggugggcuuuacccucacauguaaggugucucugaccgagugcccuacauuccuuacgagcaucaaagccugcgacauggccauuuguuacggagcugaauccgucacccugagccggggccagaauacaguuaagaucaccgggaagggaggccauucuggguccagcuuuaaaugcugucacggaaaggagugcuccuccacaggccuccaagccagcgcgccccaucuggauaaagugaacggcauuucugagcuggaaaaugagaagguguaugacgauggggcuccggaauguggaauuaccugcugguucaaaaaguccggcgagugggucauggggaucaucaacggaaauugggugguucuuaucgugcucuguguccugcugcucuuuagccugauucuucuguccauccucugcccugugagaaagcacaaaaagagcuga

SEQ ID NO: 13526 - RNA, 3423 nt, Artificial Sequence
  derived and/or modified CDS sequence (opt5) from SNV(NM H10)__NC_005215.1__GP
auggugggcugggucugcaucuuccugguugugcucaccacagccacggcugggcugaccagaaaccuuuacgagcugaagauugaauguccccacacagugggacucggccagggguaugucaccggaagcguggagaucacaccuauucugcuuacccaaguugccgaccugaaaaucgaauccucuugcaauuuugaucuccaugugccggcgacaaccacgcagaaguacaaccaggucgacuggaccaaaaagagcuccacaaccgagucuacaaaugcuggcgccaccacguucgaagccaaaacaaaggagauuaaccugaaggggaccuguaauauucccccuacaaccuuugaggcugccuauaaaagccggaagaccgugaucugcuacgaucuggcuuguaaccagacacacugccuccccacgguucaucugauugccccugugcaaaccuguauguccguccgcucuugcaugaucggacuucugagcuccagaauccaggugaucuaugagaaaacauacugugugaccggccagcucauugagggccugugcuucauccccacacacaccauugcgcuuacgcagccugggcauacauaugacaccaugacccugccggucacauguuuucucguugccaagaaacugggaacccaacugaagcucgcuguggaacuggagaaacuuaucacaggcgugagcugcacggaaaauucuuuccagggguacuacaucugcuuuauuggaaagcacuccgaaccccuguucgucccuaccauggaggauuaucggagcgccgaacucuuuacacgcauggugcugaaccccagaggcgaggaccacgauccugaccagaaugggcagggacuuaugcggaucgcuggccccguuaccgccaaggugccgucuacagaaaccacggagaccaugcaaggcauugcguucgccggggcuccuauguacuccagcuuuucuacacugguccgcaaagccgaucccgaguauguguucuccccuggaaucauugcugaaagcaaccauuccguuugugacaagaaaaccgugccccucacauggaccggcuuucuggccgucucuggggagaucgaaaagaucacgggaugcacaguguucuguacccuggccggccccggggcuagcugcgaggcguacuccgaaacaggaauuuucaauaucagcucuccuaccugucucgucaacaaagugcagaaguuuagaggcuccgagcagcggauuaauuucaugugccaacgcguugaucaggacguggucguguauuguaacggccagaagaaaguuauccugaccaagacacuugugauugggcagugcaucuacacguuuaccagccuguucucucucaucccgggagucgcccacagccuggcuguggagcuuugugugcccggccugcaugggugggccacaaccgcccuccugauuacauuuugcuucggauggcugcucaucccugcuguuacccugauuauccuuaaaauucugagacuccugacguuuuccuguucucacuauagcacagaauccaaguucaaagucauccuggagcgggugaagguggaauaccaaaagaccaugggcagcauggucugcgauauuugccaccaugagugugaaaccgccaaagagcuugagacacacaagaaaucuugccccgaagggcaguguccuuacugcaugaccaucacagaguccacggaaagcgcgcuccaggcucauuuugccaucuguaagcugaccaaucgcuuccaggagaaccugaaaaagucucucaagagacccgaggugcggaaaggcugcuaucgcacacugggaguuuuuagauacaagucccgguguuaugugggccuugucugggggauucugcucaccacagaacugaucauuugggccgcuagcgccgacaccccgcugauggaguccggauggucugacacggcucacggcguggggaucauuccuaugaaaaccgaucuugaacucgacuucgcccuggcgagcuccucuagcuacuccuauagacgcaagcugguuaaccccgccaaucaagaggaaacacucccuuuucauuuccagcuggauaaacaggugguccacgcugagauccagaaccuuggacacuggauggacggcaccuucaauaucaagacagccuuucauugcuacggggaguguaagaaauaugcuuaccccuggcaaaccgccaagugcuucuuugaaaaagauuaccaguaugagacaagcuggggcuguaacccucccgacugcccgggagugggcaccgggugcacggcguguggaguuuaccuggauaagcuccggucugugggcaaagccuauaagauugucucccugaaauacacaagaaaggugugcauccagcuggggaccgaacagaccuguaagcacauugacgugaaugauugccuugucacaccuagcguuaaaguguguaugaucggaaccauuucuaagcuccaacccggcgacacgcugcuguuccucgggccccuggagcagggcggaaucauccuuaaacaguggugcacaaccuccuguguguuuggcgauccuggggacauuaugagcacaaccucuggaaugcgcugcccggaacauacaggcagcuuccggaagaucuguggguuugcuaccacgccuaccugcgaguaucaaggaaacacagucuccggcuuccagagaaugauggccacccgcgacagcuuucagucuuucaaugugacagagccccacauuaccuccaaccggcuggaauggaucgaucccgacagcuccauuaaagaucacaucaauaugguucucaacagagacgugucuuuucaggaucugagcgacaauccuuguaaggucgaucugcauacgcaauccaucgacggggcuuggggcucuggagugggcuucacacuuguuugcaccguggggcucacagagugcgccaacuuuauuaccagcaucaaggccugugauuccgcuaugugcuacggagcgaccgucacaaaucugcugcgcggcucuaacacggugaaaguuguggggaagggaggccacagcggcucccucuucaaauguugccaugacaccgauuguacagaagaggggcuggccgcuucucccccucaccuugaccgggucaccggauauaaucagauugauagcgacaagguguacgacgauggcgcucccccgugcacaaucaaauguugguucaccaaguccggggaauggcugcucggcauucugaacggaaacuggguggucguugccgugcugaucgugauucuuauccugagcauccuccuguuuucuuucuuuugcccugucagaucccgcaagaauaaagccaacuga

SEQ ID NO: 13527 - RNA, 3423 nt, Artificial Sequence
  derived and/or modified CDS sequence (opt5) from SNV(1)__JQ690283.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuauccugcuuacacaaguugccgaccugaaaauugaauccucuugcaauuuugaucuccaugugccggcgaccacgacccagaaguacaaccaggucgacuggaccaaaaagagcuccacaacagagucuaccaaugcuggcgccgccacguucgaagcuaaaacaaaggaggugaaccugaaggggaccuguaauauucccccuacaaccuuugaggccgcuuauaaaagccggaagaccguuauuugcuacgaucuggccuguaaccagacacacugccuccccacggugcaucugaucgcgccuguccaaaccuguauguccgugcgcucuugcaugaucggacuucugagcuccagaauccaggugaucuaugagaaaacauacugugucaccggccagcucauugagggccugugcuucauccccacacacaccauugcccuuacgcagccugggcauacauaugacaccaugacccugccgguuacauguuuucucguggcuaagaaacugggaacccaacugaagcucgccguggaacuggagaaacuuaucacaggcgucagcugcacggaaaauucuuuccagggguacuacauuugcuuuaucggaaagcacuccgaaccccuguucgugccuaccauggaggauuaucggagcgcugaacucuuuacacgcaugguucugaaccccagaggcgaggaccacgauccugaccagaaugggcagggacuuaugcggaucgccggccccgugaccgcgaaggucccgucuacagaaaccacggagaccaugcaaggcauugccuucgcuggggccccuauguacuccagcuuuucuacacuggugcgcaaagcugaucccgaguauguuuucuccccuggaaucauugccgaaagcaaccauuccgugugugacaagaaaaccgucccccucacauggaccggcuuucuggccgugucuggggagaucgaaagaauuacgggaugcacagucuucuguacccuggcuggccccggggcgagcugcgaggccuacuccgaaacaggaaucuucaauaucagcucuccuaccugucucgugaacaagguucagaaauuucggggcuccgagcagcgcauuaauuucaugugccaaagaguggaucaggacgucgugguuuauuguaacggccagaagaaggugauccugaccaaaacacuugucauugggcagugcaucuacacguuuaccagccuguucucucucauuccgggaguggcucacagccuggccguggagcuuuguguucccggccugcaugggugggccacaaccgcucuccugaucacauuuugcuucggauggcugcucaucccuaccgucacgcugauuauccuuaaggugcugcggcuccugacauuuuccuguucucacuauagcaccgaauccaaauucaaggugauucuggagcgcgucaaaguggaauaccaaaagaccaugggcagcaugguuugcgauaucugccaccaugagugugaaacagccaaggagcuugagacccacaaaaagucuugccccgaagggcaguguccuuacugcaugacaauuacggaguccaccgaaagcgcgcuccaggcucauuuuucuaucuguaaacugacaaauagauuccaggagaaccugaagaaaucccucaagcggcccgaggugcgcaagggcugcuauagaacccugggagucuuucgguacaaaagcagauguuaugugggccuuguuugggggauucugcucacaaccgaacugaucaucugggccgccuccgcugacacgccgcugauggagucuggauggagcgacaccgcccacggcguggggauuaucccuaugaagacagaucuugaacucgacuucgcucuggccuccucuagcuccuacagcuaucgccggaaacuggucaaccccgcgaaucaagaggaaacccucccuuuucauuuccagcuggauaaacaggugguucacgccgagauucagaaccuuggacacuggauggacggcacauucaauaucaagaccgcuuuucauugcuacggggaguguaagaaguaugccuaccccuggcaaacagcuaaaugcuucuuugaaaaggauuaccaguaugagaccucuuggggcuguaacccucccgacugcccgggagugggcacggggugcacagccuguggagucuaccuggauaaacucagauccgugggcaaggcguauaaaauugugagccugaaguacacccgcaaagucugcauccagcuggggaccgaacagacauguaagcacaucgacguuaaugauugccuugugaccccuucugugaaggucuguaugauuggaacgaucuccaaacuccaacccggcgacacacugcuguuccucgggccccuggagcagggcggaauuauccuuaagcaguggugcaccacaagcuguguguuuggcgauccuggggacauuaugucuaccacaagcggaaugcggugcccggaacauaccggcuccuucagaaaaaucuguggguuugccacgacccccacaugcgaguaucaaggaaacaccguuagcggcuuccagcgcaugauggcuacacgggacucuuuucaguccuucaaugugaccgagccucacaucacgagcaacagacuggaauggauugaucccgacuccucuaucaaggaucacauuaauaugguccucaaccgcgacgugagcuuucaggaucuguccgacaauccuuguaaaguugaucugcauacacaaucuaucgacggggccuggggcagcggagugggcuucacccuugucugcacaguggggcucaccgagugcgcuaacuuuauuaccuccaucaaggccugugauucugccaugugcuacggagcuacaguuacgaaucugcugcggggcagcaacaccgugaaggucguggggaaaggaggccacuccggcagccucuucaaguguugccaugacacagauuguaccgaagaggggcuggcggccucucccccucaccuugacagagugacaggauauaaucagaucgauuccgacaaagucuacgacgauggcgcucccccgugcaccauuaaguguugguucacgaaaagcggggaauggcugcucggaauccugaacggcaacuggguugugguggccguccugauugugauccuuauucugucuauccuccuguuuuccuucuuuugcccuguucgcaaucggaagaacaaggccaauuga

SEQ ID NO: 13528 - RNA, 3423 nt, Artificial Sequence
  derived and/or modified CDS sequence (opt5) from SNV(1)__JQ690279.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuauccugcuuacacaaguugccgaccugaaaauugaauccucuugcaauuuugaucuccaugugccggcgaccacgacccagaaguacaaccaggucgacuggaccaaaaagagcuccaccacagagucuaccaaugcuggcgccaacacguucgaagccaaaacaaaggagaucaaucugaaggggaccuguaacauucccccuacaaccuuugaggcugccuauaaaagccggaagaccgugaucugcuacgaucuggcuuguaaucagacacacugccuccccacgguucaucugaucgccccugugcaaaccuguauguccguccgcucuugcaugauuggacuucugagcuccagaauccaggugauuuaugaaaagacauacugugugaccggccagcucaucgagggccugugcuucauucccacacacaccaucgcgcuuacgcagccugggcauacauaugacaccaugacccugccggucacauguuuucucguugccaagaaacugggaacccaacugaagcucgcuguggaacuggagaaacuuauuacaggcgugagcugcacggagaacucuuuccagggguacuacaucugcuuuaucggaaaacacuccgaaccccuguucgucccuaccauggaggauuaucggagcgccgaacucuuuacacgcauggugcugaaucccagaggcgaggaccacgauccugaccagaacgggcagggacuuaugcggauugcuggccccguuaccgccaaggugccgucuacagaaaccacggagaccaugcaaggcaucgcguucgccggggcuccuauguacuccagcuuuucuacacugguccgcaaagccgaucccgaguauguguucuccccuggaauuaucgcugaaagcaaucauuccguuugugacaagaaaaccgugccccucacauggaccggcuuucuggccgucucuggggagauugaaagaaucacgggaugcacaguguucuguacccuggccggccccggggcuagcugcgaggcguacuccgaaacaggaaucuucaacauuagcucuccuaccugucucgucaauaaggugcagaaauuucggggcuccgagcagcgcaucaacuucaugugccaaagaguugaucaggacguggucguguauuguaauggccagaagaagguuauucugaccaaaacacuugugaucgggcagugcauuuacacguuuaccagccuguucucucucaucccgggagucgcccacagccuggcuguggagcuuugugugcccggccugcaugggugggccacaaccgcccuccugaucacauuuugcuucggauggcugcucauuccuaccguuacgcugcuuauccugaagauucuccggcugcugacauuuuccuguucucacuauagcaccgaauccaaauucaaggucauccuugagcgcgugaaaguggaauaccaaaagaccaugggcagcauggucugcgauauuugccaccaugagugugaaacagcuaaggagcucgagacccacaaaaagucuugccccgaagggcaguguccuuacugcaugacaaucacggaguccaccgaaagcgcccugcaggcgcauuuuucuauuuguaaacugacaaacagauuccaggagaaccucaagaaaucccugaagcggcccgaggugaagaaaggcugcuaucgcacccuuggaguuuuuagauacaagagccgguguuaugugggccuggucugggggauccuccugacaaccgaacugaucauuugggcugccuccgccgacacgccgcuuauggagucuggauggagcgacaccgcucacggcguggggaucauuccuaugaaauccgaucucgaacuggacuucgcccuggcuucuagcuccagcuacucuuauagacgcaagcucguuaaucccgccaaccaagaggaaacacugccuuuucauuuccagcuugauaaacaggugguccacgcggagauccagaaucugggacacuggauggacggcaccuucaacauuaagacagccuuucauugcuacggggaguguaagaaauaugcuuaccccuggcaaaccgccaagugcuucuuugaaaaagauuaccaguaugagacauccuggggcuguaauccucccgacugcccgggagugggcaccgggugcacggcuuguggaguuuaccucgauaagcugcggagcgugggcaaagccuauaagaucgucucucugaaauacacaagaaaggugugcauccagcuugggaccgaacagaccuguaagcacauugacgugaacgauugccucgucacaccuuccguuaaaguguguaugaucggaaccauuagcaagcugcaacccggcgacacgcuccuguuccuggggccccuugagcagggcggaaucauucugaaacaguggugcacaaccucuuguguguuuggcgauccuggggacaucaugagcacaaccuccggaaugcgcugcccggaacauacaggcagcuuccggaagaucuguggguuugcgaccacgcccacaugcgaguaucaaggaaauacagucucuggcuuccagagaaugauggccacccgcgacuccuuucagagcuucaacgugacagagccucacauuaccuccaaucggcucgaauggaucgaucccgacucuagcauuaaagaucacaucaacaugauucugaauagagacguuuccuuucaggaucugucugacaacccuuguaagguggaucuucauacgcaaagcaucgacggggcuuggggcuccggagucggcuucacacucgugugcaccguugggcugacagagugcgccaauuuuaucaccucuauuaaggcuugugauagcgccaugugcuacggagccaccgugacaaaccugcuccgcggcuccaauacggucaaagugguugggaagggaggccacagcggcucucuguucaaauguugccaugacaccgauuguacagaagaggggcuugcugcguccccuccccaccuggaccgggugaccggauauaaccagaucgauagcgacaaggucuacgacgauggcgcucccccgugcacaauuaaauguugguucaccaagucuggggaauggcuccugggaauccugaacggcaauugggugguggucgccguucuuauugugauccugauucucuccauccugcucuuuagcuucuuuugcccugugagaucucgcaagaacaaagccaauuga

SEQ ID NO: 13529 - RNA, 3423 nt, Artificial Sequence
  derived and/or modified CDS sequence (opt5) from SNV(2)__JQ690284.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuauccugcuuacacaaguugccgaccugaaaauugaauccucuugcaauuuugaucuccaugugccggcgaccacgacccagaaguacaaccaggucgacuggacaaagaagggcagcaccacagaguccaccaaugcuggggccaacacguucgaagccaaaacaaaggaggugaaucugaagggaaccuguaacauucccccuacaaccuuugaggcugccuauaaaucucggaagaccguuaucugcuacgaucuggcuuguaaucagacacacugccuccccacggugcaucugaucgccccuguccaaaccuguaugagcgugcgcuccugcaugaucggccuucugucuagccggauucaggugaucuaugaaaagacauacugugucaccggccagcucauugaggggcugugcuucauccccacacacaccauugcgcuuacgcagccuggacauacauaugacaccaugacccugccgguuacauguuuucucguggccaagaaacugggcacccaacugaagcucgcuguggaacuggagaaacuuaucacaggggucuccugcacggagaacagcuuccagggauacuacauuugcuuuaucggcaaacacucugaaccccuguucgugccuaccauggaggauuauagauccgccgaaguuuuuacacgcauggugcucaaucccagaggggaggaccacgauccugaccagaacggacagggccugaugcggaucgcuggccccgucaccgccaaggugccgagcacagaaaccacggagaccaugcaagggauugcguucgccggagcuccuauguacucuuccuuuagcacacuuguucgcaaagccgaucccgaguauguguucucuccuggcaucauugcugaauccaaucauagcgucugugacaagaaaaccgugccccugacauggaccggguuucucgccgucuccggagagaucgaaagaauuacgggcugcacaguguucuguacccuggccgggcccggagcuucuugcgaggcguacagcgaaacaggcaucuucaacaucuccagcccuaccugucugguuaauaaggugcagaaauuucggggcucugagcagcgcauuaacuucaugugccaaagagucgaucaggacgugguuguguauuguaaugggcagaagaaggucauccucaccaaaacacuggugauuggacagugcaucuacacguuuaccucccuuuucagccugauuccgggcguggcccacucucucgcuguugagcuguguguccccgggcuucauggaugggccacaaccgcccugcucaucacauuuugcuucggcuggcugcugaucccuaccgugacgcucauuauccugaagauucuucggcugcucacauuuagcuguucccacuauucuaccgaaagcaaauucaaggugauccuggagcgcgucaaaguggaauaccaaaagaccaugggguccaugguuugcgauauuugccaccaugagugugaaacagcuaaggagcuggagacccacaaaaagagcugccccgaaggccaguguccuuacugcaugacaaucacggagucuaccgaauccgcccuucaggcgcauuuuagcauuuguaaacucacaaacagauuccaggagaaccugaagaaaucucugaagcggcccgaggugaagaaaggaugcuaucgcacccucggcgucuuuagauacaagucccgguguuauguggggcugguuuggggaauccuucugacaaccgaacucaucauuugggcugccagcgccgacacgccgcugauggaguccggcuggucugacaccgcucacggggugggaaucauuccuaugaaaacagaucuggaacuugacuucgcccucgcuagcuccucuagcuacuccuauagacgcaagcuggucaaucccgccaaccaagaggaaacccugccuuuucauuuccagcucgauaaacaggugguucacgcggagauccagaaucugggccacuggauggacgggacauucaacauuaagaccgccuuucauugcuacggcgaguguaagaaauaugcuuaccccuggcaaacagccaagugcuucuuugaaaaagauuaccaguaugagaccagcuggggauguaauccucccgacugcccgggcguggggacgggaugcacagcuuguggcgucuaccuugauaagcugcggucuguggggaaagccuauaagaucgugucccucaaauacaccagaaaggucugcauccagcugggaaccgaacagacauguaagcacauugacguuaacgauugccuggugaccccuagcgugaaagucuguaugaucggcacgauuucuaaacuucaacccggggacacacuccuguuccugggcccccucgagcagggaggcaucauucugaaacaguggugcaccacauccuguguguuuggggauccuggagacaucaugagcaccacaucuggcaugcgcugcccggaacauaccgggagcuuccggaagaucuguggauuugcgacgacccccacaugcgaguaucaaggcaauaccguuuccggguuccagagaaugauggccacacgcgacagcuuucagucuuucaacgugaccgagccucacauuacguccaaucggcuugaauggaucgaucccgacagcuccauuaaagaucacaucaacaugguccugaauagagacgugucuuuucaggaucucagcgacaacccuuguaagguugaucugcauacacaauccauugacggcgcuuggggaucuggcgugggguucacccuggucugcacagugggacuuaccgagugcgccaauuuuaucaccagcaucaaggcuugugauuccgccaugugcuacggcgccacaguuacgaaccuccugcgcgggucuaauaccgugaaagucgugggaaagggcggccacagcgggucccuguucaaauguugccaugacacagauuguaccgaagagggacucgcugcgucucccccucaccuggaccgggugacaggcuauaaccagauugauagcgacaaggucuacgacgauggggcucccccgugcaccaucaaauguugguucacgaaguccggagaauggcuucugggcauucucaacgggaauuggguugugguggccguccugaucgugauucugauccuuagcauucugcucuuuucuuucuuuugcccuguuagaucccgcaagaacaaagccaauuga

SEQ ID NO: 13530 - RNA, 3423 nt, Artificial Sequence
  derived and/or modified CDS sequence (opt5) from SNV(2)__JQ690280.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuauccugcuuacacaaguugccgaccugaaaauugaauccucuugcaauuuugaucuccaugugccggcgaccacgacccagaaguacaaccaggucgacuggacgaaaaagagcuccaccacagagucuaccaaugcuggcgccaacacguucgaagccaaaacaaaggaggugaaucugaaggggaccuguaacauucccccuacaaccuuugaggcugccuauaaaagccggaagaccguuauuugcuacgaucuggcuuguaaucagacacacugccuccccacggugcaucugaucgccccuguccaaaccuguauguccgugcgcucuugcaugaucggacuucugagcuccagaauccaggugaucuaugaaaagacauacugugucaccggccagcucauugagggccugugcuucauccccacacacaccauugcgcuuacgcagccugggcauacauaugacaccaugacccugccgguuacauguuuucucguggccaagaaacugggaacccaacugaagcucgcuguggaacuggagaaacuuaucacaggcgucagcugcacggagaacucuuuccagggguacuacauuugcuuuaucggaaaacacuccgaaccccuguucgugccuaccauggaggauuaucggagcgccgaacucuuuacacgcaugguucugaaucccagaggcgaggaccacgauccugaccagaacgggcagggacuuaugcggaucgcuggccccgugaccgccaaggucccgucuacagaaaccacggagaccaugcaaggcauugcguucgccggggcuccuauguacuccagcuuuucuacacuggugcgcaaagccgaucccgaguauguuuucuccccuggaaucauugcugaaagcaaucauuccgugugugacaagaaaaccgucccccucacauggaccggcuuucuggccgugucuggggagaucgaaagaauuacgggaugcacagucuucuguacccuggccggccccggggcuagcugcgaggcguacuccgaaacaggaaucuucaacaucagcucuccuaccugucucgugaauaagguucagaaauuucggggcuccgagcagcgcauuaacuucaugugccaaagaguggaucaggacgucgugguuuauuguaauggccagaagaaggugauccugaccaaaacacuugucauugggcagugcaucuacacguuuaccagccuguucucucucauuccgggaguggcccacagccuggcuguggagcuuuguguucccggccugcaugggugggccacaaccgcccuccugaucacauuuugcuucggauggcugcucaucccuaccgucacgcugauuauccuuaagauucugcggcuccugacauuuuccuguucucacuauagcaccgaauccaaauucaaggugauccuggagcgcgugaaagucgaauaccaaaagaccaugggcagcauggugugcgauauuugccaccaugagugugaaacagcuaaggagcuugagacccacaaaaagucuugccccgaagggcaguguccuuacugcaugacaaucacggaguccaccgaaagcgcccuccaggcgcauuuuucuauuuguaaacugacaaacagauuccaggagaaccugaagaaaucccucaagcggcccgagguuaagaaaggcugcuaucgcacccugggaguguuuagauacaagagccgguguuaugucggccuugugugggggauccugcucacaaccgaacugaucauuugggcugccuccgccgacacgccgcugauggagucuggauggagcgacaccgcucacggcguugggaucauuccuaugaaaacagaucuugaacucgacuucgcccuggcuuccucuagcuccuacagcuauagacgcaagcuggugaaucccgccaaccaagaggaaacccucccuuuucauuuccagcuggauaaacaggucgugcacgcggagauccagaaucuuggacacuggauggacggcacauucaacauuaagaccgccuuucauugcuacggggaguguaagaaauaugcuuaccccuggcaaacagccaagugcuucuuugaaaaagauuaccaguaugagaccucuuggggcuguaauccucccgacugcccgggaguuggcacggggugcacagcuuguggaguguaccuggauaagcuccgguccgucggcaaagccuauaagaucgugagccugaaauacaccagaaaggugugcauccagcuggggaccgaacagacauguaagcacauugacgucaacgauugccuuguuaccccuucugugaaaguguguaugaucggaacgauuuccaagcuccaacccggcgacacacugcuguuccucgggccccuggagcagggcggaaucauucuuaaacaguggugcaccacaagcugugucuuuggcgauccuggggacaucaugucuaccacaagcggaaugcgcugcccggaacauaccggcuccuuccggaagaucuguggguuugcgacgacccccacaugcgaguaucaaggaaauaccgugagcggcuuccagagaaugauggccacacgcgacucuuuucaguccuucaacguuaccgagccucacauuacgagcaaucggcuggaauggaucgaucccgacuccucuauuaaagaucacaucaacauggugcucaauagagacgucagcuuucaggaucuguccgacaacccuuguaagguggaucugcauacacaaucuauugacggggcuuggggcagcggaguuggcuucacccuugugugcacagucgggcucaccgagugcgccaauuuuaucaccuccaucaaggcuugugauucugccaugugcuacggagccacagugacgaaccugcugcgcggcagcaauaccguuaaaguggucgggaagggaggccacuccggcagccucuucaaauguugccaugacacagauuguaccgaagaggggcuggcugcgucucccccucaccuugaccgggugacaggauauaaccagauugauuccgacaagguguacgacgauggcgcucccccgugcaccaucaaauguugguucacaaagagcggggaauggcugcucggcauucugaacggaaauugggucguuguggccgugcugaucgucauucuuauccugucuauucuccuguuuuccuucuuuugcccugugagaagccgcaagaacaaagccaauuga

SEQ ID NO: 13531 - RNA, 3423 nt, Artificial Sequence
  derived and/or modified CDS sequence (opt5) from SNV(CC107/POR)__KT885045.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuauccugcuuacacaaguugccgaccugaaaauugaauccucuugcaauuuugaucuccaugugccggcgaccacgacccagaaguacaaccaggucgacuggaccaaaaagagcuccaccacagagucuaccaaugcuggcgccacgacauucgaagccaaaaccaaggaggugaaccugaaggggacauguaauauucccccuaccaccuuugaggcugccuauaaaagccggaagacaguuauuugcuacgaucuggcuuguaaccagacgcacugccuccccaccgugcaucugaucgccccuguccaaacauguauguccgugcgcucuugcaugaucggacuucugagcuccagaauccaggugaucuaugagaaaaccuacugugucacaggccagcucauugagggccugugcuucauccccacccacacgauugcgcuuacacagccugggcauaccuaugacaccaugacacugccgguuaccuguuuucucguggccaagaaacugggaacacaacugaagcucgcuguggaacuggagaaacuuaucacgggcgucagcugcaccgaaaauucuuuccagggguacuacauuugcuuuaucggaaagcacuccgaaccccuguucgugccuacaauggaggauuaucggagcgccgaacucuuuacccgcaugguucugaaccccagaggcgaggaccacgauccugaccagaaugggcagggacuuaugcggaucgcuggccccgugacagccaaggucccgucuaccgaaacgaccgagacaaugcaaggcauugcguucgccggggcuccuauguacuccagcuuuucuacccuggugcgcaaagccgaucccgaguauguuuucuccccuggaaucauugcugaaagcaaccauuccgugugugacaagaaaacagucccccucaccuggacgggcuuucuggccgugucuggggagaucgaaagaauuacaggaugcaccgucuucuguacacuggccggccccggggcuagcugcgaggcguacuccgaaaccggaaucuucaauaucagcucuccuaccugucucgugaacaagguucagaaauuucggggcuccgagcagcgcauuaauuucaugugccaaagaguggaucaggacgucgugguuuauuguaacggccagaagaaggugauccugacaaaaacgcuugucauugggcagugcaucuacaccuuuacaagccuguucucucucauuccgggaguggcccacagccuggcuguggagcuuuguguucccggccugcaugggugggccaccacagcccuccugaucaccuuuugcuucggauggcugcucaucccuacggucacacugauuauccuuaagauucugcggcuccugaccuuuuccuguucucacuauagcaccgaauccaaauucaaggugauccuggagcgcgugaaagucgaauaccaaaagacaaugggcagcauggugugcgauauuugccaccaugagugugaaaccgcuaaggagcuugagacacacaaaaagucuugccccgaagggcaguguccuuacugcaugacgaucaccgaguccacagaaagcgcccuccaggcgcauuuuucuauuuguaaacugaccaauagauuccaggagaaccugaagaaaucccucaagcggcccgagguucgcaagggcugcuauagaacacugggaguguuucgguacaaaagcagauguuaugucggccuugugugggggauccugcucaccacggaacugaucauuugggcugccuccgccgacaccccgcugauggagucuggauggagcgacacagcucacggcguugggaucgugccuaugaagaccgaucuugaacucgacuucgcccuggcuuccucuagcuccuacagcuaucgccggaaacuggucaaccccgccaaucaagaggaaacacucccuuuucauuuccagcuggauaaacaggugguucacgcggagauucagaaccuuggacacuggauggacggcaccuucaauaucaagacagccuuucauugcuacggggaguguaagaaguaugcuuaccccuggcaaaccgccaaaugcuucuuugaaaaggauuaccaguaugagacgucuuggggcuguaacccucccgacugcccgggagugggcacagggugcaccgcuuguggagucuaccuggauaaacucagauccgugggcaaggccuauaaaauugugagccugaaguacacccgcaaagucugcauccagcuggggacagaacagaccuguaagcacaucgacguuaaugauugccuugugacgccuucugugaaggucuguaugauuggaacaaucuccaaacuccaacccggcgacacccugcuguuccucgggccccuggagcagggcggaauuauccuuaagcaguggugcacaaccagcuguguguuuggcgauccuggggacauuaugucuacaaccagcggaaugcggugcccggaacauacgggcuccuucagaaaaaucuguggguuugcgaccacacccacaugcgaguaucaaggaaacacaguuagcggcuuccagcgcaugauggccacccgggacucuuuucaguccuucaaugugacggagccucacaucacaagcaacagacuggaauggauugaucccgacuccucuaucaaggaucacauuaauaugguccucaaccgcgacgugagcuuucaggaucuguccgacaauccuuguaaaguugaucugcauacccaaucuaucgacggggcuuggggcagcggagugggcuucacacuugucugcaccguggggcucaccgagugcgccaacuuuauuacauccaucaaggcuugugauucugccaugugcuacggagccacgguuaccaaucugcugcggggcagcaacacagugaaggucguggggaaaggaggccacuccggcagccucuucaaguguugccaugacaccgauuguacagaagaggggcuggcugcgucucccccucaccuugacagagugaccggauauaaucagaucgauuccgacaaagucuacgacgauggcgcucccccgugcacgauuaaguguugguucacaaaaagcggggaauggcugcucggaauccugaacggcaacuggguugugguggccguccugauugugauccuuauucugucuauccuccuguuuuccuucuuuugcccuguucgcaaucggaagaacaaggccaauuga

SEQ ID NO: 13532 - RNA, 3423 nt, Artificial Sequence
  derived and/or modified CDS sequence (opt5) from HPS(Convict Creek 107)__L33474.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuauccugcuuacacaaguugccgaccugaaaauugaauccucuugcaauuuugaucuccaugugccggcgaccacgacccagaaguacaaccaggucgacuggaccaaaaagagcuccacaacagagucuaccaaugcuggcgccacgacauucgaagccaaaaccaaggaggugaaccugaaggggacauguaauauucccccuaccaccuuugaggcugccuauaaaagccggaagacaguuauuugcuacgaucuggcuuguaaccagacgcacugccuccccaccgugcaucugaucgccccuguccaaacauguauguccgugcgcucuugcaugaucggacuucugagcuccagaauccaggugaucuaugagaaaaccuacugugucacaggccagcucauugagggccugugcuucauccccacccacacgauugcgcuuacacagccugggcauaccuaugacaccaugacacugccgguuaccuguuuucucguggccaagaaacugggaacacaacugaagcucgcuguggaacuggagaaacuuaucacgggcgucagcugcaccgaaaauucuuuccagggguacuacauuugcuuuaucggaaaacacuccgaaccccuguucgugccuacaauggaggauuaucggagcgccgaacucuuuacccgcaugguucugaaccccagaggcgaggaccacgauccugaccagaaugggcagggacuuaugcggaucgcuggccccgugacagccaaggucccgucuaccgaaacgaccgagacaaugcaaggcauugcguucgccggggcuccuauguacuccagcuuuucuacccuggugcgcaaagccgaucccgaguauguuuucuccccuggaaucauugcugaaagcaaccauuccgugugugacaagaaaacagucccccucaccuggacgggcuuucuggccgugucuggggagaucgaaagaauuacaggaugcaccgucuucuguacacuggccggccccggggcuagcugcgaggcguacuccgaaaccggaaucuucaauaucagcucuccuaccugucucgugaacaagguucagaaauuucggggcuccgagcagcgcauuaauuucaugugccaaagaguggaucaggacgucgugguuuauuguaacggccagaagaaggugauccugacaaaaacgcuugucauugggcagugcaucuacaccuuuacaagccuguucucucucauuccgggaguggcccacagccuggcuguggagcuuuguguucccggccugcaugggugggccaccacagcccuccugaucaccuuuugcuucggauggcugcucaucccuacggucacacugauuauccuuaagauucugcggcuccugaccuuuuccuguucucacuauagcaccgaauccaaauucaaggugauccuggagcgcgugaaagucgaauaccaaaagacaaugggcagcauggugugcgauauuugccaccaugagugugaaaccgcuaaggagcuugagacacacaaaaagucuugccccgaagggcaguguccuuacugcaugacgaucaccgaguccacagaaagcgcccuccaggcgcauuuuucuauuuguaaacugaccaauagauuccaggagauccugaagaaaucccucaagcggcccgagguucgcaagggcugcuauagaacacugggaguguuucgguacaaaagcagauguuaugucggccuugugugggggauccugcucaccacggaacugauuaucugggcugccuccgccgacaccccgcugauggagucuggauggagcgacacagcucacggcguugggauugugccuaugaagaccgaucuugaacucgacuucgcccuggcuuccucuagcuccuacagcuaucgccggaaacuggucaaccccgccaaccaagaggaaacacucccuuuucauuuccagcuggauaaacaggugguucacgcggagauccagaaucuuggacacuggauggacggcaccuucaacauuaagacagccuuucauugcuacggggaguguaagaaguaugcuuaccccuggcaaaccgccaaaugcuucuuugaaaaggauuaccaguaugagacgucuuggggcuguaauccucccgacugcccgggagugggcacagggugcaccgcuuguggagucuaccuggauaaacucagauccgugggcaaggccuauaaaaucgugagccugaaguacacccgcaaagucugcauccagcuggggacagaacagaccuguaagcacauugacguuaacgauugccuugugacgccuucugugaaggucuguaugaucggaacaauuuccaaacuccaacccggcgacacccugcuguuccucgggccccuggagcagggcggaaucauucuuaagcaguggugcacaaccagcuguguguuuggcgauccuggggacaucaugucuacaaccagcggaaugcggugcccggaacauacgggcuccuucagaaaaaucuguggguuugcgaccacaccuaccugcgaguaucaaggaaauacaguuagcggcuuccagcgcaugauggccacccgggacucuuuucaguccuucaacgugacggagccccacauuacaagcaauagacuggaauggaucgaucccgacuccucuauuaaggaucacaucaacaugguccucaaucgcgacgugagcuuucaggaucuguccgacaacccuuguaaaguugaucugcauacccaaucuauugacggggcuuggggcagcggagugggcuucacacuugucugcaccguggggcucaccgagugcgccaauuuuaucacauccaucaaggcuugugauucugccaugugcuacggagccacgguuaccaaccugcugcggggcagcaauacagugaaggucguggggaaaggaggccacuccggcagccucuucaaguguugccaugacaccgauuguacagaagaggggcuggcugcgucucccccucaccuugacagagugaccggauauaaccagauugauuccgacaaagucuacgacgauggcgcucccccgugcacgaucaaguguugguucacacgcagcggggaauggcugcucggcauucugaauggaaacuggguugugguggccguccugaucgugauucuuauccugucuauucuccuguuuuccuucuuuugcccuguucggaacagaaagaauaaggccaacuga

SEQ ID NO: 13533 - RNA, 3423 nt, Artificial Sequence
  derived and/or modified CDS sequence (opt5) from HPS(Convict Creek 74)__L33684.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuauccugcuuacacaaguugccgaccugaaaauugaauccucuugcaauuuugaucuccaugugccggcgaccacgacccagaaguacaaccaggucgacuggaccaaaaagagcuccacaacagagucuaccaaugcuggcgccacgacauucgaagccaaaaccaaggaggugaaccugaaggggacauguaauauucccccuaccaccuuugaggcugccuucaaaagccggaagacaguuauuugcuaugaucuggcuuguaaccagacgcacugccuccccaccgugcaucugaucgccccuguccaaacauguauguccgugcgcucuugcaugaucggacuucugagcuccagaauccaggugaucuacgagaaaaccuauugugucacaggccagcucauugagggccugugcuuuauccccacccacacgauugcgcuuacacagccugggcauaccuacgacaccaugacacugccgguuaccuguuuccucguggccaagaaacugggaacacaacugaagcucgcuguggaacuggagaaacuuaucacgggcgucagcugcaccgaaaauucuuuucagggguauuacauuugcuucaucggaaagcacuccgaaccccuguuugugccuacaauggaggauuaccggagcgccgaacucuucacccgcaugguucugaaccccagaggcgaggaccacgauccugaccagaaugggcagggacuuaugcggaucgcuggccccgugacagccaaggucccgucuaccgaaacgaccgagacaaugcaaggcauugcguuugccggggcuccuauguauuccagcuucucuacccuggugcgcaaagccgaucccgaguacguguuuuccccuggaaucauugcugaaagcaaccauuccguuugugacaagaaaacagucccccucaccuggacgggcuuccuggccgugucuggggagaucgaaagaauuacaggaugcaccgucuucuguacacuggccggccccggggcuagcugcgaggcguauuccgaaaccggaaucuuuaauaucagcucuccuaccugucucgugaacaagguucagaaauuccggggcuccgagcagcgcauuaauuuuaugugccaaagaguggaucaggacgucgugguuuacuguaacggccagaagaaggugauccugacaaaaacgcuugucauugggcagugcaucuauaccuucacaagccuguuuucucucauuccgggaguggcccacagccuggcuguggagcuuuguguucccggccugcaugggugggccaccacagcccuccugaucaccuucugcuuuggauggcugcucaucccuacggucacacugauuauccuuaagauucugcggcuccugaccuucuccuguucucacuacagcaccgaauccaaauuuaaggugauccuggagcgcgugaaagucgaauaucaaaagacaaugggcagcauggugugcgauauuugccaccaugagugugaaaccgcuaaggagcuugagacacacaaaaagucuugccccgaagggcaguguccuuacugcaugacgaucaccgaguccacagaaagcgcccuccaggcgcauuucucuauuuguaaacugaccaauagauuucaggagauccugaagaaaucccucaagcggcccgagguucgcaagggcugcuacagaacacugggaguguuccgguauaaaagcagauguuacgucggccuugugugggggauccugcucaccacggaacugauuaucugggcugccuccgccgacaccccgcugauggagucuggauggagcgacacagcucacggcguugggauugugccuaugaagaccgaucuugaacucgacuuugcccuggcuuccucuagcuccuauagcuaccgccggaaacuggucaaccccgccaaccaagaggaaacacucccuuuccauuuccagcuggauaaacaggugguucacgcggagauccagaaucuuggacacuggauggacggcaccuuuaacauuaagacagccuuccauugcuauggggaguguaagaaguacgcuuaucccuggcaaaccgccaaaugcuuuuucgaaaaggauuaccaguacgagacgucuuggggcuguaauccucccgacugcccgggagugggcacagggugcaccgcuuguggagucuaucuggauaaacucagauccgugggcaaggccuacaaaaucgugagccugaaguauacccgcaaagucugcauccagcuggggacagaacagaccuguaagcacauugacguuaacgauugccuugugacgccuucugugaaggucuguaugaucggaacaauuuccaaacuccaacccggcgacacccugcuguuucucgggccccuggagcagggcggaaucauucuuaagcaguggugcacaaccagcuguguguucggcgauccuggggacaucaugucuacaaccagcggaaugcggugcccggaacauacgggcuccuuuagaaaaaucuguggguucgcgaccacaccuaccugcgaguaccaaggaaauacaguuagcggcuuucagcgcaugauggccacccgggacucuuuccaguccuuuaacgugacggagccccacauuacaagcaauagacuggaauggaucgaucccgacuccucuauuaaggaucacaucaacaugguccucaaucgcgacgugagcuuccaggaucuguccgacaacccuuguaaaguugaucugcauacccaaucuauugacggggcuuggggcagcggagugggcuuuacacuugucugcaccguggggcucaccgagugcgccaauuucaucacauccaucaaggcuugugauucugccaugugcuauggagccacgguuaccaaccugcugcggggcagcaauacagugaaggucguggggaaaggaggccacuccggcagccucuucaaguguugccaugacaccgauuguacagaagaggggcuggcugcgucucccccucaccuugacagagugaccggauacaaccagauugauuccgacaaagucuaugacgauggcgcucccccgugcacgaucaaguguugguuuacaaaaagcggggaauggcugcucggcauucugaauggaaacuggguugugguggccguccugaucgugauucuuauccugucuauucuccuguucuccuuuuucugcccuguucgcaaccggaagaauaaggccaacuga

SEQ ID NO: 13534 - RNA, 3423 nt, Artificial Sequence
  derived and/or modified CDS sequence (opt5) from BRV(Indiana)__AF030551.1__GP
auggugggcugggucugcaucuuccugguugugcucaccacagccacggcugggcugaccagaaaccuuuacgagcugaagauugaauguccccacacagugggacucggccagggguaugucaccggaagcguggagacaaccccuguuccgcugggccaagugacagaccuuaaaaucgaauccucuugcaauuuugaucugcauguccccagcaccacgauucagaaguacaaccagguggagugggccaaaaagaccuccacaaccgaaucuacaaaugcgggggcuagcaccuucgaggccaaaacgaaggagguuaaccucaagggaacauguaauaucccugugaccacauuugaagccgcuuauaaaucccggaagaccgucauuugcuacgaccuggccuguaaccagacccacugccugcccacagugcaucucaucgcuccugugcaaacguguaugucuguccgcagcugcaugaucggccugcuuuccagccggauucacguuaucuaugagaaaaccuacugugugacaggccagguggucgaagggcugugcuucauucccacccauacaaucgcccucacccagccuggacacacguaugauacaaugacccugccgauuaccuguuuucuuguggcgaagaaacugggcacacagcucaagaucgccguugagcuggagaagcugauuaccgcuucugggugcacagaaaauuccuuccaaggauacuacaucugcuuucucggcaaacacagcgagccccuguaugugccuacgauggacgauuacagaucugccgaacuuuucacccgcaugguccugaaccccaagggggaggaccaugauccugaccaggauggacagggccucaugagaaucacaggccccauuaccgcuaaagugccguccacagaaaccacggagaccaugcaggggguugccuuugcgggaacaccuauguauagcucuuucuccacccugcuucggaaggccgaccccgaguacguguuuagcccuggcaucauucccgaauccaaucacucugucugugauaaaaagacaaugcccaucaccuggacgggguuccuggcugugagcggagagauugagaaaaucacaggcugcaccgucuuuuguacacucgccgggccuggagcuuccugcgaagccuauagcgaaaccggcaucuucaacauuucuuccccgaccugucuggugaauaagguucaaaaguuccgcggcagcgagcagagagugaacuuuaugugccagcgggucgaccaagaugugguuguguacuguaaugggcagaaaaaggucauccugacaaaaacgcucgugauuggacagugcaucuauaccuucacaucucuguuuagccuucugcccggcguggcccauucccucgcuguugagcugugugucccugggcuucacggaugggcgaccacagcccugcucauuaccuucugcuuuggcuggcugcugauccccucugugacgcucaucauucugcgcauccuuagacugcucacauucagcuguucccacuacagcaccgaaucuaaguuuaaaauucugcuggagaaggugaaggucgaauaccagaaaaccaugggguccauggugugcgacaucugccaucacgagugugaaacagcuaaggagcuugacacccaucggaaaagcugcccugagggccaaugucccuauugcaugacaaugacggaaucuaccgaguccgcccuccaggcccacuucagcguuuguaagcugacaaaccgcuuucaggaaaaucugaaaaagucccucaagcauccggaggugaaacagggaugcuacagaacccugggcgucuuccgguauaagucucgcuguuacguggggcuuguuuggggcauucugcucacagcugagcugaucauuugggccgcgagcgcugaaaccccucugauggaguccggauggucugauacggcccacggggugggaaucguccccaugaaaaccgaccuugaacucgauuuugcccuggcuagcuccagcucuuauuccuacagacggaagcuggugaacccugccaacagcgaggaaacacuccccuuccaccuccaacuugagaaacagguugugcaugcugagauccacaaucugggccauuggauggacgggaccuuuaacauuaagacagccuuccacugcuauggcgaauguaagaaauacgcguacccuuggcagaccgccaagugcuucuuugagaaagauuaucaguacgaaacaucuuggggauguaaucccccggacugcccuggcgucgggaccggauggacggcuugcggcguguaucucgauaagcugagauccguggggaaagccuacaagaucgucagccugaaauauacacgcaagguuuguauucaacuuggaaccgagcagaccugcaagcacaucgacgugaacgauugucucgugacacccucugucaaagugugcaugauuggcaccguuagcaagcugcagcccggggacacgcugcuguuccugggcccucuugaacagggaggcaucauccugaaacaaugguguacaaccuccugcguguuuggggauccgggagacauuaugagcacaaccucuggcaugaagugucccgagcauacaggguccuuccggaaaaucugcggauuugcuaccacgccuaccugugaguaccagggcaauacagucagcggguucaagagaaugauggccacccgcgacuccuuucagucuuucaacgugacagaaccccacauuaccagcaaucggcucgaguggaucgauccugacuccucuauuaaggaucauaucaacguugugcugaauagagacgucagcuuucaagaucuguccgacaaccccugcaaaguggaucuucacacgcagucuaucgacggcgcguggggaagcggcguuggguucacacucguguguaccgucggacugacagaaugcgccaauuuuauuaccuccaucaaggcuugcgaucuggccauguguuauggcgcuaccgugacaaaccuccugcgcgggagcaauacggugaaagucguuggaaagggcggccauucugggucccuuuucaaaugcugucacgacaccgauugcacagacgagggacuggccgccagcccuccccaccucgaucgggugaccggcuuuaaccagauugacucugacaagguguacgaugacggggcuccgccuuguuccgucaagugcugguucacaaaaagcggagaauggcugcugagaauccuuaauggcaacuggauggugguugcggugcugauugucauccucauccugucuauucuccuguucuccuuuuucugucccauccgcagccggaaguccaaaccuaacuga

SEQ ID NO: 13535 - RNA, 3423 nt, Artificial Sequence
  derived and/or modified CDS sequence (opt5) from BRV(Oklahoma)__AF030552.1__GP
auggugggcugggucugcaucuuccugguugugcucaccacaagcacggccgggcugaccagaaaccuuuacgagcugaagauugaauguccccacacagugggacucggccagggguaugucaccggauccguggagaucacaccuguuccgcugggccaagugaccgaccuuaaaauugaaucuagcugcaauuuugaucugcauguccccuccacaaccauccagaaguacacccagguggagugggcuaaaaagucuagcacgacagaauccaccaacgccgcggcuacaaccuucgaggccaaaacgaaggagguuucucucaaggggacauguaauauuccugugaccacauuugaagccgcuuauaaaagccggaagaccgucaucugcuacgaccuggccuguaaccagacccacugccugcccacagugcaucucaucgcuccugugcaaacguguauguccguccgcagcugcaugguuggacugcuuucuucccggauucaggugaucuaugagaaaaccuacugugugacaggccagcuggucgaaggccucugcuucauucccacccacacaaucgcccugacccagccugggcauacguaugauacaaugacccuuccgauuaccuguuuucugguggcgaagaaacucggaacacaacugaagaucgccguugagcuggagaagcucauuaccgcuagcggcugcacagaaaauucuuuccagggguacuacaucugcuuucugggaaaacacuccgagcccauguaugugccuacgauggacgauuacagaagcgccgaacuuuucacccgcaugguccugaaccccaagggcgaggaccacgauccugaccagaaugggcagggacucaugagaaucgcuggccccauuacagccaaagugccgucuaccgaaacaaccgagacgaugcaaggcaucgcguuugccggggcuccuauguauuccaccuucgccacacugguucggaaggcugaucccgaguacguguuuagcccuggaauuauccccgaauccaaccauucugucugugacaaaaagaccaugcccauuacauggaccggcuuccuugcccugagcggggagaucgaacgcaucacgggaugcacaguguuuuguacccucgccggcccuggggcuuccugcgaggcguauagcgaaacaggaauuuucaauaucucuuccccgaccugucuggucaacaaagugcagaaguucagaggcagcgagcagcggauuaauuuuaugugccaacgcguugaucaggacguggucguguacuguaacggccagaagaaaguuauccugaccaagacacucgugauugggcagugcaucuauacguucaccucucuguuuagccuucugcccggagucgcccacucccucgcuguggagcugugugugccuggccuucaugggugggccacaaccgcccugcucaucacauucugcuuuggauggcugcugauucccgcuaucacccucauuguucugaaaauccuuagacugcucacguucucuuguagccacuacuccaaggaaagccgguuuaaaauucugcuggagaaggucaagguggaauaccaaaagacaaugggcucuauggugugcgauaucugccaccaugacugugagaccgccaaggaacuugacacccacaaaaaguccugcccugaggggcagugucccuauugcaugacaaugaccgagagcacagaaucugcgcuccaggcucauuucuccgucuguaaacugacgaaucgcuuucaggagaaccugaaaaagagccucaaacacccggaagugaagcaaggcugcuacagaacccugggaguuuuccgguauaaaucccgcuguuacgugggccuugucugggggcugcuccugacaaccgagcugauuaucugggccgccucugcugagacaccucuuauggaaagcggaugguccgauaccgcccauggcguggggaucguucccaugagaacggaccucgagcuggauuuugcucuggccucuagcuccagcuauucuuaccggagaaagcucgugaauccugcgaacaccgaagagacacugcccuuccaccuucagcuggaaaaacaggucgugcacgccgagauucagaaccucggacauuggauggacggcaccuuuaauaucaagacagcuuuccacugcuauggggaguguaagaaauacgccuacccuuggcaaaccgcuaagugcuucuuugaaaaagauuaucaguacgagacauccuggggcuguaaucccccggacugcccuggaguuggcaccgggugcacggccuguggaguguaucuggauaagcugcgcagcgucggcaaagcguacaagauugugucucuuaaauauacacggaaggugugcauccagcucgggaccgaacagaccuguaagcauauugacgucaacgauugccugguuucccccagcgugaaaguguguaugaucggaacagucucuaagcugcaacccggcgacacccuccuguuccuugggccucuggagcagggcggaaucauucucaaacaguggugcacgacaagcuguguguuuggcgauccgggggacaucauguccaccacaagcggaaugagaugccccgaacacaccggcucuuuccgcaagauuuguggguuugccacaaccccuacgugcgaguaccaaggaaacaccaucuccggcuucaaacggaugauggcuacaagagacagcuuucaguccuucaauguuaccgagccccacauuacaucuaaccgccuggaauggaucgauccugacagcuccaucaaggaucauauuaaugugguccugaaccgggacgugucuuuucaggaucuuagcgacaaucccuauaagguugaucuccacacccaguccaucgacggggccuggggcucuggagugggcuucacgcuggucuguauuguggggcugacagagugcgcuaacuuuaucaccagcauuaaagccugcgauauggccauguguuacggagcuacaguuaccaaucuccugagaggcuccaacaccgugaaggucguggggaaaggaggccauagcggcucucuuuucaagugcugucacgacacagauugcacggaagaggggcuggcggccuccccuccccaucucgaccgcgugaccggauacaaucaaaucgauagcgacaaagucugugacgauggcgcuccgcugugcucuguuaaguguugguuuacaaaguccggggaauggcugcuuggaauccugaacggcaauuggauggugguggccguccucgugguuauucugauccucagcauucugcuuuucucuuucuuuugcccuauccgguccaaaaagagcaaacccaacuga

SEQ ID NO: 13536 - RNA, 3399 nt, Artificial Sequence
  derived and/or modified CDS sequence (opt5) from THAIV(Thai749)__L08756.1__GP
auguggggccugcucgugaucgccguccugguugggcccggauucgccauuaagaacguguacgacaugaaaaucgagugcccucacagcgugaauuuuggcgaaaccuccgucacaggacagguggagcuuccggcccugcccauuacggaagcggagcaacucguuccugaaucuagcuguaacauggauaaucaucagucccuggcuaccaucaacacacuuaccaaggugucuuggcggaaaaaggccgaccaggucagcgccucccagaauagcuucgaggugauugaggcugaaacaucuuuuaaaggacugugcaugcucaagcacagaaugaucgaggaauccuucaagaaccgcagaagcguuaucuguuaugaucugucuugcaauaccacauuuuguaaacccaccguguacauggucgugccugugcaugccugcaacaugaugaaguccugucuggucggccucgggcccuaucggguucaagugguguacgagcgcacguauugcaccgucgggauucugacagagggcaaauguuucaucccugacaagaccauucuuagcucuaucaaaagaggcauguuugugguuacauccgugcagguccugugcuucuuuauugugcagaaggggcacagcuacaagaucauggaugaaguuaaaaagucuaugaugaauaaauguaacgacaccgagaauaaggugcagggauauuacauuugcauccucggcgggaacuccgcuccggucuacgugcccagccuggaugacuuccgguccauggaaaucuuuucuaauaugcuucgcagcccuuucggagaggaucaugaccugcccggcgaagaguuuuccacguaucaaauugccgggccuacagaggcgaaagucccccacaccgccagcucuaagaaccucgcucugaucgccuacuccggaaauccgagcuauucuagccugucccucauuacaucuagccaggauggcagauacguguucuccccuggccuguuccccaaccuuaaccagacccagugcgagaaaaaugcucugccuaugguuuggcgggggaugaucgaccucagcggauauuacgaagccauucaccccuguaacaucuuuugcgugcugucuggccccggggcguccugugaagccuucagcgagggaggcaucuuuaauauuaccucuccuacaugccuugucuccaagcaaaaccgcuucagagcugccgaacagcagaucaauuuugugugucaacggguugauauggacauuguggucuauugcaacgggcagaagaaaacgauccugaccaagacacucauuaucggacaguguaucuacaccauuacaagccuguucucccugcucccgggcguggcucauucuaucgccauugagcugugcgugcccggcuuucacgggugggccaccgcugcgcuucugaucacguucuguuuuggauggauucucaucccuacaauuacccuggccguucuugucgugcugaaauucaucgcuaauauccuccauaccaacagccaggagaaucgcuuuaagcugauucugaaaaaggugaaggaagaguucgagaaaacaaagggcuccauggucugcgaaguguguaaauacgaaugcgagaccucuaaggagcucaaagcccacaaccugagcugcccccaauccaaguguccuuauugcuuuacacacugugaacccacggaggccaccuucaaggcucauuacaaaguuugccaggccacacacagauuccgggaagaccuuaagaaaaccgugacaccgcagaccgucgggccuggauguuaucgcacgcugaaucucuuuagauacaagagccggugcuauauccugaccauguggcuguuccuucucucuauugaguccaucaugugggcggcuagcgccgccgagauuccccuggugccucuguggacagauaacgcucauggcaucgggucuguucccaugcacaccgaccucgaacuggauuuuucccuuccuagcucuagcaaauacacauauaagagaaagcugaccaaucccgugaacacggagcagggcguccaacuccauaucgaaauugaggaacagggaaucggcgccgacgugcaccaccuggggcauugguucgaugcucgccugaaucuuaaaacauccuuucacuguuacggagccugcagcaaguaccaguauccguggcauaccgcgaaaugucacuucgagaaggacuacgaguaugaaaacucuugggccugcaacccugcugauugucccggcguugggacaggaugcaccgccugcggccucuaccuggaccagaugaaacccauugggaccgcuuauaagcugguggccauccgguacuccagaaaagcguguguccaauuuggcgaggaacaccucugcaagacaauugauaugaaugacuguuucgugacgcgccaugugaagaucugcaucauuggaaccgucagcaaauuuauccagggcgauacacugcuuuuccuggggccucucgagggaggcgggcugauuuuuaagcacugguguaccuccacaugccaguucggagacccgggcgacaucaugucucccaaagauaagccuuuucugugucccgaguucccugggcaguuccggaaaaagugcaacuuugccaccacgcccguuugugaauaugacggcaaucaaauuagcggauacaagaaaaugaaggcuacaaucgauuccuuccagucuuuuaacaccagcuccauccauuucaccgacgagagacuuauggaagauccugacggcaugcuccgcgaucacauuaauaucguggugacaaaagacauugauuuugagaaccuggccgaaaaucugugcgggaucggacuccaggucucugcuauuaagggcgccugggggagcggagugggcuucacccugacaugucaaguuucccuuacggagugccccaccuuucugacaagcaucaaagccugcgacauggcuauuuguuacggggcggaaucugugacccucguccggggccagaacacagugaagaucuccggaaagggcgggcauagcggaucuuccuucaaaugcugucacggcguugauugcagcucuaaugggcugcaggccaacccgccucaccuggacagaguggcuggagucuccgagcuuaccaaugagaagguguaugaugacggcgcuccccaguguggcaucgccugcugguuuauuaaaagcggggaauggguuaagggaaucuucuccggcaacuggauugugcucaucguccugugugugcugcuccugauuagccuuauccugcucgggaucuuuugcccugugcgcaaacauaagaagucuuga

SEQ ID NO: 13537 - RNA, 3426 nt, Artificial Sequence
  derived and/or modified CDS sequence (opt5) from TULV(Moravia/5302v/95)__NC_005228.1__GP
auguucugccugugucucagccugcuuggccugcuccugugcuggcccgccgcuaccagaaaccuucuggagcucaagguggaauguccucacacaaucgggcugggacagggcauugucaucggguccgccgagcugccgcccguuccucucgcgaaaguggaaucucugaaacuugagagcuccugcaauuuugaccugcauacgucuaccgcugcccaacaggccuucacaaaauggagcugggaaaagaaagcugauaccgccgagaacgcuaaggccgcguccacaaccuuucagucuagcuccaaggaggugcagcuccggggacugugugucauucccacacuugugcuggaaaccgccagccgcacgagaaaaaccguuacaugcuucgaccucucuuguaaucaaaccgugugccagccuacagucuaccugauggcucccauccagaccugugugacgacaaaguccugccugcucggccugggggaucagcggauucaaguuguguaugagaaaaccuacugugucagcggacagcuuaucgaaggcaacugcuuuaauccucugcacacaaucgccauuucucagccgacccauaccuaugacaucaugacacucgcugugcacugcuucuuuauuuccaagaaaggcgggacggaugacacccugaagaucgagaagcaguucgagacacuuguggaaaagaccggauguacagagaacgcccugaagggcuacuaugcgugcauucucgggaccagcucugaagucguuuacgugcccgccauggaugacuaucgcuccagcgagauccuguccagaaugacgacagcuccucauggagaagaucacgacauugaucccaaugccaucucuagccugcggaucgugggccaacucaccgggaaagcuccuuccaccgagagcucugacacaguccagggaauugccuuugccggcacaccccuguacaccuccacgagcauccuugugcgcaaggaggauccgauuuaccuguggucuccuggcaucauucccgaagggaaccacagccagugugacaaaaagacccucccucugacauggaccggauucaucacacuucccggcgagaucgagaaaaccacgcaaugcaccguuuucuguacacuguccgggcccggagcugacugcgaagcguauucugauaccggcauuuucaauaucagcuccccuacaugucucgugaacagaguccagcgguuucgcggggccgaacaacaggugaaguucguuugccagagaguggaccuggauauuaccgucuacuguaauggagugaagaaagucauccugacgaagacacucgugauuggccagugcaucuauaccuucacaagcaucuuuucucugaugccgggcguugcucauucccuugccguggagcuguguguccccgggcuccacggaugggccaccauuagccugcugaucaccuucugcuuuggcuggcuugcuauuccucuccugucuaugaucauuauccgguuccugcucauuuuuacauaccugugcuccaaauauagcacggacuccaaguucaaacuuaucaucgagaaggugaagcaggaauaccagaaaaccauggggucuaugguuugugaggugugccaacagggaugugaaacagccaaggagcuggaaagccauaaaaaguccugcccccacggccaguguccuuauugccucaaccccaccgaggcgacagagucugcucugcaggcccacuuuaaagucuguaagcugaccacgcgcuuccaagaaaaucuuaagaaaagccucuccacauacgagccgaagagagggcuguaccggacccugagcauguuucgcuauaaaucuaagugcuacgugggccucgugugguguauucugcuuaccauggaacugaucguuugggccgcuuccgccgagacaauuaaccucgagccuggauggaccgauacagcucauggcagcgggaucauuccccugaaaacggaccuggaacuugauuucucucucccuuccagcgccaccuauacauacagacgggagcugcagaaucccgcgaacgaacaggagaagaucccuuuucacuuccagauggaaagacaagucauccaugccgagauucagcaccugggacauuggauggacggcaccuuuaaccucaagacagcuuuccacugcuaugggucuuguaucaaauacgccuaucccuggcagaccgcuaagugcuuccuggagaaagauuuugaauuugagacgggauggggcugcaauccgccugacugucccggggugggcaccggaugcacagccuguggcguguaccuugauaagcugcgcagcgucgggaaaguguacaagauucucucccugaaauauacccggaagguuugcauccaacugggaacagaacagaccuguaagacaauugacagcaacgacugccuugugaccacgucugucaaaguguguaugaucggcacaaucuccaaguuucagcccggggauacccuccuguuccugggaccucucgaggaaggcgggaugauuuuuaaacaguggugcaccacaaccugucaauucggcgacccgggagauaucaugagcacgccccugggcaugaagugcccugagcacgcgggguccuuucgcaaaaaguguucuuucgccacacuucccagcugccaguacgacggaaauaccguuuccggcuaucagagaaugauugcuacaaaggauucuuuucagagcuucaacaucaccgagccucauauuacaaccaauucccuggaauggguggaccccgauucuagccucaaagaccacgucaaccugaucgugaaucgggaucuguccuuucaagaccuugccgagaacccuugccagguugaucugagcgugucuuccaucgacggggcuuggggaagcggcgucggguucaaucucguguguucugugucccugacggaaugcgccagcuuucucaccucuauuaaggccugugauuccgcuaugugcuacggcagcuccacagcgaaccuggucagaggacagaauaccguucauguggugggcaaagggggacacagcggcucuaaguucauguguugccacgacaaaaaguguagcgccacagggcuugucgcugccgcuccccaucuggaccgcgugaccggauauaaccagaucgauacgaauaagguuuucgacgauggcgccccgcaaugcggcgugcacuguugguuuaaaaaguccggggaguggcuccugggcauucugucuggaaacuggauggucguggccguucuuaucgcgcuguucauuuuuagccuccuccuguucucccugugcuguccucggagacagaauuacaaaaagaacaaauga

SEQ ID NO: 13538 - RNA, 5055 nt, Artificial Sequence
  derived and/or modified CDS sequence (opt5) from CCHFV(10200)__U39455.2__GP
augcacaucagccugauguacgccauucucugccugcagcuuuguggccugggggagacccauggaucccacaacgaaacaagacauaauaagacggacaccaugacaacccacggcgauaaccccucuagcgagccuccgguguccacagcucucucuaucacccuggaccccagcacagucaccccuacgacccccgccuccgggcuugaaggaucuggcgagguuuauacaagcccucccauuaccacagggucccugccucucagcgaaaccacgccggagcugcccgugacaaccggaacagauacccugucugcgggcgacguggauccuuccacccagacagcuggcgggacgagcgcccccaccguccggacaucucucccuaauucccccagcaccccgucuacaccucaggacacccaucaccccgugcgcaaccugcuuuccguuacgagcccuggacccgaugagacauccacccccucuggcaccgggaaagaaagcuccgccacaagcucuccucacccgguguccaauagacccccuacacccccugcuaccgcccagggacccacggagaacgacagccauaaugcuaccgaacacccggagucucugacacagagcgccaccccuggccucaugacaucccccacccaaaucguccauccucagucugcgacgcccauuaccgugcaggauacacacccuagccccaccaaccgguccaagcgcaaucugaaaauggagaucauccuuacacugagccaggggcucaagaaauacuauggaaagauucugagacugcuccaacugacccuugaagaggacacggaaggccugcucgaguggugcaagcggaaccugggccuugauugugacgauacauucuuucagaaacgcaucgaagaguucuuuauuaccggggagggacacuucaaugaaguucugcaguuuagaacaccgggcacccucucuaccacagaguccacgccugccgggcugcccaccgcugaacccuucaagagcuacuuugccaaaggauuccugucuaucgacuccggcuauuacagcgcuaagugcuauuccgggacaucuaacagcggacuccagcugauuaauaucacccggcauuccacacgcauuguggacaccccuggcccgaaaaucacgaaccuuaagacaaucaauuguauuaaccugaaggccucuaucuuuaaagagcacagagaagucgagauuaacgugcuccugccccaaguggcggucaaucuuagcaacugccauguugugaucaagucccacgugugugauuacagccuggacauugauggcgccguccggcucccucauaucuaccacgaggggguguucauccccggaaccuauaaaauuguuaucgacaagaaaaauaagcugaacgaucgcugcacccuguuuacagacugugugauuaaaggcagagaaguccggaaggggcagucugugcuccgccaguacaagaccgagaucagaauuggaaaggcuuccacaggcuuccggagacugcuuagcgaggaaccuucugaugacugcguuucccgcacgcaacugcuccggaccgaaacagccgagauccacggggauaauuauggcggacccggcgacaagaucaccauuuguaacgggagcacaaucguggaucagagacugggaucugagcugggcugcuacaccauuaaucgcguccggagcuuuaaacuuugcgaaaacuccgcuacggggaagaauugugagaucgacagcgugccugucaaaugcagacagggauauugucuccgcauuacccaggaaggccgggggcaugugaagcugucuagaggcuccgagguugugcuggacgccugcgauacaagcugugagaucaugauucccaagggaaccggcgacauccucgucgauugcuccgggggacaacagcacuuccugaaagacaaccuuaucgaucugggcuguccgaagauuccucuccuggggaaaauggccaucuacauuugccgcaugucuaaucaucccaagacaaccauggcuuuccuguuuugguucagcuuuggauaugugaucacauguauucuuugcaaagcgaucuucuaccuccugaucauuguuggcacccuggggcggagacucaagcaguaccgcgaacugaagccucagacguguacaaucugcgagaccacccccgugaacgccauugacgcugaaaugcacgaucuuaauugcuccuauaacaucuguccguacugcgccucucggcugacaagcgacggccucgccagacacgucauucaauguccuaaacggaaggagaaaguggaagagaccgagcuguaucugaaucuugaacgcauccccugggugguuagaaagcuccugcaggucuccgagucuacgggaguggcucugaaacggagcuccuggcucaucgugcugcuuguccuguuuacagugagccucucuccuguucaguccgcccccauuggccaggggaagaccaucgaagcguacagagcucgcgagggauauacaagcauuugccuguucgugcugggcucuauccuuuuuauugucuccugucucaugaaggggcugguggauagcguuggaaacucuuucuuucccggccuguccaucugcaaaaccuguagcaucuccagcauuaacggguucgaaaucgagucucauaagugcuacuguagccucuuuugcuguccuuauugccggcacugcuccacagacaaagagauucauaagcugcaccuuucuaucuguaaaaagagaaaaaccggcagcaaugugaugcuggccgucugcaagcucauguguuuccgcgccacgauggaaguguccaacagagcucuguuuauucggucuaucauuaauaccacauucguucugugcauccuuauccuggccgugugugucgugagcaccuccgcuguggagauggaaaaccucccggccggaacaugggagcgcgaagaggaucugaccaauuucugccaucaagagugucaggucacggaaacagagugccucugucccuacgaagcgcugguucuuagaaagccucuguuucucgacucuaccgccaaaggcaugaagaaccugcugaauagcacaucccuugagaccagccugucuauugaggcucccuggggagccaucaacgugcaguccaccuacaaaccuacagugagcacggcuaauauugcccucucuugguccagcgucgaacaccggggaaacaagauccugguguccggccgcucugagagcauuaugaaacucgaagagagaaccgggaucuccugggaucugggaguugaagacgcgagcgagucuaaacuucugacaguguccgucauggaccucagccagauguauucucccguguucgaguaccugagcggcgaucggcaaguugaagaguggccuaaggcuaccugcacaggcgacuguccggaacgcugcgggugcaccuccucuacgugucugcacaaagaguggccccauagcagaaauuggcggugcaacccuacaugguguuggggagugggcaccgggugcaccuguugcggacuugaugucaaggaccuguuuacagauuauauguucgugaaauggaagguugaauacaucaaaaccgaggccauugugugugucgagcucacaucccaggaacgccagugcucucugaucgaggccggcacgagauuuaaucucgggcccgugaccauuacacugagcgaaccucggaacauccaacagaaacuucccccggagauuaucacccugcacccuagaaucgaagagggauucuuugaccugaugcaugugcagaagguccucuccgcuagcacaguuuguaaacugcagucuugcacccacggcgugcccggcgaucuucaaguguaucauauugggaaucugcucaagggagacaaagucaacggccaccugauccacaagauugagccccauuucaacacguccuggaugagcugggaugggugugaccucgauuacuauugcaauaugggagacuggccuuccugcaccuacacaggcgugacccagcacaaccaugccucuuuuguuaaucugcuuaacaucgaaacagauuacaccaaaaauuuccacuuucacagcaagcgcgugacagcccauggggacacgccccagcuggaccugaaggcucggccuaccuauggagcgggcgagauuacaguccucguggaaguugccgauauggagcugcacaccaaaaagaucgagauuuccggccuuaaauucgcuucucuggccuguaccgggugcuacgccuguagcuccagcaucucuugcaaggugagaauccaugucgacgaaccggaugagcucacagugcacgucaaauccgacgaucccgacgugguugcugccucuagcucccugauggcgcgcaagcucgaauuuggaacggauagcaccuucaaggcuuucucugccaugccuaagacaagccuguguuuuuauauuguggagcgggaacauugcaaguccuguucugaggaggacaccaaaaagugcgucaacacaaaacuugaacagccccaaagcauccugauugagcacaagggcaccaucauugggaaacaaaauuccacguguacagccaaggcuagcugcuggcuggaauccgugaagucuuucuuuuacggacucaaaaacaugcugagcggcaucuucgggaauguuuuuaugggaaucuuccuuuuucuggccccuuucauucuccugauccucuuuuucauguuuggcuggcgcauucuguucuguuucaagugcugcagacggaccagaggccuuuuuaaauaucgccaccugaaggaugacgaggaaaccggguaccggagaaucauugagaaacugaacaauaagaaggggaaaaacaagcuccuggauggcgagcggcuugcggacgggcgcaucgcugaacuguucuccacaaaaacccauaucggauga

SEQ ID NO: 13539 - RNA, 5055 nt, Artificial Sequence
  derived and/or modified CDS sequence (opt5) from CCHFV(IbAr10200)__AF467768.2__GP
augcacaucagccugauguacgccauucucugccugcagcuuuguggccugggggagacccauggaucccacaacgaaacaagacauaauaagacggacaccaugacaacccccggcgauaacccuucuagcgagccgcccguguccacagcucucucuaucacccuggacccuagcacagucacccccacgaccccugccuccgggcuugaaggaucuggcgagguuuauacaucucccccuauuaccacagggucccugccgcucagcgaaaccacgcccgagcugccugugacaaccggaacagauacccugucugcgggcgacguggaucccuccacccagacagcuggcgggacgagcgccccuaccguccggacaucucuccccaauuccccgagcaccccuucuacaccccaggacacccaccauccugugcgcaaccugcuuuccguuacgagccccggacccgaugagacauccaccccuucuggcaccgggaaagaaagcuccgccacaagcucuccgcaccccguguccaauagaccucccaccccucccgcuacagcccagggaccgacggagaacgacagccacaaugcuaccgaacauccugagucucugacacagagcgccacccccggccucaugacauccccuacccaaaucguccacccccagucugcgacgccuauuaccgugcaggauacacaucccagcccgaccaaccgguccaagcgcaaucugaaaauggagaucauccuuacacugagccaggggcucaagaaauacuauggaaagauucugagacugcuccaacugacccuugaagaggacacggaaggccugcucgaguggugcaagcggaaccugggccuugauugugacgauacauucuuucagaaacgcaucgaagaguucuuuauuaccggggagggacacuucaaugaaguucugcaguuuagaacaccuggcacccucucuaccacagaguccacgcccgccgggcugcccaccgcugaaccuuucaagagcuacuuugccaaaggauuccugucuaucgacuccggcuauuacagcgcuaagugcuauuccgggacaucuaacagcggacuccagcugauuaauaucacccggcacuccacacgcauuguggacaccccgggccccaaaaucacgaaccuuaagacaaucaauuguauuaaccugaaggccucuaucuuuaaagagcauagagaagucgagauuaacgugcuccugccucaaguggcggucaaucuuagcaacugccacguugugaucaagucccaugugugugauuacagccuggacauugauggcgccguccggcucccccacaucuaccaugaggggguguucaucccuggaaccuauaaaauuguuaucgacaagaaaaauaagcugaacgaucgcugcacccuguuuacagacugugugauuaaaggcagagaaguccggaaggggcagucugugcuccgccaguacaagaccgagaucagaauuggaaaggcuuccacaggcagccggagacugcuuucugaggaacccuccgaugacugcaucagccgcacgcaacugcuccggaccgaaacagccgagauccacggggauaauuauggcggaccuggcgacaaaauuaccaucuguaacgggucuacaauuguugaucagagacugggaagcgagcugggcugcuacaccaucaaucgcgugcgguccuucaaacuuugcgaaaacagcgcuacggggaagaauugugagauugacucuguccccgugaaaugcagacagggauauugucuccgcaucacccaggaaggccgggggcacgucaagcuguccagaggcagcgaggugguucuggacgccugcgauacauccugugagauuaugaucccgaagggaaccggcgacauccucguggauugcucugggggacaacagcauuuucugaaagacaaccuuauugaucugggcuguccuaagaucccccuccuggggaaaauggccauuuacaucugccgcaugagcaaucacccuaagacaaccauggcuuuccuguucugguuuuccuucggauaugucauuacauguauccuuugcaaagcgaucuuuuaccuccugauuaucgugggcacccuggggaagcggcucaagcaguacagagaacugaaaccccagacguguacaauuugcgagaccaccccgguuaacgccaucgacgcugaaaugcaugaucuuaauugcucuuauaacauuuguccuuacugcgccagccgccugacauccgacggccucgcccggcacgugauccaaugucccaagagaaaagagaaggucgaagagaccgagcuguaucugaaucuugaacggaucccuuggguggugcgcaaacuccugcagguuucugagagcacgggagucgcucugaagagauccagcuggcucauugugcugcuugugcuguucacagucucucucucccccgugcagagcgcccccaucggccaggggaagaccauugaagcguaccgggcuagagagggauauacaucuaucugccuguuuguucugggcuccauucuuuucaucgugagcugucucaugaaagggcuggucgauucugugggaaacuccuuuuucccuggccugagcaucugcaagaccuguuccauuagcucuaucaacggguuugaaauugagagccacaaaugcuacuguucccucuucugcuguccguauugccgccauugcucuacagacaaggagauccacaaacugcaucuuagcauuuguaagaaacggaagaagggcuccaauguuaugcuggccgugugcaaacucauguguuuuagagccaccauggaagucucuaaccgcgcucuguucaucagaagcauuaucaauacgaccuuugugcugugcauccuuauucuggccguuuguguggucuccacaucugcuguggagauggaaaaccuccccgccggaaccugggagcgggaagaggaucugacaaauuucugccaccaagagugucaggugaccgaaacggagugccucuguccuuacgaagcgcugguccuucgcaagccccuguuccucgacagcacagccaaaggcaugaagaaccugcuuaauuccaccagccuggagacaucucuguccaucgaggcuccuuggggagccauuaacguucagagcaccuacaaacccaccgugucuacagcuaauaucgcccucuccuggagcuccguggaacauagagggaacaagauucuggucucuggccggagcgaguccaucaugaagcucgaggaacgcacggggaucagcugggaucugggaguggaagacgcgucugaguccaaacuucugaccguuagcgugauggaccucucucagauguauagcccugucuuugaguaccuguccggcgauagacaagugggcgaauggccgaaggccacaugcaccggggacugucccgagcggugcggaugcacaucuagcaccugucugcacaaagaauggccucacucccgcaauuggagaugcaaccccacgugguguuggggcguugggacaggaugcaccuguugcggccuugaugugaaggaccuguucaccgauuauauguuugucaaauggaagguggaguacauuaagacagaagcuaucguuuguguggagcucaccucucaggagcggcagugcagccugauugaagccgggacacgcuucaaucucggaccugucacgaucacccuguccgagcccagaaacauucaacagaaacuuccgccugaaaucaucacacugcauccccggauugaggaaggcuuuuucgaccugaugcacgugcagaaggugcucagcgcuucuaccgucuguaaacugcaguccugcacacauggcguucccggggaucuucaaguguaucacaucggaaaucugcucaagggcgacaaagugaacgggcaucugauucacaagaucgagccucacuuuaacaccagcuggauguccugggauggaugugaccucgauuacuauugcaauaugggcgacuggcccucuugcacguacaccggggucacacagcauaaccacgccagcuucgugaaucugcuuaacauugagaccgauuacacaaagaauuuucauuuccacuccaaaagaguuaccgcccacggagacacaccucagcuggaccugaaggcucgcccgacguauggcgcgggcgaaaucaccgugcucgucgagguggccgauauggaacugcauaccaaaaagauugagaucucugggcuuaaauuugcuagccuggccuguacaggaugcuacgccuguuccagcggcaucucuugcaagguucggauucacguggacgagcccgaugaacucaccguccaugugaaauccgacgauccugacgucguggcugccucuagcucccugauggcgagaaagcucgaguucgggacagauagcacguuuaaggcuuucucugccaugcccaaaaccagccuguguuucuauaucguugaacgcgagcacugcaaguccuguucugaagaggacaccaaaaagugcgugaacacaaaacuugagcagccucaaagcauucugaucgaacauaagggaacaauuaucggcaagcaaaauuccaccuguacggccaaagcuagcugcuggcuggaguccgucaagagcuuuuucuacgggcucaaaaacaugcugagcggaaucuuuggcaauguguucaugggcauuuuucuuuuccuggcccccuuuauccuccugauucucuucuuuauguucggguggcggauccuguuuuguuucaagugcugcagacgcacacggggacuuuucaaauauagacaccugaaggaugacgaagagaccggcuaccgccggauuaucgaaaagcugaacaauaaaaaggggaaaaacaagcuccuggauggagagagacuugcggaccggcgcaucgcugagcuguuuuccaccaaaacacacauuggcuga

SEQ ID NO: 13540 - RNA, 5067 nt, Artificial Sequence
  derived and/or modified CDS sequence (opt5) from CCHFV(Turkey-Kelkit06)__GQ337054.1__GP
augcccaccaacaucaugcacacaccucuggugugcuucauucucuaccugcagcuucugugucucggcggggcccauggacaacugaaugcuacggagcacaacggcaccaauaacacaaccgccccgggggcgagccagucccccaagccucccaugucuacaaccccuccccaugcuccugaaagcuccacaaucaaaccgaccacgcccauuucugaggccgaaggaagcggcgagaccacauccccucccaauaccacacaggggcuuucuagcccugaaaccacguccgagagacccgccacaaccagcaucucuacauccagcaccgacucuaccaacccgacaacgcagaugaccgauaauacaccuacccccacagucuccaccagcccuucuuccagccccuccacgcccucuacaccucaagggauucaccauccggcucggagccugcucuccguuagcucucccaagaccgugaccacaccuacccccacauccccuggcgagaugagcucugaaacgagcucccagcacucugccaugagccgcauccccaccccgcacacagcuaccagaguguccacagagaucaccaaccaucggacgccucgccagagcgaaucuuccgcccagcaaaccacacccagcccuaugaccucucccgcgcaguccauucugcugaugagcgccgcuccuacagccguccaggacauccaccccuccccgaccaauagaucuaaacggaaccucgagacggagauuauccugacacuuagccagggccugaagaaauauuacgggaagauucucaagcugcuucaucugacccucgaacaagauacagagggacugcuggaauggugcaaaggcaaucucggguccaacugugacgaugacuuuuuccagaagcgcaucgaggaauuuuucaugaccggagagugcuauuuuaaugaggugcugcaguucaaaacccuuucuacacugagcccuacggaacccucccacgcuagacuccccaccgccgagccuuuuaagagcuacuucgcgaaaggcuuucugucuauugauuccggguauuucagcgccaaguguuacccgcggucuuccgcuagcggacuucaacugaucaacguuacacagcaccccgcccgcaucgcugaaaccccuggccccaagacaaccucucucaaaacgauuaauugcaucaaccugagagccagcguguuuaaggagcaucgggaagucgagauuaacgugcugcucccucagaucgccguuaaucuguccaacugucacguggucauuaauagccaugugugcgacuauucucuugauacagacggccccgugcgccugccuagaaucuaccacgaggggaccuucauccccggaaccuacaaaauugucaucgauaagaaaaacaagcucaaugaccgguguacacugguuaccaacugcgugauuaaaggccgcgaagugagaaaggggcaguccguccuucggcaauauaagacagagaucaaaauuggaaaggcuagcacgggcuuuagaaaacugcucuccgaggaaccgggggaugacuguaucucucgcacccagcugcugcggacagaaaccgcggagauccaugacgauaauuacggaggcccuggcgacaagauuacaaucugcaacgggagcaccauuguggaucagagacucggauccgagcugggcugcuauacgaucaaucgcguuaaaucuuucaaacuuuguaagaacagcgccaccgggaagacaugcgaaguggacuccacccccgucaagugucggcagggauucugccugaaaauuacacaagagggcagagggcacgugaagcucucucgcggcagcgaaguugugcuggaugcuugugacuccagcugcgaggucaugaucccuaaaggaaccggcgauauucugguggacuguucugggggacagcagcacuuucuuaaggauaaucucaucgaccugggcugcccccauaucccgcugcucgggcggauggccauuuacaucuguagaauguccaaccacccucgcacaaccauggccuuccuguuuugguucagcuuuggauaugucauuacgugcaucuucuguaaggcucuguuuuacucucugauuaucaucggcacacucgggaaaaagauuaaacaguaucgggagcugaagccccaaaccugcaccaucugcgaaacagccccugugaaugcgauugaugcugagaugcaugaccugaacuguuccuacaauaucugccccuacugugccagcagacuuaccucugacggccucgcccgccacguuacgcagugccccaaacggaaggaaaagguggaggaaacagagcuguaucugaaccucgagcggauuccuuggaucgucagaaaacugcuucagguguccgaaagcaccggaguugcucugaagcgcuccagcuggcucaucgugcugcugguccuucucacagugucucugagcccggugcaguccgcccccguuggccacgggaaaaccauugagaucuaccaaacaagagaaggauucgcuucuauuugucuguuuaugcucggcagcauccuguucauugucuccugccuugugaaggggcugguggauucugucagcgaguccuuuuucccuggacucucuguguguaaaaccugcagcaucggcuccguuaacggguuugaaaucgagagccauaaguguuauugcucucuguucuguugccccuacugccggcacuguuccgccgacagagagauucaucagcugcaccuuagcaucugcaaaaagcgcaagacgggcucuaaugugaugcucgcggucuguaaacggaugugcuucagagccaccauugaggcuucccgcagagcccugcugauccggagcauuaucaacacaaccuuugugauuuguauccucacacugaccaucugcguuguguccacgucugcugucgaaauggaaaaucuuccugccggaacaugggagcgcgaagaggaucugaccaacuucugucaucaggagugccaagugacagaaaccgagugucucugccccuaugaagcgcugguucugagaaagccucuuuuucuggacagcauugugaaaggcaugaagaaucuccugaacuccaccagccucgagacaucucuguccaucgaggccccguggggagcuauuaauguccagagcacguucaaacccaccgugucuacagccaacaucgcucuuagcugguccucugugguccaccggggaaauaagauucugguuaccggccgcagcgaauccaucaugaagcucgaggaaagaacaggggugucuugggaucugggaguggaggacgccagcgaauccaaacugcuuaccgucagcaucauggaucugucucagauguacuccccuguguuugaguaucucagcggcgaccggcagguugaggaauggcccaaggccacguguacaggggauugcccugagcgcugcggcuguaccuccucuaccugccugcacaaagaauggagccauuccagaaacuggcgguguaaucccacauggugcuggggagugggcaccggguguacaugcuguggagucgacgugaaggaucucuucacggaccacauguuuguuaaauggaagguggaguacauuaagaccgaagcuaucgucugcguggcgcugacaucucaagagcgccaguguagccuuauugaggccggcaccagauucaaccuggggccgguuacaaucacccucuccgaaccucggaauauucagcagaaacugccucccgagaucaucacgcugcaucccaagauugaagagggauuuuucgaucuuaugcacgugcaaaaaguccugagcgcuucuaccgugugcaagcuccaguccuguacacauggcauccccggcgaccuucagguguaccacauugggaaccuccugaaaggagacagagucaauggccaccuuauccauaagauugaaagccacuuuaacaccucuuggauguccugggaugggugcgaccuggauuauuacugcaacaugggagacuggccuagcuguacauauaccggcguuacacagcauaaucacgccgccuucgugaaccugcucaauaucgagacggauuacaccaagacauuucacuuccauucuaaacgcgugaccgcucacggggacaccccgcaacuggaucuuaaggcccggcccacauauggagcgggcggcauuacgguccugguggagguugcugacauggaacuccauaccaaaaagguggagaucagcgggcugaaauucgccucccucgccugcacaggauguuacgcuugcucuagcggcaucuccuguaagguccgcauucacguggaugaaccugacgagcugaccguucaugugaaaagcuccgaucccgacgucguggccgcgucuacaagccuuauggcuagaaagcuggaguuugggaccgauuccacguucaaggccuuuucugccaugccuaaaacaagccugugcuucuauaucgucgaacgggaguacuguaaguccugcucugaagacgacacccagaaauguguggauaccagacucgagcagccccaaagcauucugaucgaacacaagggaacaauuaucggcaaacagaacgauaccugcacagcuaaggccuccuguuggcuugagagcguuaaguccuuuuucuacgggcugaaaaauaugcucggaucuguguuuggcaaccuguucaucggcauucuccuguuucuugcuccguucguccugcuggugcucuuuuucauguucggguggaagauccuguuuugcuucaaaugcugucgccggaccagaggacuuuuuaaguaucgccaccugaaagacgacgaggaaacgggcuaccggagaauuaucgagcggcucaauagcaagaaggggaaaaaccgccugcucgauggagacagacuggccgaucggaagauugcggaacuuuucucuacaaaaacccauaucggcuga

SEQ ID NO: 13541 - RNA, 5103 nt, Artificial Sequence
  derived and/or modified CDS sequence (opt5) from CCHFV(UCCR4416)__KY484026.1__GP
auguuccugcacuuuaaguucaugcuccugaccaacuuuuucuuuugccagcuucuguggggcgggggaggcguggccagcgggggaagaacaaauacguccucuacccaaacaacccucaucagcuccaacacacuuaauucuaccaugagcguccuugaguccucuauuggcacagcuaccgaaacgguucccagcaccacaaccaacacaccugacacccaggugacgacagauuccgggagcggagagucuuccaccgacccgcagacaaccagcaaagaagugcccucuaccuccgucgccacaaucaagacgcaggagagcgaaacccaucgggcgcaaaauccuucuacaaccgcuggcuccggcgccagcacacccuccaacaccacgucuaauaaaccugaugugaacagccugacaucccccauucucgaggccaagagcucuccuuccccgagcaaaaccucuaugccccagaccgcucaccaucugagccgcucccugcucucugccgcuacaaccgagacaaaucaggccgcgagcguuaugacgaccacaagagaaaccacaaccauguccagcccuacgaccgugaagaacucugucacagccauccccacccaggggauuacaaccuccaauacgagcaagcaaacagacaccaucacacuggagaucucuccuaaaauucagaccacccagucccagcaaacagcuacgcccgccaucgcuccggccaccacagcgauugccuucaucagcccuaccaaccgguccaagcgcgaaucuaaagugcagauuauccuuacauuuagccagggacugaagaaauacuauuccaagauucucaagcugcuucaccugacccaagaggaggauucugaaggccuccuggagugguguacgagaguucuggaacaggcuugcaaugacgauuacuucaacgagcggaucgaagaguuuuucaucacagggaaaggauauuuuaaugacgugcuccaguuccgccuguacgauacccuuagcaccacagaguccacccagaacacaagccccacggccaagccuuuuagaucuuauuacgcuaaaggcucccugaccuucgacagcggguauuucucugccaaguguuacccccgggccuccaacagcggacuccaacugauuaaugucacacagcauucugugaaaaucgcuaacacccccggcccuaagauuagcaauccgaaaacaaucaacugcauuaaucuuaagguguccaccgauaaggaccacagcaaacuggaaaucaacguccuccugccccagguugcggugaaucugucuaacugucacgugcucaucgagucccaugucugcgauuacagccuggacacggacggcaccauuaagcugccuaaaaucacacacaauggggccuuuauucccggaaccuauaagaucgugauugauaaaaagaacaagcugaaugaccgcugugcucucuucacaaacugcguuaucaaaggcagagaagugcggcgcgggcaguccgcccugagacaauaccggaccgagauccgcauuggacagacauuuaccggcucuagacggcuucuggccgaagggggaagcaaugauugugucuccagaacgcagcucgugaagacagagguugcugagauccaugaagacucuuauggcggcccuggggagaaaauuaccaucugcaacggaagcaccauuguggaucagcgccugggcuccgaacugggguguuacacaaucaaucgggucagaaccuauaagcucugcgagaacucugccacggaaaaaucuugcgagauugacuccgugcccgucaaguguaagcaaggauucugccugaaaaucacacaggagggccgcgggcacgugaaacuuagccggggcaccgaaaucguucuggaugugugugacacaucuugcgagcucaugauuccgaaaggaaccggcgauauccuggucgacuguuccgggggacagcagcacuuucugcaagauaaccuuauugaccucggcugcccuaauaucccccugcuggggagaacagcgauuuacgugugucgcaugagcaaccauccuaagaccacgauggcuuuccucuuuugguucucuuuuggauauguuauuaccugcguggucuguaaagugcuguucuaccuucugaucgugaucggcacacucgggaagcggcugaagcaguacagagaacugaaaccccagaccugcaucguuugugaguccauuccugucaaugccaucgacgccgagaugcacgaucuuaacugcaauuauaacauuugccccuacugugcuagccgccucacaucugacggccuggugcggcaugugacccaaugcccgaagagaaaagaaaaggucgaggaaacggagcuguaucucaaucuggaacgcaucccuuggcuugugcggaaacugcuccagguuuccgagagcacaggaguggcccugaagagauccuguuggaugaucacccugcuuauucuccugacagucagcaugucucccgugcagagcgcucccguuggccacaaacgggccguggaggucuaccagaugcgcgaauccuauaccgggaucugccuguuugugcucggaucuguucuguucgcggugagcuggcuugucaaggcccugauugauuccaucggcaacagcuuuuucccugggcucagcauuuguaagaccugcuccaucggaucuaucaauggcuucgagauugaaagccauaaauguuacugcucccuguuuuguugcccguauuguagagcuugcagcucugacaagaucacacaccggaugcaccugaacgugugcaaaaagagaaaagugggguccaaugucaugcuugccguuuguaagcgcaugugcuucaaggcuacgauugaggccagcaaccgggcgaccuuuaucagaaauauuaucaacucuacauucgugauuuguauccucauccuggugauuugcgucguguccaccagcgccguugauauggaaaaucugcccgcuggcaucugggagaaagaggaagaccucacaaacuuuugucaucaagagugccaggugaccgaaacggagugucugugcccuuacgaagcccuuaugcugcgcaagccccucuuccuggauagaauugcuaaaggaaugaagucccugcuuaacucuacaagccuggagaccucccucagcaucgaggccccuuggggcgccauuaauguccagucuaccuuuaaacccacaguguccgcugcgaacaucgcccugagcuggucuagcguugaacacaaggggaauaagauccucguguccggacggucugagagcauuaugaaacuggaggaacgcaccggcaucuccuggugucuuggggucgaggacgcuucugaaagcaagacacugacgguguccguuauggaucucagccagauguacucuccuguguucgaguaucuguccggagacagacaagucgaagaguggcccaaagcuaccugcacaggcgauuguccggaacggugcgggugcaccagcuccacaugucugcauaaggaguggccucacucucgcaacuggagaugcaaucccaccugguguuggggcgugggaacgggcugcaccuguugcgggcuugacgugaaagaucuguuuacagacuacaugcucgucaaguggaagguugaguauauuaaaaccgaagccaucauuuguguggagcugacaagccaggaacggcagugcucccucaucgaggccggaacccgcuucaaccugggcccugugacaaucacgcuuucugaacccagaaauguccagcaacggcugccgccugagauuaucacccuccaccccaagauugaggaaggguuuuucgaccugaugcaugugcagaaaguuaugagcgccuccacaguguguaagcugcagagcugcacccacggagucccuggcgaucuucaaguguaccauguuggcaaccugcucaaaggggacaaggugaauggacacucuauccauaaaauugagucccaccugaacaccagcuggaugucuugggauggcugugaccucgauuauuuuugcaauaugggggacuggcccuccugcacauacacgggagucacccagcacaaccaugcggcuuucaucaauaugcugaacauugaaacagauuauaccaagacauuccacuuucauagcaagcgcgugaccgcccacggcgacacgccccagcuugaucugaaagccagaccugcuuacggggccggagagaucacaguccugguggaaguugcggaccucgagcugcauaccaagaaaaucgaggugucuggccuuaaguucgcuagccuguccuguucuggcugcuacgccuguagcuccgggauuagcugcaaaguccggauccacgugaaugaaccggaugaguuuaccguucacgugaaguccaacgaccccgaugucguggccgcuggaucuagccucauggccagaaagauugaauccggcgcugacucuacauucaaagccuuuagcuccaugccuaagaacucucuguguuucuauaucguggagcgcgacuacugcagcuccuguaccgaugacgauacacagaaaugcguugacauuaagcucgagcauccccaaagcauccugaucgaacacaaagggaccauuaucggaaagcagaaugauacguguccuacaaagaccucuugcuggcuugaguccauuaagagcuuuuucuauggccugaagaacaugcugucugggaucuuuggaaaugucuuccucggcaugcugcuuuuucuggcgcccuucauucuccugauccucuucuuuuucuuuggcuggcggcugcuuuucugucugaaaugcugcagacgcacacggaagcugcucaaauacaagcaucugagagacgaagaggaauccggguauaagaaaaucauugagcgccuuaacgauaagaaaggaaagagccggcuguuugacggcgagagacucgccgaucgcaaaaucgcugaacuguucucuaccaagacgcacauuggguga

SEQ ID NO: 13542 - RNA, 5103 nt, Artificial Sequence
  derived and/or modified CDS sequence (opt5) from CCHFV(ArD15786)__DQ211627.1__GP
auguuccugcacuuuaaguucgugcuccugaccaacuuuuucuuuugccagcuucuguggggcgggggaggcgucacaagcgggggaggcacgaauaccuccucuacacaagccauccucauuagcuccaacacccccaauucuacaaugagcguucuggaguccucuaccgggacagcugccgaaaccgugccuagcacgaccaucaacacaccggacacccaggugacaaccgauuccggaagcggcgagucuuccacggacccccagacaaccaauggcgaagucccuagcacaucuauugcgaccaucaaaacccaggaguccgaaacaagacggacgcaaaaccuuagcaccacagcugggucuggagccuccacccccggcaauacaaccagcaacaagccugaugugaaucugcucacgucccccauuucugaggccaaaagcuccccuagcccgucuaagacauccacaccccagaccgcucaucaccugagccgcucucugcucagcgccgcuacaaccgagacaucccaggccgcgucuguuaugacgaccacaagagaaaccacaaccaugagcuccccuacgaccgugaaaaacagcgccacagcuacccccacacaggggaucaccacgucuaauacauccaagcaaaccgacacaaccacccuggagaucccucccaagauucagacaacgcagagccagcaaaccgccacaccggcuaucaccccugccacaaccgcgauugccuucaucucucccacgaaccgguccaaacgcgaaagcaagguccagauuauccuuacauuuucccagggacugaaaaaguacuauucuaaaauucucaagcugcuucaucugacccaagaggaggauagcgaaggccuccuggagugguguaccagagugcuggaacaggcuugcgacgaugacuacuucaaugagcggaucgaagaguuuuucaucacagggaagggauauuuuaacgauguucuccaguuccgccuguacgacaccuuuuccacaacggagucuacccagaauacaagcccuaccgccaaacccuucagauccuauuacgcuaagggcagccuuacauucgauucuggcuauuuuuccgccaaauguuacccccgggccagcaacucugggcugcaacucauuaacgugacccagcacuccgucaagaucgcuaauacgccuggaccgaaaauuagcaaccccaagaccaucaauugcauuaaccugaaagugucuacagacaaggaucauagcaaacuugaaaucaaugugcugcucccucaggucgcgguuaaccuguccaauugucacgugcugaucgagagccacgugugcgacuacucucucaacaccgacggcacaauuaagcugcccaagaucgcccauaauggggcuuucauuccuggaaccuauaaaaucgucauugauaagaaaaacaaacuuaaugaccgcugugcccuguuuacaaacugcgugaucaagggcagagaaguucggcgcgggcaguccgcccucagacaauaccggaccgagauccgcauuggacagacguucacaggcagcagacggcugcuugcugaaggcggguccaaugauugugugucuagaacccagcuggucaagaccgaggugacagagauccacgaagacagcuauggaggccccggggagaagauuaccaucugcaacggauccacgauuguugaucagcgccucggcucugaacugggguguuacacaaucaaucgggugagaaccuauaaacugugcgagaacagcgccacagaaaaguccugcgagauugacucugucccggugaaauguaagcaaggcuuuugccucaagaucacccaggagggacgcggccaugucaaacugagccgggggacagaaaucgugcuugauguuugugacaccuccugcgagcugaugauuccuaagggaacgggcgauauccucguggacuguagcgggggacagcagcacuuccugcaagauaaccugauugaccuuggcugccccaauaucccucuccuggggcagaccgcgauuuacgucuguagaaugucuaaccaccccaaaacaaccauggcuuuucuguucugguuuuccuucggcuaugugaucacaugcguuguguguaagguccucuuuuaccugcuuaucgugauuggaacccugggcaaacgccucaagcaguaccgggaacugaagccucaaacgugcaucgugugugagagcauucccguuaaugccaucgacgccgagaugcaugaucugaacugcaauuauaacauuugcccguacugugcuucuagacuuacauccgacgggcucguccgccacgugacccagugcccuaaacggaaggaaaaaguggaggaaacagagcuguaucugaaucucgaaagaauccccuggcugguccgcaaacuucuucaggugagcgagucuaccggaguugcccucaagcgguccuguuggaucauuacccugcugauccuucucacagugagcaugucccccguccagagcgcuccugugggccauaagagagccguugagguguaccaaauucgggaaucuuauacggggaucugccuguucguccugggaggcgugcucuuugcgguuagcuggcuggugaaagcccuuauugauuccaucgggaacucuuucuucccgggccugagcaucuguaagaccugcuccauuggaucuaucaauggcuuugagauugaaagccacaaguguuacugcucccuccuguguugccccuauugucgcgcuugcucuagcgacaaaaucacacauagaaugcaccugaacgucugcaagaaacggaaggugggguccaaugugaugcuugccgucuguaaaagaaugugcuucaaggcuaccauugaggccaacaaucgcgcgacauuuauccggaacauuaucaauagcaccuucguuaucuguauucucauccuggugauuugcguggucucuacguccgccguggauauggaaaaccugccugcuggaaucugggagaaggaggaagaccucacaaacuuuugucaccaggagugccagguuaccgaaaccgagugucugugccccuacgaagcccuuaugcugagaaaaccucucagccuggauucuauugcuaagggcaugaaaucccugcuuaauagcacaucccuggagaccucucucagcaucgaggcccccuggggagccaucaacgugcaguccacauucaagccuacgauuagcgcugcgaauaucgcccugucuugguccagcgucgaacauaaagggaacaagauucucgugucuggccgcagcgaguccaucaugaagcuggaagagagaaccgggauuucuuggugucuuggcguugaggacgcuagcgaauccaaaacacugaccgugucugucauggaucucagccaaauguacucccccguguuugaguaucugagcggagaccggcagguugaagaguggccgaaggccacaugcaccggcgauuguccugaacgcugcgggugcacgucuuccaccugucugcacaaagaguggccccauagcagaaauuggcggugcaacccuacaugguguuggggagugggcaccgggugcacauguugcggacuugacgucaaggaucuguucaccgacuacaugcucgugaaauggaagguggaguauaucaagacagaagccaucauuugugucgagcugacgucccaggaacgccagugcucucucaucgaggcuggcaccagauuuaaucugggccccguuacaauuacccuuagcgaaccgcggaacgugcaacagcgccugccucccgagaucauuacccuccacccuaaaaucgaggaaggguucuuugaccugaugcacgugcagaaggucauguccgccucuacaguguguaaacugcaaagcugcacgcauggaguucccggcgaucuucagguguaccacgucgggaaucugcucaagggagacaaagugaacggccauuccauucacaagaucgagagccaucugaauaccucuuggauguccugggaugggugugaccucgauuauuucugcaacaugggagacuggcccagcugcacauacaccggcguuacacagcacaauagagcggcuuuuaucaacaugcugaauauugaaaccgauuauacgaaaacauuccacuuccauucuaagcgggugaccgcccacggcgacaccccucagcuugaucugaaggcccgcccgacauacggggcuggagagaucaccguccugguggaagucgccgaccucgagcugcauaccaaaaagauugagguguccggccuuaaauuugcgagccugaccuguucugggugcuacgcuuguagcuccggaaucucuugcaagguucggauucacgugaacgaacccgaugaguucacgguccaugugaaaagcaacgacccugauguuguggccgccggcuccagccucauggcuagaaagaucgaauccggggccgacucuacauuuaaggcuuucagcuccaugcccaaaaauucucuguguuuuuauaucgucgagagagacuacugcagcuccuguaccgaugacgauacacaaaagugcguggacauuaaacucgagcacccucagucuauccugauugaacacaagggaaccaucauuggcaaacagaacgauacgugucccaccaagacaagcugcuggcuugaguccaucaagagcuucuuuuauggccugaaaaauaugcugucugggaucuucggaaacauuuuucucggcaugcugcuuuuccuggccccuuuugugcuccugauccucuucuucuuuuucggguggcgccugcuguuuugucugaagugcugccggagaacccgcaaacugcucaaguacaaacaucugcgggacgaagaggaauccggauauaagaagauuaucgagagacuuaaugauaaaaagggcaaaagccgccuguucgacggggagcggcucgcggauagaaagauugccgaacuguuuucuacaaaaacccacguuggauga

SEQ ID NO: 13543 - RNA, 5100 nt, Artificial Sequence
  derived and/or modified CDS sequence (opt5) from CCHFV(UCCR4432)__KY484047.1__GP
auguucugccugagacucgugcugcuuaucaaccuggcccucugucagcugcuugagggcaaugacggggucaccagcgcugaugaaauuaacuccaauacaacgcaaaccucucugggacuccccacaauccugaacagcaccaccccugccccgggccccuccauugacgcgaccauggaggcuguuccugggacaaccaauucugugcuggaaacacaggugaccauggauagcggauccggcgagcucucuacagaccccaccacaacccgggaagccacgacaccuaucaccgccgcuacagucagcgcccaggagaccaagacccacaugacacagaaccccgggacgaccguggauccugacacaaccacauccaauaccacgacaagcauugagccgaucaccacacccccuacaucucccaccccucaagcuacacccacgccguccuacagcgaaaccccuacacugcccaacacccaucaccuuucucgcucccugcucagcgccguuggaacagaggcgggccagaccgccccugcuacgcccaccgccgaaguggcucuggcccccggcgggucuuccacagcggagagcaauaccaucuccauuccugcccaggauacaaccaucucuggagucagcaaacaggacaacccgacgacaaccggcauuucccccgaggcucaaacaaugcagagccagcaggccguggcuccuguuaccacccccgccacagccaucucugcuccuacgucccccaccaauagaagcaagcgggaaucuaaagugcaaauuauccuuacauuuccgcaggggcugaagaaauauuacagcaagauucucaaguuccugcaucugacccaggaggaagauuccgagggacuccuggaauggugcacacgcguccuucaacaggugugugacgauaccuauuuuaacgagagaaucaaagaguucuuuaucacgggcaagggguacuucaaugacgugcugcaguuuaaacuccacgauacgccugcgaccaccguccccgcccuggcugccucuagcacagccaugccuuuccgguccuauuacgcuaagggaagccuuacccuggacucuggcuauuuuuccgccaaaugcuacccccgcgcgagcaacucuggcaugcagcucauuaauguuacacaacauccuaugaagaucgcuaacacgcccgggccgaagauuuccaaccugaaaaccaucaauuguauuaaccugaaggugagcacagacaaagaacacuccgagcucgaaaucaaugugcugaucccucaggucgccgugaaccuuucuaauugcuucguuagcauuaagucccacgugugugauuacucucuggacaccgauggagccaucagacuccccaaagucgcucauaacggcguguuuaugcccgggacauauaagauuguuaucgacaaaaagaauaagcugaacgaucggugcgcccuuauuaccaauugugugaucaaaggacgcgaggucagaaagggccagagcacgcugcggcaguacaaaaccgaaauccgcauugggcaaacaaucgcuggauccagacggcuccuggccgagggcgugagcaacgacugcgucucucgcacccagcugauuaagacagagguggcggaaauccacgaggauuccuauggcgggccuggagaaaagauuaccaucuguaauggcagcacaauuguugaccagagacucgggucugagcugggaugcuacaccaucaaccgggugaagacguauaaacuuugcgaaaauuccgccacagagaaaggcugugagaucgauagcgucccggugaagugcaaacagggguucugucugaagguuacccaagaaggcagaggacaugugaaacucucucgcggcaccgagauuguccuggacgugugcgauacaagcugugaacugaugauccccaaggggaccggagacauucuuguggacugcuccggcgggcagcagcacuuucuccaggauaaccugaucgaccugggauguccuaauguuccccuccugggcaagauggcuauuuacaucugccggaugagcaaccacccuaaaacgacaauggccuuccuuuucugguuuucuuucggguaugucaucaccuguauugugugcaaggugcuguuuuaccuccugaucgucauuggcacacuguccaaaaagcugaaacaauacagagagcucaagccccagaccuguaucgugugcgagagcacaccuguuaacgcuauugaugccgaaaugcaugagcugaauugcaacuauaauaucugucccuacugcgcgucccgccugaccucugacggacucgugcggcacgucaaccaguguccgaagagaaaagaaaagguggaggaaacggagcuguaucuuaaucuggagcgcaucccuuggcucguucggagacugcugcaagugagcgaauccaccggcauggcccuuaaacgcucuugcuggaugacaacccuccugauucugcucgucgugagccugucccccguucagucugcuccuguggggcagggaaaggccgucgagguguaccgggugagagaaagcuauacauccaucugucuuuucguccugggcagcguucucuuugcugugucuuggcugauuaaagggcugaucgauggaauuggcaacuccuucuuucccgggcuuagcgugugcaagaccuguucuaucggcuccaucaauggauucgagauugaaagccauaaaugcuacuguucucucuuuugcuguccguauugccgcgccugcuccagcgacaagaucacgcaccggaugcaucugaacgucuguaagaaaagaaaggccggcuccaaugugaugcuggcuguuugcaaacggauguguuucaaggcgacaguggaggccagcaacaccgcucuccugauucgcgggaucauuaauucuacauuugucaucugcgugcuuauucugguuaucuguguggucagcaccuccgccguggauauggagaaccucccugccggaaucugggaaagagaggaagaccugaccaauuucugccaccaggagugucaaguuacagaaacggagugccugugucccuacgaggcucuuauucugcggaaaccucucuaccuggauucuaucgccaagggcaugaaaagccuccugaacuccaccaaucuugaaacaucucugagcauugaggcgcccuggggcgcuaucaacgugcaguccaccuuuaagcccacagucucugccgccaacauugcucucagcugguccagcguggaacacagaggaaauaagauccuggugucuggccgcuccgagagcaucaugaaacuggaggaacggaccgggauuucuuggucccuuggcgucgaggacgccagcgaauccaagacgcugacaguuucugugauggaucucagccagauguauuccccuguguucgaguaccugagcggagacagacaggucgaagaguggccgaaagcgaccugcaccggcgauugucaagagcgcugcgggugcacaucuuccaccugucuccauaaggaauggccccacagcagaaacuggcggugcaauccuacaugguguuggggagugggcacggggugcaccuguugcggacuggacguucgcgaccuuuucacagauuauaugauggugaaguggaaagucgaguacgugaagaccgaagcuaucauguguguugagcugacaucucaggaaagacagugcagccucauugaggccggcacccgguuuaaccugggccccgugacgaucacccuguccgagccucgcaauauucagcaaagacuucccucugaaaucgucacacugcauccuaaaaucgaggaaggguucuuugaccucaugcacgugcagaagguccugagcgccuccaccguguguaaacuccagucuugcacacacggaguuccgggcgaucugcaaguguaucaugucgggaaccuucugaagggagacaaggugaauggccacagcauucauaaaaucgagucccacuucaacaccagcuggaugucuugggaugggugugaccuggauuacuuuugcaauaugggagacuggcccuccugcacauauacgggcguuacccagcauaaccgggcugccuucauuaauaugcucaacaucgaaacagauuacaccaagaccuuucacuuccacagcaaacgcgugacagcucauggcgacacgccucagcuggaucuuaaggccagacccaccuacggggcgggagaggucacagugcugguggagguugccgaccucgaacugcacaccaaaaagauugaggucuccggccucaaauuugcuucucugacauguagcgggugcuaugccuguuccucuggaaucagcugcaaggugcggauucaugugaaugaaccugaugaguucaccguccacgugaaguccagcgaccccgacguuguggcugccgggucuucccuuauggcccgcaaaaucgaguuuggggcugauagcacguucaaggcguuuucuuccaugccgaaaaacagccuguguuucuacaucgucgaaagagacuauugcucuagcuguacaaaugaugacacccagaagugcguggauaccaaacuggagcauccucaauccauucucaucgaacacaagggaacaauuaucggcaagcagaacgacaccuguucuacaaaaaccagcugcuggcuggaguccguuaagagcuucuuuuacggccuuaaaaacaugcuugggggaauuuucggcaauguguuucucgggaucuuccuguuucucgcccccuucgcucugcuuaucuuuuucuuuuucuuuggauggcggcugcuguucugucucaagugcugcagacgcacgcggggccugcuuaaauauaagcagcugaaggaugaagaggaggccggguacaaaaagauuaucgaaagacucaacgacaaaaagggaaaaucccgccuguucgauggcgagcggcucgccgacagaaagauugcugaacuguuuucuacaaagacccacaucggcuga

SEQ ID NO: 13544 - RNA, 5100 nt, Artificial Sequence
  derived and/or modified CDS sequence (opt5) from CCHFV(Nakiwogo)__KX013484.1__GP
auguucugccugaagcucgugcugcuuaucaaccugacccucugucagcugcuugagggcaaugacagagucacaagcgccgaugggauuaacuccaauacgacccaaacaaaccugggaaucucuaccauucucaauagcacaacccccgcuccuggcccguccacagacaccacgauggaaaccguucccucuacagccgauagcaugcuggagacccaggugacaaccgacuccgggucuggagaaccuagcacggagcccacaaccacaggcgaagcgaccuccagcaccacagcugccacggugucuaugcaggagaccaaaaagcacaugacacagaacacccgguccacagccgauccugacaccacgacacccaauagcaccaccucugucgagccuacaaccaucccgcccacauccccuauuccccaagcuacgccuacccccgggcauggaaaagccccgacacugccuaacacccaccaucucagccgcucucugcuuuccgcugugagcacagaagccggccagaccacgcccgcgaccuccacaaccgaggccgcuucugccccuagcuccagcucuacagcugaaaauaacaccguuucccagcccgcccaggauacgacaaccagcggcgugucugagcaauacaaucccacaaccaccgggaucagcccuaaggcgcagacaaugcagggacagcaagccaucgucccggugacgacccccguuacaaccacauuuaccccuacgaaccccacaaauagauccaaacgggagucuaaggugcagauuauccugaccuucccucagggccucaagaaauauuacagcaagauucugaaacuucugcaccucacccaagaagaggacuccgaagggcugcuggaguggugcacacgcguccuccaacaggugugugaugacaccuauuuuaacgaaagaaucgaggaguucuuuauuacaggaaagggcuacuucaaugaugugcugcaguuuaaacuucaugacacgcccaccacaaccgucagcgcucuggccgcuucuuccacagccaugccguuccggagcuauuacgccaaggggucucucacccuggauuccggauauuuuagcgcuaagugcuacccucgcgcguccaacucuggcaugcagcuuaucaacguuacgcagcaccccaugaaaauugccaauaccccuggccccaagacaagcaaccugaaaaccaugaauuguaucaaccucaagguguccacagacaaagaacacucugagcuggaaaucaaugugcugauuccucaggucgcugugaaccucagcaauugccugguuuccaucaagagccaugugugugacuacucucuugauaccgacggggccauuagacugcccaaagucgccuauaacggaguguucaugccgggcacauacaagaucguuauugauaagaaaaaucggcucaacgaccgcugcgcucugaucaccaauugugugaucaaggggagagagguccggaaaggacaguccacgcuucgccaauauaagacagaaauuagaaucggccagacccugauggggagccggcgccuccuggccgagggagugucuaacgauugcgucuccagaacccagcugauuaaaacagagguggcggaaauccacgaggacagcuacggcggcccuggggaaaagauuaccaucuguaauggaucuacgaucguugaucagcggcucggcagcgagcuggggugcuauacaauuaacagagugaagaccuacaaacuuugcgaaaauuccgcuacagagaagggaugugagaucgacagcguccccgugaaaugcaagcaaggcuuuugucugaaaguuacccaggaagggcgcggccaugugaagcucucucggggaacagagauuguccuggaugugugcgacaccuccugugaacugaugauccccaagggcacgggggauauucuuguggacugcagcggaggccagcagcacuuccuccaagacaaccugaucgaucugggguguccuaacguuccgcuccugggaaaaauggccauuuauaucugcagaauguccaaucaccccaagaccacaauggccuuucuuuucugguucucuuuuggcuacgucaucaccuguguggugugcaaaguccuguucuaccuccugauugugaucgggacacugggcaagaaacuuaagcaguaucgcgagcucaagccucagaccuguauuguuugcgagagcauccccgugaacgucauugacgcugaaaugcaugagcugaauugcaacuacaauaucuguccuuauugcgccucccggcugacgucugauggacucgugagacacguuacacaaugucccaaacgcaaggaaaaaguggaggaaaccgagcuguaccuuaaccuggagcggaucccuuggcucgucagacgccugcuccaggugagcgaauccacaggcauggcucuuaagcggucuugcuggaugaccacccuccugauucugcucguugugagccugucccccguccagagcgccccgguggggcaggagaaagcgaucgaaguguaucaagucagagagucuuacacauccaugugucuuuuuguucugggaagcgugcuguucgccgugucuuggcuggucaagggccugauugacgggaucggaaauuccuuuuucccuggccuuagcgugugcaaaacguguucuauuggguccaucaacggcuuugaaaucgagagccauaagugcuauuguucccucuucugcugucccuacugccgcgcuugcagcucugauaagauuacccaccggaugcaucugaauaucuguaaaagacggaagguuggaagcaacgugaugcuggccgucugcaaacgcauguguuuuaaggcuacaguggaggccuccaauucugcgcuccugauuagaagcaucauuaacuccaccuucguuaucugcgugcuuauccuggucauuugugugguuucuacaagcgccguggacauggaaaaucucccugcuggcaucugggagcgggaagaggaucugaccaacuuuugccaccaggaaugucaggucacggagacagagugccugugucccuacgaagcccuuauucugagaaaaccgcucuaucuggacuccaucgcuaaggggaugaagucucuccugaauagcaccaaccuugagaccucccugagcauugaagccccuuggggagccaucaacgugcagucuacauucaaacccaccguguccgcugcgaauauugcccucagcuggucuuccgucgagcaccgcggcaacaagauccugguuagcgggcgguccgagucuaucaugaaacuggaagagagaacaggaauuagcuggucccuuggcguggaagaugcuagcgagucuaagacgcugaccguguccgucauggaccucagccaaauguacucuccuguguuugaauaucugagcggggaucgccagguugaggaguggcccaaagccacaugcaccggcgacugucccgaaagaugcggaugcacauccucuaccugucuccauaaggaguggccucacagccggaauuggcgcugcaacccgacgugguguuggggcguggggaccggaugcacauguugcggccuggaugucagagaccuuuucaccgacuacaugauggugaaguggaaaguugaauaugugaagacagaggccaucaugugugucgaacugaccucccaggagcggcagugcucucucauugaggcugggacacgcuucaaucugggacccgugacgaucacccugagcgaaccuagaaacguccaacagcggcuucccuccgagauugugacacugcauccuaaaaucgaagagggcuuuuucgaucucaugcacguucagaaggugcuguuuuguaaacacagccuccaagccaccucuugcacccauggcguccccggggaccuucagguguaccacguuggaaaucugcugaagggcgauaaggugaacgggcauuccauccacaaaauugaaagccauuucaauacauccuggaugucuugggacggaugugaucuggacuauuuuugcaacaugggcgauuggccuagcugcacguacaccggggucacacagcacaaucgcgcggcuuucgugaacaugcucaauaucgagaccgacuacacaaagaccuuucacuuccauuccaaaagagugacggcccacggagauacaccgcagcuggaccuuaaggcccggcccaccuauggcgcuggcgagguuaccguccugguggaaguggccgaucucgagcugcauaccaaaaagauugaagucucugggcucaaauuugcgagccugacauguuccggaugcuacgcuuguagcucuggcaucuccugcaaggugcgcauucacguuaacgagccugacgaguucacagugcaugucaagagcaaugaucccgacgugguugccgccgggucuucccuuauggcuagaaaaaucgaacugggagccgacagcaccuuuaaggcuuucucuagcaugccuaaaaacucccuguguuuuuauaucguggagcgggauuacugcucuagcuguacggacgaugacacacaaaagugcgucaacaccaaacucgaacacccccaguccauucugaucgagcacaagggcacaauuaucgggaagcagaaugauaccuguccgacgaaaaccagcugcuggcuugaauccgugaagucuuucuucuauggacugaaaaacaugcucggcggcauuuuugggaauguuuuccugggaaucuuucucuuccuggccccuuuugcgcuucugauucuguucuuuuucuuuggcuggagacuccuguucugucuuaagugcugccgccggacaagagggcugcucaaauacaagcagcugaaggacgaggaggaagccggauauaaaaagaucaucgagcgccucaacgauaaaaagggcaaaagccggcuguuugacggggaaagacuugcugaucgcaagauugccgagcuguucuccaccaagacacauaucggauga

SEQ ID NO: 13545 - RNA, 5100 nt, Artificial Sequence
  derived and/or modified CDS sequence (opt5) from CCHFV(UG3010)__AY900143.1__GP
auguucugccugagacucgugcugcuuaucaaccuggcccucugucagcugcuugagggcaaugacggggucaccagcgcugaugaaauuaacuccaauacaacgcaaaccucucugggacuccccacaauccugaacagcaccaccccugccccgggccccuccauugacgcgaccauggaggcuguuccugggacaaccaauucugugcuggaaacacaggugaccauggauagcggauccggcgagcucucuacagaccccaccacaacccgggaagccacgacaccuaucaccgccgcuacagucagcgcccaggagaccaagacccacaugacacagaaccccgggacgaccguggauccugacacaaccacauccaauaccacgacaagcauugagccgaucaccacacccccuacaucucccaccccucaagcuacacccacgccguccuacagcgaaaccccuacacugcccaacacccaucaccuuucucgcucccugcucagcgccguuggaacagaggcgggccagaccgccccugcuacgcccaccgccgaaguggcucuggcccccggcgggucuuccacagcggagagcaauaccaucuccauuccugcccaggauacaaccaucucuggagucagcaaacaggacaacccgacgacaaccggcauuucccccgaggcucaaacaaugcagagccagcaggccguggcuccuguuaccacccccgccacagccaucucugcuccuacgucccccaccaauagaagcaagcgggaaucuaaagugcaaauuauccuuacauuuccgcaggggcugaagaaauauuacagcaagauucucaaguuccugcaucugacccaggaggaagauuccgagggacuccuggaauggugcacacgcguccuucaacaggugugugacgauaccuauuuuaacgagagaaucaaagaguucuuuaucacgggcaagggguacuucaaugacgugcugcaguuuaaacuccacgauacgccugcgaccaccguccccgcccuggcugccucuagcacagccauuccuuuccgguccuauuacgcuaagggaagccuuacccuggacucuggcuauuuuuccgccaaaugcuacccccgcgcgagcaacucuggcaugcagcucaucaauguuacacaacauccuaugaagauugcuaacacgcccgggccgaagaucuccaaccugaaaaccauuaauuguaucaaccugaaggugagcacagacaaagaacacuccgagcucgaaaucaaugugcugauuccucaggucgccgugaaccuuucuaauugcuucguuagcaucaagucccacgugugugauuacucucuggacaccgauggagccauuagacuccccaaagucgcucauaacggcguguuuaugcccgggacauauaagaucguuauugacaaaaagaauaagcugaacgaucggugcgcccuuaucaccaauugugugaucaaaggacgcgaggucagaaagggccagagcacgcugcggcaguacaaaaccgaaauucgcaucgggcaaacaauugcuggauccagacggcuccuggccgagggcgugagcaacgacugcgucucucgcacccagcugaucaagacagagguggcggaaauucacgaggauuccuauggcgggccuggagaaaagaucaccauuuguaauggcagcacaaucguugaccagagacucgggucugagcugggaugcuacaccaucaaccgggugaagacguauaaacuuugcgaaaauuccgccacagagaaaggcugugagauugauagcgucccggugaagugcaaacagggguucugucugaagguuacccaagaaggcagaggacaugugaaacucucucgcggcaccgagaucguccuggacgugugcgauacaagcugugaacugaugauucccaaggggaccggagacauccuuguggacugcuccggcgggcagcagcacuuucuccaggauaaccugauugaccugggauguccuaauguuccccuccugggcaagauggcuaucuacaucugccggaugagcaaccacccuaaaacgacaauggccuuccuuuucugguuuucuuucggguaugucauuaccuguaucgugugcaaggugcuguuuuaccuccugauugucaucggcacacuguccaaaaagcugaaacaauacagagagcucaagccccagaccuguauugugugcgagagcacaccuguuaacgcuaucgaugccgaaaugcaugagcugaauugcaacuauaauaucugucccuacugcgcgucccgccugaccucugacggacucgugcggcacgucaaccaguguccgaagagaaaagaaaagguggaggaaacggagcuguaucuuaaucuggagcgcauuccuuggcucguucggagacugcugcaagugagcgaauccaccggcauggcccuuaaacgcucuugcuggaugacaacccuccugauccugcucgucgugagccugucccccguucagucugcuccuguggggcagggaaaggccgucgagguguaccgggugagagaaagcuauacauccauuugucuuuucguccugggcagcguucucuuugcugugucuuggcugaucaaagggcugauugauggaaucggcaacuccuucuuucccgggcuuagcgugugcaagaccuguucuaucggcuccauuaauggauucgagaucgaaagccauaaaugcuacuguucucucuuuugcuguccguauugccgcgccugcuccagcgacaagauuacgcaccggaugcaucugaacgucuguaagaaaagaaaggccggcuccaaugugaugcuggcuguuugcaaacggauguguuucaaggcgacaguggaggccagcaacaccgcucuccugauccgcgggauuaucaauucuacauuugucauuugcgugcuuauccugguuaucuguguggucagcaccuccgccguggauauggagaaccucccugccggaauuugggaaagagaggaagaccugaccaauuucugccaccaggagugucaaguuacagaaacggagugccugugucccuacgaggcucuuauccugcggaaaccucucuaccuggauucuauugccaagggcaugaaaagccuccugaacuccaccaaucuugaaacaucucugagcaucgaggcgcccuggggcgcuauuaacgugcaguccaccuuuaagcccacagucucugccgccaacaucgcucucagcugguccagcguggaacacagaggaaauaagauccuggugucuggccgcuccgagagcauuaugaaacuggaggaacggaccgggaucucuuggucccuuggcgucgaggacgccagcgaauccaagacgcugacaguuucugugauggaucucagccagauguauuccccuguguucgaguaccugagcggagacagacaggucgaagaguggccgaaagcgaccugcaccggcgauugucaagagcgcugcgggugcacaucuuccaccugucuccauaaggaauggccccacagcagaaacuggcggugcaauccuacaugguguuggggagugggcacggggugcaccuguugcggacuggacguucgcgaccuuuucacagauuauaugauggugaaguggaaagucgaguacgugaagaccgaagcuauuauguguguugagcugacaucucaggaaagacagugcagccucaucgaggccggcacccgguuuaaccugggccccgugacgauuacccuguccgagccucgcaauauccagcaaagacuucccucugaaaucgucacacugcauccuaaaauugaggaaggguucuuugaccucaugcacgugcagaagguccugagcgccuccaccguguguaaacuccagucuugcacacacggaguuccgggcgaucugcaaguguaucaugucgggaaccuucugaagggagacaaggugaauggccacagcauccauaaaauugagucccacuucaacaccagcuggaugucuugggaugggugugaccuggauuacuuuugcaauaugggagacuggcccuccugcacauauacgggcguuacccagcauaaccgggcugccuucaucaauaugcucaacauugaaacagauuacaccaagaccuuucacuuccacagcaaacgcgugacagcucauggcgacacgccucagcuggaucuuaaggccagacccaccuacggggcgggagaggucacagugcugguggagguugccgaccucgaacugcacaccaaaaagaucgaggucuccggccucaaauuugcuucucugacauguagcgggugcuaugccuguuccucuggaauuagcugcaaggugcggauccaugugaaugaaccugaugaguucaccguccacgugaaguccagcgaccccgacguuguggcugccgggucuucccuuauggcccgcaaaaucgaguuuggggcugauagcacguucaaggcguuuucuuccaugccgaaaaacagccuguguuucuacauugucgaaagagacuauugcucuagcuguacaaaugaugacacccagaagugcguggauaccaaacuggagcauccucaauccauccucauugaacacaagggaacaaucauuggcaagcagaacgacaccuguucuacaaaaaccagcugcuggcuggaguccguuaagagcuucuuuuacggccuuaaaaacaugcuugggggaaucuucggcaauguguuucucgggaucuuccuguuucucgcccccuucgcucugcuuaucuuuuucuuuuucuuuggauggcggcugcuguucugucucaagugcugcagacgcacgcggggccugcuuaaauauaagcagcugaaggaugaagaggaggccggguacaaaaagauuauugaaagacucaacgacaaaaagggaaaaucccgccuguucgauggcgagcggcucgccgacagaaagaucgcugaacuguuuucuacaaagacccacauuggcuga

SEQ ID NO: 13546 - RNA, 5100 nt, Artificial Sequence
  derived and/or modified CDS sequence (opt5) from CCHFV(Semunya)__DQ094832.1__GP
auguucugccugaagcucgugcugcuuaucaaccuggcccucugucagcugcuugagggcaaugacagagucaccagcgcugaugggauuaacuccaauacaacgcaaaccaaccugggaaucucuacaauucucaauagcaccacacccgccccuggcccguccaccgacacaaccauggaaacgguucccucuaccgcggauagcaugcuggagacacaggugaccacagacuccgggucuggagaaccuagcaccgagcccacgacaaccggcgaagcuacauccagcaccaccgccgccacagugucuaugcaggagacgaaaacccacaugacacagaacacccgguccacagcugauccugacaccacgacacccaauaccaccacaagcgucgagccuaccacaaucccgcccacgucuccuauucugcaagccacccccacaccugggcauggaaaggcucccacccucccgaacacacaccaucugucccgcagccuucugucugccguguccaccgaagcgggccagacgaccccugccacaagcaccacagaggcugccuccgcucccucuagcuccagcaccgccgaaaauaacacgauguuucagccugcgcaggauacaaccacaucuggcguuuccgagcaauacaaucccaccaccacagggaucagccccaaagcccagacgaugcaggcucagcaagccaucgugccugucaccacaccggugaccacaaccuucacgcccauuaacccuacaaauagaucuaagcgggagagcaaaguucagaucauucucaccuuuccccagggacugaagaaguauuacuccaaaauccuuaagcugcuccaccugacccaagaagaggacucugaaggccugcucgaguggugcacacgcgugcugcagcaggucugugaugacaccuauuucaacgaaagaauugaggaguuuuucaucacagggaaaggauacuuuaaugaugugcuucaguucaagcugcaugacacgccuaccacaaccgugcccgcucucgccgccagcuccacagcuaugccguuucggagcuauuacgcgaaaggcucucugacccuugauuccggguauuucagcgccaagugcuacccucgcgcuucuaacuccggaaugcaacugauuaacgucacgcagcaccccaugaagaucgccaauaccccuggccccaaaacaagcaaccucaagaccaugaauuguaucaaccugaaaguuuccacagacaaggaacacucugagcuggaaauuaaugugcucaucccucagguggccgucaaccugagcaauugccuuguguccauuaaaucucauguuugugacuacagccuggauaccgacggcgcuaucagacuccccaagguggccuauaacggggucuuuaugccgggaacauacaaaauugugaucgauaagaagaaucggcugaacgaccgcugcgcgcuuaucaccaauuguguuauuaaaggcagagaggugcggaaggggcaguccacgcugcgccaauauaaaacagaaaucagaauuggacagacccucaugggcagccggcgccugcuggcugagggggucucuaacgauugcguguccagaacccagcucaucaagacagaggucgccgaaauucacgaggacagcuacggaggcccuggcgagaaaaucaccaucuguaaugggucuacgauuguggaucagcggcugggauccgaacuuggcugcuauacaaucaacagaguuaagaccuacaagcugugcgaaaauagcgccacagagaaagggugugagauugacucugugcccgucaagugcaaacaaggauucugucucaaggugacccaggaaggccgcgggcauguuaaacugagccggggcacagagaucgugcuggaugucugcgacaccuccugugaacuuaugauucccaagggaacgggcgauauccucguggacugcagcgggggacagcagcacuuucugcaagacaaccugauugaucucggcuguccuaacgugccgcugcuugggaagauggcuaucuauaucugcagaaugucuaaucaccccaaaaccacaauggccuuccuguucugguuuuccuucggauacguuauuaccugugucgugugcaaggugcucuuuuaccugcugaucgucauuggcacacuugggaaaaagcucaaacaguaucgcgagcugaagccucagaccuguaucgugugcgagagcauucccguuaacgcuaucgacgccgaaaugcaugagcugaauugcaacuacaauaucuguccuuauugcgcgucccggcucacgucugauggccuggugagacacgucacacaaugucccaagcgcaaagaaaagguggaggaaaccgagcuuuaccugaaccucgagcggauuccuuggcugguuagacgccugcuucaggugagcgaauccacaggaauggcccucaaacggucuugcuggaugaccacccugcugauccuccuggucgugagccuuucccccguucagucugcuccggugggccaggagaaggccauugaagucuaucaagugagagagagcuacacauccaucugucuguucgugcucgggagcguccuguuugcuguuucuuggcuggugaaaggacuuauugacggcaucggcaauuccuucuuuccuggacucagcgugugcaagacguguucuaucggcuccauuaacggguucgaaaucgagagccauaaaugcuauuguucucuguuuugcugucccuacugccgcgccugcuccagcgauaagauuacccaccggaugcaucugaauaucuguaagagacggaaagucggcuccaacgugaugcucgcgguuugcaagcgcauguguuucaaagccacaguggaggcuagcaauucugcccugcuuauuagaagcaucaucaacuccaccuuugucauuugcgugcugauccucguuauuuguguggucucuacaagcgcuguggacauggaaaaucugccugccggaaucugggagcgggaagaggaucugaccaacuucugccaccaggaaugucagguuacggagacagagugccuuugucccuacgaagcccugauucucagaaagccgcuguuucucgacuccaucgcuaaaggcaagaagucucugcuuaauagcaccaaccuggagaccucccucucuauugaagcgccuuggggagccaucaacgugcagagcacauucaaacccaccgucuccgcugccaauaucgcccugagcuggucuuccguggagcaccgcgggaacaagauucuggugagcggccggucugaguccaucaugaaacuugaagagagaacagggauuagcuggucccugggagucgaagaugcuucugagagcaagacgcucaccguuuccgugauggaccugagccaaauguauucuccuguguucgaauaccucuccggcgaucgccaggucgaggaguggcccaaagccacaugcaccggggacugucccgaaagaugcggcugcacaagcucuaccugucugcauaaggaguggccucacagccggaauuggcgcugcaacccgacgugguguuggggagugggcaccgggugcacauguugcggacuugauguuagagaccuguuuaccgacuauaugauggugaaguggaaagucgaauacgugaagacagaggcgaucauguguguugaacucaccucccaggagcggcagugcucucugauugaggcuggcacacgcuucaaucuggggcccgugacgaucacccuuagcgaaccuagaaacguccaacagcggcugcccuccgagaucgugacacuccauccuaaaauugaagagggauuuuucgaucugaugcacguccagaaggugcucuuuuguaaauauucucugcaagccaccagcugcacccacggcguucccggcgaccuucagguguaccaugucgggaaucugcugaagggagauaaggugaacggccacuccauccauaaaauugaaagccacuucaauacaucuuggauguccugggacgggugugaucucgacuauuuuugcaacaugggagauuggccuagcugcacguacaccggcguuacacagcauaaucgcgccgcuuucgugaacaugcugaauaucgagaccgacuacacaaagaccuuucacuuccacuccaaaagagucacggcccauggggauacaccgcagcuugaccugaaggcgcggcccaccuauggagcuggcgaggugaccgugcucguugaagucgccgaucuggagcuccacaccaaaaagauugaagugucuggccugaaauuugccagccuuacauguuccgggugcuacgcuuguucuagcggaaucuccugcaaggugcgcauccaugucaacgagccugacgaguucacagugcacguuaagagcaaugaucccgacguggucgccgcugggucuucccugauggccagaaaaauugaauuuggggcggacagcaccuucaaggccuucucuuccaugccuaaaaacagccuguguuuuuauaucguggagcgggauuacugcucuagcuguacggacgaugacacacaaaagugcguuaacauuaaacucgaacauccccaguccauccugauugagcacaagggaaccaucauuggcaagcagaaugauacauguccgaccaaaacgucuugcuggcuugaaagcgugaaguccuucuuuuaugggcugaaaaacaugcucggaggcaucuucggcaaugucuuucuggggaucuuccucuuucuggcuccuuucgcccuucugauucuguuuuucuuuuucggauggagacuccuguucugucuuaagugcugccgccggaccagaggccugcucaaauacaagcagcugaaggacgaggaggaagcuggguauaaaaagaucauugagcgccucaacgauaaaaagggaaaaagccggcuguuugacggcgaaagacuugccgaucgcaagaucgccaagcuguucuccacaaaaacccacauuggguga

SEQ ID NO: 13547 - RNA, 5094 nt, Artificial Sequence
  derived and/or modified CDS sequence (opt5) from CCHFV(79121)__AB069673.1__GP
augcuguuccacuuuaaguucaugcuccucaucaacuuuauucuuugccaucugcucuggggcgggggaggcgugaccgggggaguggagaccaauagcagcucuacgcaggccauccaaacacccccuguuacaagcaacagcaccaccccgggccccucuaccgacacagcuaccgaaacggccagcuccaugaccacaucuaccccugacacacaggugaccacggacaaugggagcggagagcccuccacagauccucugaccacaaacgaagcgacacccccucuuagcgugaccacagcucagacgaccgagaccaagaagcacaccacacuggacccgucuaccuccacgaaucccgaugccacaaccccuagcauuaccauccucucugccuccaacacaagccugcccauuucuuccguccaugcuagcccuucccccucuagcuccgaggaaccgaccccucagaaugcccaccaucugagcagaucucuccuguccgcugugagcacagagacgggccaaaucgccucugcggccaccgcugccaaagaaaucacaaccaagaacucucccccuacagcuggcaaugacaccaugguuacguccgcccccaacgggaauauucggaacacccccgagcaggcgaauccuacagccccggaggcuucccccaaaauccagaccacacagaaccaacagaccgugacgccugaggccacacccauuaccacaaucaccgcucuuaccgaucugacaaaucgcagcaagagagacuccaagguccagaaaauucucacguucagccagggacugaagaaauacuauucuaagauccuuaaacugcuccaacugacccaggaggaagauuccgagggccugcucgaaugguguacacgggugcuggagcaggccugcgacgaugacuacuuuaacaagcgcauugaagaguucuuuaucaccgggaagggauauuucaacgauguucuucaauuuagacugcacgacgcccucagcaauacagagccugcucagaccacgucucccacagcggugccguucaaauccuacuaugccaagggcagccugaccuuugacuccggguacuucucugcucgguguuauccucgcgccagcaacuccggacuucagcugaucaaugucacccagcaccccgugaaaauugccaacacaccuggccccaagcucucuaaucugaaaaccaucaacugcauuaaucugaaggugagcacagauaaagaacauuccgagcucgaagucaacguucugcuuccucaaguggcugugaaucugagcaacugucacgucucuaucaagucccaugugugcgacuacagccucgauacggacggcgccauuaagcugcccagaguugcgcacaaugggguguuuaucccgggaaccuacaaaaucgucauugauaagaaaaacaaucuuaacgaccgguguacacugaucaccaauugcgugauuaagggccgcgagguuagaaaagggcagucugcucuccggcaguauaagacagaaauccgcauuggacagaccuucacgggcuccagacggcugcuggccgaaggcgggagcucugauuguaucagccgcacccaacucgugaagacagaggucgccgaaauccacgaggacuccuacgggggcccuggggagaaaaucaccaucugcaacggaagcacaauuguggaucagggccuggggucugagcuuggauguuauaccaucaacagaguccgguccuacaagcugugcgaaaauagcgcuuccggcaaaucuugcgagauugacagcauccccgugaaguguaaacagggguucugccucaagauuacacaggagggcagaggacauguuaagcugucccgcggcaccgaaaucgugcuggaugucugugacucuagcugcgagcuuaugauccccaaagggacgggagacauucucguggauuguuccggcgggcaacagcacuuucugcagaacaaucugaucgaccucggaugcccuaacguuccgcugcuuggcaagauggccauuuaugugugucggaugucuaaucaucccaaaacaaccauggcuuuccuguuuugguucagcuuuggguacgucauuaccugcauugccuguagaguccucuucuaucugcugaucgcgaucggcacagugggaaagaaacuuaagcaguaccgcgaacucaagccucaaaccugcauuguuugugaguccguccccgugaacgccaucgaugcugagaugcacgaacugaauugcagcuacaacauuugcccuuauugugccucucggcuguccacggacggccucaucagacaugugacacagugccccaaacgccgggagaaggucgaagagaccgaacuguuucuuaaucuggagcggauuccuuggcucgugcgcaaacugcugcagguuagcgagucuacagggauggcucuuaagcgguccuguuggaugaucacccuccugauccugcuccuggugagcauuucucccguccaauccgccccggugggaaaagaaagagcgaucgagacauaccaggcccgcgaaaccuauacgggcauuugccuuuucguucuggggagcgugcucuuugcugucuccuggcugaccaaggcccugaucgauggaauuggcaacagcuucucuccugggcuuagcguguguaaaacaugcuccaucggcucuaucaauggauuugagauugaaagccacaaguguuacugcucccucuucuguugccccuauugucgggcuugcucuagcgacaagaacacccacagaaugcaucugaauguuugcaaaaagcggaaaaugggcuccaacgugaugcuggccgucuguaagcgcaugugcuuuagagccacaaucgaggcuucuaauaaagcgcuccugauucggagcaucauuaacuccaccuucgugaucuguauucuuauccugacgaucugcguggucagcacaucugccguugauauggagaaccucccugcugggauuugggaaaaggaggaagaccugaccaauuucugucaccaggagugccaggugacagaaaccgagugucugugccccuacgaggccauggugcuuagaaagccgcuguuucucgauuccaccgccaaaggaaugaaaagccugcucaacucuacaucccuggaaacgagccuuuccaucgaggcuccuuggggcgccauuaauguccaaucuaccuucaaacccacagugagcgcggcuaacaucgcccuguccuggagcucuguugaacaucgcgggaauaagauucucguguccggacggagcgagucuaucaugaaacuggaggaaagaaccggcgucagcuggaaccuggggguggaggacgccuccgaaucuaagacacuuaccguuagcgugauggaucugucccagauguauucuccugucuuugaguaccucagcggcgaccgccagguggaagaguggcccaaggcuacguguacaggagauugccccgagagauguggcugcaccuccucuaccugccugcacaaagaauggccucacucccggaauuggcgcuguaacccgacauggugcuggggaguuggaaccggcuguacaugcugugggcucgacgugaaggacuucuuuacggauuacaugcuggucaaauggaagguggaguauaucaaaaccgaagccauugugugcgucgagcuuacaucccaggaaagacaauguagccugaucgaggcgggaacccgguucaaucucggccccguuacaauuacccuguccgagccucgcaacgugcagcagagacugcccccugaaaucgugacgcuucaucccaagauugaggaaggcuuuuucgaccugaugcacguccagaagauccucucugcuagcaccgugugcaaacugcaauccuguacacaugggguuccuggagauuuucagaucuaccacgugggcaaucuccugagaggggacaaggucaacggacauucuauucacaaaaucgagccgcacuucaauaccagcuggauguccugggauggcugcgaccuugauuauuuuuguaacaugggggacuggcccagcugcacauacaccggagugacacagcauaaucgcgccgccuucauuaacaugcugaacaucgaaacggauuauaccaagacauuucacuuccauucuaaaagaguuaccgcucacggcgacaccccucaacuggaucucaaggcccggcccgcuuacggcgccggggaggugacaguccugguggaggucgcggaccuugaacugcauacgaaaaaucucgagguguccggacugaagauugccagccugaccugcucuggcuguuaugcuugcuccagcgggaucucuuguaagguucgcauucacgugaacgaaccugaugaguucacaguccacgugagaagcuccgaccccgacguuguggccgcuggaucuagccugauggcccggaaaaucgaguuuggcgccgauuccaccuucaaggcuuuuagcuccaugccgaaagacucucuuugcuucuacaucgucgaaaaggauuacuguagcuccugcacagacgaugacacccagaaaugugugaauacgaagcuggaucauccucagucuauucugaucgagcacaaggggacaauuaucggaaaacagaacgauaccugcagcaccaagacauccuguuggcucgaaucugugaaaggcuuuuucuauggccugaagaauaugcuuagcgggauuuuuggaaacguuuuccugggcaucuuucucuuccuggcgcccuuuguccuccugaucuucuucuuuuucuuuggguggagacuucuguucugccugaaauguugccgccggaccagaggacuccugaaguacaagcaucuuaaagaugaggaagaggccggcuauaagaaaauuaucgagcgccugaaugggaagaaaggaaagucccaacucuuugacggcgaacggcuggcugauagaaagauugccgaacucuucagcacaaaaauccacauuggcuga

SEQ ID NO: 13548 - RNA, 5094 nt, Artificial Sequence
  derived and/or modified CDS sequence (opt5) from CCHFV(7001)__AB069670.1__GP
augcuguuccacuuuaaguucaugcuccugaucaacuuuauucuuugccaucugcucuggggcgggggaggcgugaccgggggagucgagacaaauagcuccucuacgcaggccauccaaacacccccuguuacaagcaacuccaccacaccgggccccucuaccgacacagcuaccgaaacggccagcuccaugaccacaucuaccccugauacacaggugaccacggacaaugggagcggagagcccuccacagauccucugaccacaaacgaagcgacacccccucuuagcgugaccaccgcucagacgaccgagaccaaaaagcacaccacacuggacccgucuaccuccacgaaucccgaugccacaaccccuagcauuaccauccucucugccuccaacacaagccugcccauuucuuccguccaugcuagcccuucccccucuagcuccgaggagccgaccccucagaaugcccaccaucugagcagaucucuccuguccgcugugagcacagagacgggccaaaucgccucugcggccaccgcugccaaagaaaucacaaccaagaacagcccucccacagcuggcaaugacaccaugguuacguccgcccccaacgggaauauucggaacacccccgagcaggcgaauccuacagccccggaagcuagccccaaaauccagaccacacagaaccaacagaccgugacgccugaggccacacccauuaccacaaucaccgcucuuaccgaucugacaaaucgcagcaagagagacuccaagguccagauuauccucacguucagccagggacugaaaaaguacuauucuaaaauucuuaagcugcuccaacugacccaggaggaagauuccgagggccugcucgaaugguguacacgggugcuggagcaggccugcgacgaugacuacuuuaacaaacgcaucgaagaguucuuuaucaccgggaagggauauuucaacgauguucuucaauuuagacugcacgacgcccucagcaauacagagccugcucagaccacgucucccacagcggugccguucaaguccuacuaugccaaaggcagccugaccuuugacuccggguacuucucugcucgguguuauccucgcgccagcaacuccggacuucagcugauuaaugucacccagcaccccgugaagaucgccaacacaccuggccccaaacucucuaaucugaagaccauuaacugcaucaaucugaaagugagcacagauaaggaacauuccgagcucgaagucaacguucugcuuccucaaguggcugugaaucugagcaacugucacgucucuauuaaaucccaugugugcgacuacagccucgauacggacggcgccaucaagcugcccagaguugcgcacaaugggguguuuaucccgggaaccuacaagauugucaucgauaaaaagaacaaucuuaacgaccgguguacacugauuaccaauugcgugaucaaaggccgcgagguuagaaaggggcagucugcucuccggcaguauaaaacagaaauucgcaucggacagaccuucacgggcuccagacggcugcuggccgaagggggaagcucugauuguaucagccgcacccaacucgugaagacagaggucgccgaaauucacgaggacuccuacggcggcccuggggaaaagaucaccauuugcaacggaagcacaaucguggaucagagacugggcucugagcuuggguguuauaccauuaaccgggucagauccuacaaacugugcgaaaauagcgcuuccggaaagucuugcgagaucgacagcauucccgugaaauguaagcagggcuucugccucaaaaucacacaggaggggcgcggccauguuaagcugucccggggaaccgaaaucgugcuggaugucugugacucuagcugcgagcuuaugauucccaagggcacgggggacauccucguggauuguuccggaggccaacagcacuuucugcagaacaaucugauugaccucgggugcccuaacguuccgcugcuuggaaaaauggccaucuauguguguagaaugucuaaucaucccaagacaaccauggcuuuccuguuuugguucagcuuuggcuacgucauuaccugcaucgccugucgcgugcuuuucuaucugcugaucgcgauugggacagugggcaaaaagcucaaacaguaccgggaacucaagccucaaaccugcaucguuugugaguccguccccgugaacgccauugaugcugagaugcacgaacugaauugcagcuacaacaucugcccuuauugugccucuagacuguccacggacggacucauucgccaugugacacagugccccaagcggagagagaaagucgaagagaccgaacuguuucuuaaucuggagcgcaucccuuggcucgugcggaagcugcugcagguuagcgagucuacaggcauggcucuuaaaagauccuguuggaugaucacccuccugauucugcuccuggugagcaucucucccguccaauccgccccgguggggaaggaacgcgcgauugagacauaccaggcccgggaaaccuauacgggaaucugccuuuucguucugggcagcgugcucuuugcugucuccuggcugaccaaagcccugauugaugggaucggaaacagcuucuuuccuggccuuucuguguguaagacaugcagcaucggguccauuaauggcuucgagaucgaaucucacaaauguuacugcagccucuuuuguugccccuauuguagagcuugcuccucugacaagaacacccaccggaugcaucugaauguuugcaagaaacgcaagaugggaagcaacgugaugcuggccgucuguaaaagaaugugcuuccgggccacaauugaggcuuccaauaaggcgcuccugaucagaucuauuaucaacagcaccuucgugauuuguauccuuauccugacgauuugcguggucuccacaagcgccguugauauggagaaccucccugcuggcaucugggaaaaagaggaagaccugaccaauuuuugucaccaggagugccaggugacagaaaccgagugucugugccccuacgaggccauggugcuucgcaagccgcuguuccucgauaacauugccaaggggaugaaaucucugcucaauuccaccagccuggaaacaucucuuuccaucgaggcuccuuggggagccauuaacguccaaagcacguuuaagcccaccguguccgcggcuaauaucgcccugucuuggagcuccguugaacaucggggcaacaaaauccucgugagcgggagaucugaguccauuaugaagcuggaggaacgcacaggagucagcuggaaucugggcguggaggacgccucugaaagcaaaacccuuacaguuuccgugauggaucugucucagauguauagcccugucuucgaguaccucuccggggacagacagguggaagaguggcccaaggcuaccuguacgggcgauugccccgagcgguguggaugcacaucuucuaccugccugcacaaggaauggccucacucccgcaacuggagauguaauccgaccuggugcuggggcguugggacaggauguaccugcuguggccucgacgugaaagacuuuuucacagauuacaugcuggucaaguggaaaguggaguauaucaagacggaagccauugugugcgucgagcuuaccagccaggaacggcaauguucucugaucgaggcggggacacgcuuuaaccucggacccguuaccauuacacuguccgagccuagaaaugugcagcagcggcugcccccugaaaucgugacccuucaucccaaaaucgaggaaggcuucuuugaccugaugcacguccagaagauucucagcgcuuccacggugugcaagcugcaaucuuguacccauggcguuccuggggauuuccagguguaccacgucggaaaccuccugcgcggcgacaaagugaaugggcauagcauccacaagauugagccgcacuuuaacacauccuggaugucuugggauggaugcgaccuugauuauuucuguaauaugggcgacuggcccagcugcaccuacacagggguuacccagcauaacagagccgccuuuaucaacaugcugaauauugaaacagauuauacgaaaaccuuccacuuccauuccaagcgggugacagcucacggagacaccccucaacuggaucucaaagcccgccccgcuuacggcgccggcgaggucaccgugcuggucgagguggcggaccuugaacugcauacaaagaaacucgagguuagcgggcugaagaucgccucucucacgugcuccggauguuaugcuugcagcucuggcauuuccuguaaggugagaauccacgucaacgaaccugaugaguuuaccgugcacguucggagcucugaccccgacguggucgccgcugggagcucccugauggccagaaaaaucgaguucggagccgauucuacauuuaaggcuuucagcuccaugccgaaagacagccuuugcuuuuacauuguggaaaaggauuacuguuccucuugcaccgacgaugacacacagaaaugugugaauaccaagcuggaucauccucagagcauccugauugagcacaagggcacgaucauugggaaacagaacgacacaugcuccaccaagaccucuuguuggcucgaaagcguuaaaggauucuuuuauggccugaagaauaugcuuuccggcaucuucgggaacgucuuucugggaaucuuccucuuucuggcgcccuucgugcuccugauuuucuuuuucuuuuucggcuggcgccuucuguuuugccugaaauguugccggagaacacgcgggcuccugaaguacaagcaucuuaaagaugaggaagaggccggauauaagaaaaucauugagcggcugaauggcaagaaagggaagucucaacucuucgacggagaaagacuggcugaucgcaagaucgccgagcucuuuagcaccaaaauucacaucggcuga

SEQ ID NO: 13549 - RNA, 5094 nt, Artificial Sequence
  derived and/or modified CDS sequence (opt5) from CCHFV(YL16070)__KY354081.1__GP
augcuguuccacuuuaaguucaugcuccugaucaacuuuauucuuugccaucugcucuggggcggggugggagucaccggcgggguugagacaaauagcuccucuacgcaggccauccccaccccuccggugacaagcaacuccaccacacccggaccuucuaccgacacagcuaccgaaacggccagcuccaugaccacaucuacccccgauacacaagugaccacggacaauggcagcggggagccuuccacagauccccugaccacaaacgaagcgaccccuccgcuuagcgucaccacagcucagacgaaagagaccaagaaacacacaacccuggaccccaauacaucugccaacccugaugccaccacgcccuccauuacaauccucagcgcuucuaauaccucccugccuaccagcucugugcaugccucccccagcccguccucuagcgaggaaccuacaccccagaacgcucaccaucuguccagaagccuccugucugccguuuccaccgagacaggacagacggcgagcgccaccacagcuaccaaggaaauuacaaccaaaaauucuccucccacggccggcaacgacaccauggugacaagcgcucccaauggcaacacccggaauacaccugagcaagccaacccgaccgcgcccgaagccucccuuaagauccagacgacacagaaucagcaaaccgucacaccugaggcuacccccaucaccacagugacggcccugaccgaucucacaaaccgcucuaagagagacagcaaaguucagauuauccugaccuucucccaggggcuuaagaaauacuauagcaagauucugaaacuccugcagcugacacaagaggaagauucugagggacuccuggaaugguguacccgggugcuugagcaggcuugcgacgaugacuacuuuaacaagcgcaucgaagaguucuuuauuacgggcaagggguauuucaaugauguccugcaguuuagacuccacgacgcccuguccaacacagagccugcccaaaccaccagccccacagcugugccguucaaaucuuacuaugcgaagggaucccuuaccuuugacagcggcuacuucuccgcccgguguuauccucgcgcuucuaauagcgggcugcagcucaucaacgugacacagcaccccgucaaaauugccaauacgccuggacccaagcuguccaaccugaaaaccaucaauugcaucaaccucaagguuucuacagauaaagaacauagcgagcuggaagugaaugugcuucugccucaggucgccgugaaccucuccaauugucacguuagcauuaagucucaugugugcgacuacucccuggauaccgacggcgcuaucaaacuucccagagucgcccacaacggcguguuuauuccggggacauacaaaaucguuauugauaagaaaaauaaccugaaugaccgguguacccucacgaccaacugcgugaucaagggacgcgaggucagaaaaggccaaagcgcgcugcggcaguauaagacagaaauccgcauugggcagaccgugacaggaucuagacggcugcucgcugagggcggguccagcgauuguaucucucgcacccagcuggucaagacagagguggccgaaauucacgaggacagcuacggaggcccuggcgaaaagaucaccauuugcaacggguccacgaucguugaucaaagacuuggaagcgagcugggcuguuauacaaucaaucgggugaagucuuacaaacucugcgaaaacuccgccagcgggaaguccugcgagauugacucuauccccgucaaauguaagcagggauucugccugaagauuacccaggagggcagagggcaugugaaacugagccgcggcaccgaaaucguucuugaugugugugacuccucuugcgagcucaugauucccaagggaacaggcgacauccuggucgauuguagcgggggacagcaacacuuccugcagaauaaccucauugaccugggcugcccuaaugugccgcuucuggggaaaauggcuaucuaugugugucggauguccaaccaucccaagaccacgauggccuuucucuucugguuuucuuucggauacguuaucacaugcauugucuguagagugcuguuuuaucugcuuaucgcuauuggcaccguggggaaaaagcucaagcaguaccgcgaacugaaaccucagacaugcaucgucugugagagcgugcccguuaaugccauugaugcggagaugcacgaacugaacugcuccuacaauaucugcccuuauugugccagccggcucucuaccgacggccugaucagacaugugacacaaugccccaagcgccgggagaaagucgaagagaccgaacuuuuccugaaccucgagcgcauuccuuggcuggugagaaagcugcuucagguuuccgagagcacgggaauggcucucaaacggucuuguuggaugaucacccugcugauucuccugcuuguguccaugagccccguccagucugccccggugggcaaggaaagagcuaucgagacauaccaagcccgcgaagcguauaccgggauuugccuguuuguucucggauccgugcuguucgccgucagcuggcugacaaaagcucuuaucgauggcaucgggaauagcuuuuucccuggacucagcguguguaagaccugcucuauuggcagcaucaacggguuugagauugaaucccacaaguguuacugcucucuguucuguugccccuauugucgggccugcagcuccgacaaaaauacgcacagaaugcaucugaacgugugcaagaaacggaagaugggcucuaaugucaugcucgcuguuuguaaacgcaugugcuuuagagccacaaucgaggccagcaacaaggcucugcuuauucgguccaucaucaacucuaccuucgugauuuguauccugauucucacaaucugcguggucagcaccuccgcgguggauauggagaaucugccugccggaauuugggaaaaggaggaagaccugaccaacuucugucaccaggagugccagguuacagaaacggagugucuuugccccuacgaggcuauggugcugagaaaaccgcucuuucuggauagcaucgccaagggcaugaaaucucuccucaauuccaccagccuugaaacaucucuguccauugaggccccuuggggagcuaucaacguccagagcaccuucaagcccacaguguccgccgcgaauaucgcucucucuuggagcuccguugaacaucgcgggaacaaaauucuggugagcggccggucugaguccaucaugaagcuggaggaaagaaccggggucagcuggaaucuuggaguggaggacgccucugaaagcaagacgcugacaguuuccgugauggaucucucucaaauguauagcccugucuuugaguaccuguccggcgaccgccagguggaagaguggcccaaagccaccuguaccggggauugccccgagagauguggcugcacaucuagcacaugccuccacaaggaauggccucacucccggaacuggcgcuguaauccgaccuggugcuggggagugggcacgggguguaccugcuguggacuggacgucaaagacuucuuuacagauuacaugcuuguuaaguggaaaguggaguauauuaagaccgaagcuaucgugugcgucgagcugacaagccaggaaagacaguguucucucauugaggccggcacccgguucaaccuggggcccgugacgaucacccuguccgagccucgcaauguucaacagagacuucccccugaaaucgugacacugcaucccaagauugaggaaggauuuuucgaccucaugcacguccagaaaauccugagcgcguccaccgugugcaagcuccagucuuguacacauggcguuccuggcgauuuucaaguguaccacgucgggaaccugcuucggggagacaaagugaauggccauagcauucacaagaucgagccgcacuucaacaccuccuggaugucuugggaugggugcgaccuggauuauuuuuguaauaugggagacuggcccagcugcacauacacgggcgucacccagcauaaccgcgcugccuucauuaacaugcugaauaucgaaacagauuauaccaaaaccuuucacuuccauuccaagagagugacagcccacggggacacgccucagcucgaucugaaagcucggcccgccuacggagcuggcgagguuaccgugcuugucgagguggccgaccuggaacuccauacaaagaagcuggagguuagcggccucaaaaucgcgucucugaccugcuccggguguuaugccugcagcucuggaauuuccuguaaggugcgcauccacgucaacgaaccugaugaguucacagugcacgugagaagcucugaccccgacguugucgcugccggcagcucccuuauggcucggaaaauugaguuuggggccgauucuaccuucaaggccuuuagcuccaugccgaaagacagccugugcuucuacaucguggaaaaggauuacuguuccucuugcacggacgaugacacacaaaagugugugaauaccaaacuggaucauccucagagcauucucaucgagcacaagggaaccauuaucggcaaacagaacgacacaugcuccaccaagacaucuuguuggcugaaauccuuuaagggguucuuuuauggacuuaagaauaugcuguccggcaucuucggcaacgucuuucucgggauucugcuguuccuggcucccuuugugcuucugaucuucuucuuuuucuuuggauggagacuccuguucugccugaaauguugcaagaaaaccaagggccuucugaaauacaagcaucucaaggauaaagaagaggcgggguauaagaaaauuaucgaacgccugaauggaaagaaaggcaagucucagcucuuugacggggagcggcuggccaacagaaagauugcugagcuuuucagcacgaaaauccacaucggauga

SEQ ID NO: 13550 - RNA, 5094 nt, Artificial Sequence
  derived and/or modified CDS sequence (opt5) from CCHFV(YL04057)__FJ562094.1__GP
augcuguuccacuuuaaguucaugcuccugaucaacuuuauucuuugccaucugcucuggggcgggggaggcgugaccgggggagucgagacaaauagcuccucuacgcaggccauccccaccccuccgguuacaagcaacuccaccacacccggcccuucuaccgacacagcuaccgaaacggccagcuccaugaccacaucuacccccgauacacaagugaccacggacaaugggagcggagagccuuccacagaucccccuaccacaaacgaaaccaccccgcccccuagcgcgacaacggcucagaccacagagaccaaaaagcacacaacccuggaccccaauacgucuacaaacccugaugccauuacccccuccaucaccauucuuagcgccucuaauacaucccugccgaucagcucugugcaugcuuccccuagccccuccucuagcgaggagccuacaccccagaacgcccaccaucucuccagaagccugcugucugcugucuccaccgagacgggccagaucgccagcgcgaccacagccgcuaaagaaauuaccacaaagaacucucccccuaccgccggcaaugacacgaugaucaccagcgcuccgaaugggaacacacggaauacccccgagcaagccaacccuacagcgcccgaagccuccccuaaaauucagaccacgcagaaucagcaaacagugauccccgaggcuaccccgauuacaaccaucaccgcccucacagaucugacgaaccgcucuaagagagacagcaagguucagauuauccuuaccuucucccagggacugaaaaaguacuauagcaaaauccucaagcugcuucagcugacacaagaggaagauucugagggccuccuggaaugguguacccgggugcuggagcaggcuugcgacgaugacuacuuuaacaaacgcauugaagaguucuuuaucacagggaagggauauuucaaugauguccuccaguuuagacugcacgacgcccuuuccaacaccgagccugcccaaacgacaagccccaccgcugugccuuucaagucuuacuaugcgaaaggcucccugaccuuugacagcggguacuucuccgcccgguguuauccccgcgcuucuaauagcggacuccagcugauuaacguuacacagcacccugugaagaucgccaauacccccggcccgaaacuuuccaaccugaagacaauuaauugcaucaaccucaaagucucuacggauaaggaacauagcgagcuggaagugaaugugcugcucccucaggucgccguuaaccuguccaauugucacgugagcaucaaaucucaugugugcgacuacucccuugauaccgacggcgcuauuaagcugcccagaaucgcccacaacggggucuuuauucccggaacauacaagaucgugauugauaaaaagaauaaccucaaugaccgguguacccugacaaccaacugcguuaucaaaggccgcgaggugagaaaggggcaaagcgcgcuucggcaguauaaaacggaaauccgcauuggacagaccuucacaggcucuagacggcugcucgcugaagggggauccagcgauuguaucucucgcacccagcuggucaagacagagguggccgaaauucacgaggacagcuacggcggcccuggggaaaagaucaccauuugcaacggauccacaaucguugaucaaagacugggccgggagcucggguguuauaccauuaauagagugcgcagcuacaaacugugcgaaaacucugccuccggaaagagcugcgagaucgacuccaucccggucaaauguaagcagggcuucugccuuaaaauuacgcaggaggggcggggccaugugaagcugucuagaggaacagaaaucguccucgaugugugugacagcuccugcgagcugaugauucccaagggcaccggggacauccugguugauuguucuggaggccagcaacacuuucuucagaauaaccucauugaccuggggugcccuaaugugccccugcucggaaaaauggcuaucuaugucugucgcaugagcaaccauccuaagaccacaauggccuuccuguuuugguucuccuuuggcuacgugauuaccugcaucgcuugucggguucuuuucuaucugcucaucgccauugggacggugggcaaaaagcugaaacaguacagagaacugaagccccagacaugcaucgucugugagucugugccugugaaugcgauugaugccgagaugcacgaacuuaacugcagcuacaauaucugccccuauugugcuucccgccucagcaccgacggacugauccggcauguuacacaaugcccgaagagacgcgagaaagucgaagagaccgaacuguuucucaaccuggagcggauuccuuggcuugugagaaagcugcuccaggugucugaguccacaggcauggcccugaaacgcagcuguuggaugaucacccugcuuauucuccugcuggucucuaucucccccgugcagagcgcuccuguugggaaggaacgggccauugagacguaccaagcgagagaaaccuauacaggaaucugccucuucgugcugggcucuguccuuuuugccguguccuggcugaccaaagcucucaucgaugggauuggaaauagcuucuuucccggccuguccguuuguaagacaugcagcaucgggucuauuaacggcuucgagaucgaaagccacaaauguuacugcucccuguuuuguugcccguauugucgggccugcucuagcgacaagaauacccaccgcaugcaucuuaacgugugcaagaaaagaaagaugggauccaaugucaugcucgcuguguguaaacggaugugcuucagagccacgauugaggccucuaacaaggcucugcugauccgcagcauuaucaacuccacauucguuaucuguauucucauccugaccauuugcguggucucuacaagcgcgguggauauggagaaucuuccugccggcaucugggaaaaagaggaagaccugaccaacuuuugucaccaggagugccaggugaccgaaacagagugucucugccccuacgaggcuaugguccugcggaagccucuguuccuugauuccauugccaaggggaaaaagagccugcucaauucuacgucccuggaaaccagccucucuaucgaggcccccuggggagcuaucaacguucaguccacauuuaaacccaccgugagcgccgcgaauauugcucuguccuggucuagcguggaacauagaggcaacaagauccuugucuccgggcgcagcgagucuauuaugaaacuggaggaaagaacaggaguguccuggaaucucggcguugaggacgccagcgaaucuaagacccugacggugagcgucauggaucugucccaaauguauucuccuguguucgaguaccuuagcggggaccggcagguugaagaguggccgaaggccacauguaccggcgauugccccgagcgcuguggaugcaccuccucuacaugccugcacaaagaauggccucacagcagaaacuggcgguguucccccaccuggugcuggggcguggggacaggauguacgugcuguggccucgacgucaaggacuuuuucaccgauuacaugcuggugaaauggaagguugaguauaucaaaacagaagcuauugugugcgucgagcucaccagccaggaacgccaguguucucugaucgaggccgggacaagauuuaaucuuggaccugugaccaucacgcuguccgagccccggaacgugcaacagcgccucccuccggaaauugucacccugcaucccaagaucgaggaaggcuucuuugaccugaugcacguucagaagauucuuagcgcguccacagugugcaaacugcagucuuguacccauggcgugccuggggauuuccaagucuaccacgugggaaaucuccugagaggcgacaagguuaacgggcauagcauccacaaaauugagccccacuuuaauacauccuggaugucuugggauggaugcgaccucgauuauuucuguaacaugggcgacuggccuagcugcaccuacacaggggugacgcagcauaaucgggcugccuuuaucaacaugcugaacauugaaaccgauuauacaaagaccuuccacuuccauuccaaacgcgucaccgcccacggagacacaccccagcuugaucugaaggcuagaccggccuacggcgcuggcgaggugacgguucugguggaggucgccgaccucgaacugcauaccaaaaagcuggaggugagcgggcuuaagaucgcgucucucacaugcuccggauguuaugccugcagcucuggcaucuccuguaaaguccggauucacgugaaugaaccugaugaguuuaccguucacgugagaagcucugaccccgacgucguggcugccgggagcucccugauggcucgcaagaucgaguucggagccgauucuacauuuaaagccuucagcuccaugcccaaggacagccucugcuuuuacauuguugaaaaagauuacuguuccucuugcaccgacgaugacacgcaaaagugugugaacacaaagcuggaucauccucagagcauccuuauugagcacaaaggcaccaucaucgggaagcagaaugauaccugcuccacaaaaaccucuuguuggcuggaaagcgucaagggauucuuuuauggccugaaaaacaugcucuccggcauuuucgggaauguguuucugggaauccuucuguuccucgcucccuuugugcugcucauuuucuucuuuuucuuuggcuggcggcugcuuuucugccugaaguguugcagacgcacacgggggcugcucaaguacaaacaucugaaggacgaggaagaggcgggauauaaaaagaucauugagagacuuaacggcaaaaaggggaagucucagcuguuugacggagaacgccucgccgaucggaaaaucgcugagcuguucagcaccaagauccacauuggcuga

SEQ ID NO: 13551 - RNA, 5094 nt, Artificial Sequence
  derived and/or modified CDS sequence (opt5) from CCHFV(79121M18)__GU477493.1__GP
augcuguuccacuuuaaguucaugcuccucaucaacuuuauucuuugccaucugcucuggggcgggggaggcgugaccgggggaguggagaccaauagcagcucuacgcaggccauccaaacacccccuguuacaagcaacagcaccaccccgggccccucuaccgacacagcuaccgaaacggccagcuccaugaccacaucuaccccugacacacaggugaccacggacaaugggagcggagagcccuccacagauccucugaccacaaacgaagcgacacccccucuuagcgugaccacagcucagacgaccgagaccaagaaacacaccacacuggacccgucuaccuccacgaaucccgaugccacaaccccuagcauuaccauccucucugccuccaacacaagccugcccauuucuuccguccaugcuagcccuucccccucuagcuccgaggaaccgaccccucagaaugcccaccaucugagcagaucucuccuguccgcugugagcacagagacgggccaaaucgccucugcggccaccgcugccaaagaaaucacaaccaagaacucucccccuacagcuggcaaugacaccaugguuacguccgcccccaacgggaauauucggaacacccccgagcaggcgaauccuacagccccggaggcuucccccaaaauccagaccacacagaaccaacagaccgugacgccugaggccacacccauuaccacaaucaccgcucuuaccgaucugacaaaucgcagcaagagagacuccaagguccagaaaauucucacguucagccagggacugaagaaauacuauucuaagauccuuaaacugcuccaacugacccaggaggaagauuccgagggccugcucgaaugguguacacgggugcuggagcaggccugcgacgaugacuacuuuaacaagcgcauugaagaguucuuuaucaccgggaagggauauuucaacgauguucuucaauuuagacugcacgacgcccucagcaauacagagccugcucagaccacgucucccacagcggugccguucaaauccuacuaugccaagggcagccugaccuuugacuccggguacuucucugcucgguguuauccucgcgccagcaacuccggacuucagcugaucaaugucacccagcaccccgugaaaauugccaacacaccuggccccaagcucucuaaucugaaaaccaucaacugcauuaaucugaaggugagcacagauaaagaacauuccgagcucgaagucaacguucugcuuccucaaguggcugugaaucugagcaacugucacgucucuaucaagucccaugugugcgacuacagccucgauacggacggcgccauuaagcugcccagaguugcgcacaaugggguguuuaucccgggaaccuacaaaaucgucauugauaagaaaaacaaucuuaacgaccgguguacacugaucaccaauugcgugauuaagggccgcgagguuagaaaagggcagucugcucuccggcaguauaagacagaaauccgcauuggacagaccuucacgggcuccagacggcugcuggccgaaggcgggagcucugauuguaucagccgcacccaacucgugaagacagaggucgccgaaauccacgaggacuccuacgggggcccuggggagaaaaucaccaucugcaacggaagcacaauuguggaucagggccuggggucugagcuuggauguuauaccaucaacagaguccgguccuacaagcugugcgaaaauagcgcuuccggcaaaucuugcgagauugacagcauccccgugaaguguaaacagggguucugccucaagauuacacaggagggcagaggacauguuaagcugucccgcggcaccgaaaucgugcuggaugucugugacucuagcugcgagcuuaugauccccaaagggacgggagacauucucguggauuguuccggcgggcaacagcacuuucugcagaacaaucugaucgaccucggaugcccuaacguuccgcugcuuggcaagauggccauuuaugugugucggaugucuaaucaucccaaaacaaccauggcuuuccuguuuugguucagcuuuggguacgucauuaccugcauugccuguagaguccucuucuaucugcugaucgcgaucggcacagugggaaagaaacuuaagcaguaccgcgaacucaagccucaaaccugcauuguuugugaguccguccccgugaacgccaucgaugcugagaugcacgaacugaauugcagcuacaacauuugcccuuauugugccucucggcuguccacggacggccucaucagacaugugacacagugccccaaacgccgggagaaggucgaagagaccgaacuguuucuuaaucuggagcggauuccuuggcucgugcgcaaacugcugcagguuagcgagucuacagggauggcucuuaagcgguccuguuggaugaucacccuccugauccugcuccuggugagcauuucucccguccaauccgccccggugggaaaagaaagagcgaucgagacauaccaggcccgcgaaaccuauacgggcauuugccuuuucguucuggggagcgugcucuuugcugucuccuggcugaccaaggcccugaucgauggaauuggcaacagcuucucuccugggcuuagcguguguaaaacaugcuccaucggcucuaucaauggauuugagauugaaagccacaaguguuacugcucccucuucuguugccccuauugucgggcuugcucuagcgacaagaacacccacagaaugcaucugaauguuugcaaaaagcggaaaaugggcuccaacgugaugcuggccgucuguaagcgcaugugcuuuagagccacaaucgaggcuucuaauaaagcgcuccugauucggagcaucauuaacuccaccuucgugaucuguauucuuauccugacgaucugcguggucagcacaucugccguugauauggagaaccucccugcugggauuugggaaaaggaggaagaccugaccaauuucugucaccaggagugccaggugacagaaaccgagugucugugccccuacgaggccauggugcuuagaaagccgcuguuucucgauuccaccgccaaaggaaugaaaagccugcucaacucuacaucccuggaaacgagccuuuccaucgaggcuccuuggggcgccauuaauguccaaucuaccuucaaacccacagugagcgcggcuaacaucgcccuguccuggagcucuguugaacaucgcgggaauaagauucucguguccggacggagcgagucuaucaugaaacuggaggaaagaaccggcgucagcuggaaccuggggguggaggacgccuccgaaucuaagacacuuaccguuagcgugauggaucugucccagauguauucuccugucuuugaguaccucagcggcgaccgccagguggaagaguggcccaaggcuacguguacaggagauugccccgagagauguggcugcaccuccucuaccugccugcacaaagaauggccucacucccggaauuggcgcuguaacccgacauggugcuggggaguuggaaccggcuguacaugcugugggcucgacgugaaggacuucuuuacggauuacaugcuggucaaauggaagguggaguauaucaaaaccgaagccauugugugcgucgagcuuacaucccaggaaagacaauguagccugaucgaggcgggaacccgguucaaucucggccccguuacaauuacccuguccgagccucgcaacgugcagcagagacugcccccugaaaucgugacgcuucaucccaagauugaggaaggcuuuuucgaccugaugcacguccagaagauccucucugcuagcaccgugugcaaacugcaauccuguacacaugggguuccuggagauuuucagaucuaccacgugggcaaucuccugagaggggacaaggucaacggacauucuauucacaaaaucgagccgcacuucaauaccagcuggauguccugggauggcugcgaccuugauuauuuuuguaacaugggggacuggcccagcugcacauacaccggagugacacagcauaaucgcgccgccuucauuaacaugcugaacaucgaaacggauuauaccaagacauuucacuuccauucuaaaagaguuaccgcucacggcgacaccccucaacuggaucucaaggcccggcccgcuuacggcgccggggaggugacaguccugguggaggucgcggaccuugaacugcauacgaaaaagcucgagguguccggacugaagauugccagccugaccugcucuggcuguuaugcuugcuccagcgggaucucuuguaaaguucgcauucacgugaaugaaccugaugaguucacaguccacgugagaagcuccgaccccgacguuguggccgcuggaucuagccugauggcccggaagaucgaguuuggcgccgauuccaccuucaaggcuuuuagcuccaugccgaaggacucucuuugcuucuacaucgucgaaaaagauuacuguagcuccugcacagacgaugacacccagaagugugugaacacgaagcuggaucauccucagucuauucugaucgagcacaaagggacaauuaucggaaagcagaaugauaccugcagcaccaaaacauccuguuggcucgaaucugugaagggcuuuuucuauggccugaaaaacaugcuuagcgggauuuuuggaaauguuuuccugggcaucuuucucuuccuggcgcccuuuguccuccugaucuucuucuuuuucuuuggguggagacuucuguucugccugaaguguugccgccggaccagaggacuccugaaguacaaacaucuuaaggaugaggaagaggccggcuauaaaaagauuaucgagcgccugaacgggaaaaagggaaagucccaacucuuugacggcgaacggcuggcugauagaaaaauugccgaacucuucagcacaaagauccacauuggcuga

SEQ ID NO: 13552 - RNA, 5088 nt, Artificial Sequence
  derived and/or modified CDS sequence (opt5) from CCHFV(ArD39554)__DQ211628.1__GP
augcugugccacaucaagcauauucuccuguucuguaucauucuuuaccaccagcaauggaacaccggcgccagcaauacaacgaucucccccaccacaaacaaaucucauaccgacauuagccaccagccuacauccaucaccgcugccucuagcccggggucccccgcgacaaccgcuccucccgagagaucugugacgccuagccauacccccacaaccuccgucagcgaagccggaucuggcgagccuccggccgcuacacccgccuccgcuaccgcccagagcccugaacccgcgucugccgcucagccuucccccacgaucccgaagccuacaacccccgauccuacaagcgaggcccugucuacccccgcuaccucccggccccaagaaccuagcacacacccguccccucgcucuagccccuccaaacccguugagacgcagagcaccagacacacagcccgggagcuccugucugugaccgggacagaagcggagcagcuuauuacccagacgauccauacaaccaaggaagccaccaaagcuacauccccucaacccaccgccagcaauccggacccuacacuggcuacgaccucucgcagcauuaacuccaucaaucccaagggaccugagucuacaagagccacaccccagagcaccuccccuacccccgagagcucuacgauucagacccagauccucccgauuaucacaaccccuggcacacuggaagccaucauucaccccaccaaccgguccaagcgcaaucuggggacggagaucauucucacacugccccaaggacuuaaaaaguauuacagcaaagugcugaagcucaugcaucugaccagagaagaggauucugaaggccuucuggaguggugcacacggauccucggccagaccugugacgaugacuauuuucagaaacgcauuaccgaguucuuuaucacaggggucggauacuucaacgaagugcugcuguuuaaggagacgaccgaugcuccuacacucgcgccgacccacaagggcgcucccccuacagaacccuucaaauccuauuacgccaagggguuuaucaccauggacagcggauauuucuccgccaaaugcuacucuagagccagcaauuccggccugcaacuuauuaacguuacgaugcacucuagcaagaugccuaucacacccgggccuaaauacuccaaucugaagaacauuaauuguaucaaccucaaagugagcaccgauaaggagcauaaugaagucgagauuaacgugcugcuuccccagguugcugugaaccugucuuccugccacguccucgugcggagccaugugugugacuauucucuggaugccgacggaaugaucaagcugccgcagaucacccacgagggcacauuuauuccuggcaccuacaaaaucauuaucgauaagaaaaauaagcagaacgaccgcugcacacucauuacgaauugugucaucaaagggagagaaguucggaagggacaauccgcgcugcgccaguauaagaccgagauuagagugggccaggcuagcucugggacacggagacuucugagcgaauccaacaauaacgacugcgugagccgcacccagcucaucaaaacagagaaugccgaaauccauggagaugacuacggcgggcccggagagaagauuaccaucuguaacggcucuacgauugucgagcaacggcugggcuccgaacuugggugcuauaccaucaauagaauuaagagcuucaagcugugcgagaacuccgccucuggaaaaggcugugaaaucgauagcacaccugugaagugcaagcagggguuuugucucaaaaucacccaggagggacgcggccacguuaagcugucccgggggucugagauuauccuggacgugugcgauagcuccugugaaaugaugauucccaaaggcucuggagacauccucgucgauugcagcggcgggcagcaacacuuccugcaggacaaucuuguggaucugggauguccgaacguuccucuccugggcaagauggcuauuuacaucugcagaauguccaaucaucccaaaacaaccauggccuuucuguucugguucagcuuuggguaugugaucacauguauuuucugcaaggucaucuuuuacgugcuuauuaucauuggaacccucggcaagcgcaucaaacaguaccgggagcugaagccucagacguguacaaucugcgaagcuacccccgucaacgccauugacgcggagaugcacgaucugaauugcucuuauaacaucugucccuacugcgccuccagacucaccagcgaagggcuggugcgccauguuacacaauguccuaaacggaaggagaaaauugaggaaaccgagcuuuaucugaaccucgaaagaaucccgugguucgugcgcaagcugcugcaggucucugaguccacgggcguggcucuuaaacggagcucuuggcucguuacacugcuggugcuccugaccgucucccuuagccccgugcaguccgccccuauuggacaagaaagaacagugguuaccuaccagguccgggagagcuauacaggcaugugccuguuuauccucgggucugugcuguucgcuauuagcuggcugaccaagggacuuguggacuccgucggcaauaucuuuuuccccgggcucucuguguguaagacgugcagcaucggauccauuaacggcuuugagaucgaaucucacaaauguuacugcagccuguucuguugcccuuauugucgcuacugcuccgccgacagaggggcgcaccagucucaucugagcguuugcaagaaacggaagaccggcuccaaugugaugcucgccgucuguaaaagaaugugcuuucgcgcuacacugaaggugagcucugaggcccuuauuauccgguccauuaucaacaccacauucguuguguguauccugauucucgucgugugcguugugagcaccucugcugucgaaauggagaaucugcccgccggaacgugggaaaaggaggaggaucugacaaacuuuugucaccaggaaugccaagugaccgagacagaaugucuuugcccuuacgaggccuucgugcucagaaaaccgcuguuccuggacuccaccgcuaagagcaugaaaucccuccugaauagcaccagccuugagacaucccugagcaucgaagcgcccuggggcgccauuaacguccagucuacguuuaagccuaccgcuuccacagccaauaucgcccucagcuggucuagcguugagcaucgcgggaacaaaauucuggugaccggaagauccgaaucuaucaugaagcuggaggaacggacaggcaucagcuggaaucuugggguggaggaugcuuccgagucuaagacccugacggucagcgugauggaccucucccagauguauagcacaguuuucgaauaccugucuggagaucgccagguggaggaauggcccaaagccaccuguaccggcgacugcccugagagaugugggugcacauccucuaccugccuccacaaggcguggccccauucccggaacuggcgcuguaauccgacauggugcuggggcgucggaacgggcuguaccugcugugggcuggaugugaaaaaccuuuuuacagacuauaugcugauuaaguggaaaguugaguucaucaagaccgaggcuauugugugcgucgagcucacaucucaagaaagacaguguagccugaucgaggccggaacccgguuuaaucugggcccugugacgauuacccuuuccgaaccccgcaacauccagcagaagcugcccccugagcucguuacacugcaccccagaguggaagagggguucuuugaucucaugcacguccaaaaagugcugucugccagcaccgugugcaaacuucaguccuguacacauggagucccuggcgaccugcagguuuaccacgugggcaaccuccugaaaggggauaagauuaauggaaacagcuuccauaaaaucgagccgaaucugaacaccucuuggauguccugggacggcugcgaucuugacuauuacuguaauaugggggacuggcccagcugcacauauacgggagugacccaacacaaccaugcugccuuugucaaucugcucaacaucgaaacagauuacaccaagaauuuccacuuucacucuaaacgggugaccgcgcauggcgagacaccucagcuggaccucaaggcucgccccaaguacggggccggagaaguuacggugcuggucgagguggccgauauggagcuucacaccaaaaagauugaaaucuccggccugaaauucgcuagccugacaugcaccggcuguuaugccugcucuagcgggauuuccuguaagguuagacuccauguggacgagccugaugaacugacaguccacgugaaaucugacgaucccgacgucguggcugccagcuccagccuuauggcgcggaagaucgaguuuggaaccgauuccacguucaaggccuucucuagcaugccgaaagacaagcugugcuuuuacauuguugaaagagauuauuguuccucuugcagcaaagaggacacacagaagugugugaacgcuaaacucgagcagccucaauccauccugaucgaacacaagggcaccauuaucgggaagcagaaugauaccugcacagucaaagccucuuguuggcucgagagcgugaaguccuucuuuuacggacugaaaaacaugcuuggcgggauuuucggaaauguuauccugggcauuaucauguuucuggcucccuucgcccuccugcuucuguuuuuccucuuuggcuggcgcauccuguucugccuccgguguugcagacgcacccgggggcuguuuaaguauaaacauauuaaggacgacgaagagagcggauacaagagaaucauugaacgccuuaacaauaaaaagggcaaaaacaagcuguucgauggggagcggcuggccgacaaaaagaucgcugaacucuucucuacaaagacccacauuggauga

SEQ ID NO: 13553 - RNA, 5088 nt, Artificial Sequence
  derived and/or modified CDS sequence (opt5) from CCHFV(AP92)__DQ211625.1__GP
augcccgaccacuucauccugcuccugcuuauguacaccguguuucaucagcacccucaagaugucagcgccaacguucaucuggugaauccguccaacucuacaacgggcgcuagcaccgccuucaaucccgugcacaacgcgacaaccgacgggcagaagcaguccacaucuaccacaaccauggcuagaccuagcacggucacccagauuacaaccgcccaagccauggagguggauggauccggcgaaucuacaacccuccccgcuguuacgccuacacccgccgagaccacaacccaugcuaaucagaaaagcgccuccaccauggggacacugacgaccagccuugaagacacagcgcugaugacccucacaggacggucuauccugaccucccagagccagacgggcucuuuugaucgcacauccaagccucaaaccccgagaagcaccaaccagccccugcggaaacuccugucugccguguccacagaggcugccccucagaccagccccacagcugucacggccgaccagaccgaagcguccacaucuccucaagugaccacagauaccagccccuccacgccgacccagguuacaagcucugccggguccagcucuagcaauaccuccaaccacucuaagacaaccccucagcuuacgagcuccggaagcgaggcucaacagacacagcccaccacaaugccuaauaccaccgcccuggugacacccacggcucacauuucucccaccaaccgcuccaaaagaaauagcgaggucgaaaucauucucacacugccucagggccuuaagaaguauuacucuaaaauccugaagcuccugcaucugacccucgaggaagacuccgagggccugcuugaguggugcacacggacccugaaacaagccugugaugacggguauuuccaggaacgcaucaaggaguuuuuccucacgggagaaggcuacuuuaacgaggugcugcuuuucagaagcccgucccagcuggggacaaccggaucuccccucgccagcccucccaccgcugaaccuuuuaaauccuucuaugcgaagggcuuucugauuauggauucuggguacuucagcgccaagugcuaucccaaagcuagcaauagcggacugcagcucaucaacauuacacaacacucuaucaagguggucaauaccccgggcccuaaauacuccaaccugaagacaguuaacuguauuaaucuuaaagugagcacggacaaggaucauucugagcuggaggugaacguccuccugccccagguggccguuaauaucuccaacugccacgugcuuauuaaaagccacgucugugacuacucucuggacaccgauggcaugauccggcucccucaggugacacaugaagggaccuuuauccccggaacauauaagauuguuaucgacaagaaaaauaagcugaacgaucgcugcaccaugacgaccaauugugugauuaaaggcaaggaggucagaaaagggcagagcacacugcggcaauaccgcaccgaaaucagagugggacagauguccagcggcacacggcgccuccugucugaagggggagacggcggcugcauuuccagaacccagcuuaucaagacagaaaccgccgagguccacggggaugacuauggaggcccuggggagaagaucacgauuuguaacggaagcacaaucguggaucagcggcugggcuccgaacucgggugcuacaccauuaauagaaucaaaucuuucaagcugugugagaacagcgcucaaggcaaaaauugcgaaauugacuccgcccccguucagugccgccagggauauugucugaagaucucucaagagggccgggggcaugugaaacuuagcagaggauccgaaaucguccucgaugugugcgacaccucuugugagauuaugaucccgaagggcacaggggauauucugguugacugcagcggaggccagcagcacuuccugcaguccaaccucguggaccugggguguccuaauaucccccuucugggcaagauggcgauuuacaucugccgcaugagcaaccaucccaaaaccacgauggcuuuucucuucugguuuucuuucggauaugucauuacauguauccugugcaagacccuguuuuacauccuuauuaucauuggcacacucgggaaaaagcugaaacaauaccgggagcugaagccucagaccuguacaaucugcgaauccgugccggugaaugccauugaugccgagaugcacgaccucaacuguagcuauaacaucugccccuacugcgcuucuagacugaccuccgaaggacuuacgcgccacguuaaucaguguccuaagcggaaagagaaggucgaggaaaccgagcuguaucucaaccuggaaagaauccccuggauugugcgcaaacugcuucaggugagcgagucuacaggcgucgcccucaagcgguccagcuggaugaucgugcugcugauucuccugaucguuuccaugagcccugugcaaucugcucccauuagccaggaaagaaccgucgcccuuuaccagucccgcgaggauuauauggggaucugccuggugaucaugggaucuguucuccuggcggugagccugcuuguccggggccucauugacuccaucucuagcacauucuuuccugggcuguccguguguagaaccugccauauuggcucuaucaauggauucgagauugaaagccacaaauguuacugcggccugcucuguugccccuauugucgggccugcuccacggaucaggacgcucaucaauuucaccugagcguuuguaagaaacgcaaggccgggucuaacgugaugcuugcugucugcaagagaaugugcuucaaagccaucaucgaggcguccaauaaggugcuguuuauucggaacgugaucaauacaaccuucgucguuuguauucucgugaugguggccugcaucgcuagcucugccgcugucgaaauggagaaccugccggccggaacaugggaaagagaggaggaacugaccaauuuuugucaccaggagugccaggugaccgaaacagagugucuuugcccuuacgaauccuucauucugcgcaaaccccucuuccuggauagcaucgccaagggcguuaaaaaccuccuuaauuccacgucucuugagaccagccuguccauugaggcuccuuggggagcgaucaacgcccaaagcacauacaagcccaccgcuucuuccgccaauaucgcccucacauggagcucuguggaacaucgggggaacaagauucuggucagcggcagauccgagucuaucaugaaacuggaggagcgcaccgggauuagcuggaaucuuggcguggaggacgcuuccgaaucuagaacgcugacaaucagcguuauggaucucucccagauguauagcccgguguuugaguaccugucuggagaccggcaggucgaagaguggccuaaggccaccuguaccggcaacugccccgaacgcugugggugcacauccagcaccugucucuauaaagaguggccucacuccagaaacuggcggugcaaucccacauggugcuggggagugggcacgggguguaccugcuguggacuggauguuaaggagcuuuucacagaccauaugcuggugaaauggaaggucgaauacauuaagaccgaggcgaucgugugcguggaacucacaucucaggagcgccaauguagccugaucgaagcuggcaccagauuuucccugggccccgucacgauuacccuuucugagccucggaacauccagcagaaacugccgcccgagcucauuacacugcacccuaagaucgaagauggguauuucgaccucaugcauguucagaaagugaugagcgccuccaccgugugcaagcugcaaagcuguacacacggaguccccggcgaccuucagauuuaccacguggggaaucugcugaaaggagaucgcguuaacggccaucucauccacaagguggagccucaucugaauaccucuuggauguccugggacgggugcgaucuugacuauuuuuguaacaugggagauuggcccagcugcacauacacgggcgucacccagcacaaucaugccgcuuucgccaaccugcucaauaucgaaacagacuacaccaagaccuuucacuuccacucuaaaagagugacagcgcauggcgauacgccucagcuggaccucaaggcucggccgcgcuauggggccggagagauuaccguucugguggaagucgccgauauggagcuucacaccaaaaagguggaggucacaggccugaaauuugcuucccugacauguagcgggugcuacgccugcucuagcggaaucuccuguaaggugcggauucauguugacgaacccgaugagcucaccgugcacgucaaaucuagcgacccugauaucguggcugccuccagcucccugauggcgagaaagauugaguucggcguugacucuacguuuaaggccuucagcuccaugcccaaagacucucuuugcuuuuauaucguggaaagagauuacuguaacagcugcaagaaugaggaaacacaacgcugugucaacgcuaaacuggagcagccucaguccauucucaucgaacacaccgggaccaucauuggaaagcagaaugacacaugcggcucucggaccagcuguuggcuggauuccuucaaauccuucuuuuauggccucaagucuaugcuguccgggaucuucggaaacguguuucuuggcauuuuccuguuucuggcccccuucgcucuccugcuguuuuucuuuuucuuuggguggagaauccuguucugcuucaaguguugccgccggacaagaggacucuuuaaauaccgccauauuaaggacgaugaggaagugggcuauaaaaagaucaucgagcggcugaauaacaaaaaggggaagcacagacuccuggacggagagcgccuugccgaucggaaaauugccgaacuguucagcaccaagacgcauaucggcuga

SEQ ID NO: 13554 - RNA, 5085 nt, Artificial Sequence
  derived and/or modified CDS sequence (opt5) from CCHFV(UCCR4413)__KY484038.1__GP
augcugagauacauccucuaugcccugcuugcuagcgccauucugcaccagcaucucuacaaggugggcgcggacacccaaaaacccacaguccggacgaacaccacacacaagaucuccccuaccgcuacagccaaucgcaccacauaugagcaggccaccccgucuacgacccccaaaagcuccacaaagccuaccacacauauugcuaccgcccaccuggcugaaucugaugggagcggagagacgacacuucugcuccccaccacagccucccaguacaccaccgaaggccagacaucucuggagccuacggcggaagagaccgggagcaacacaauccccuccgacaccacaagcaccucuccuauuacggaaaauuccgaaagcacagauacccaaaugaacguuucugacuccucuucuuccccgcuggccacccagggagcuagaagccccgcccggaaucuccuguccgugccuucuguggagcccggccagcagacaaccccuaaacaacccacaacgaaggggaccgucacaccgaccacaccucagcccaccacgagcuccccuacccccgcucccacaagcgccacccuuucuacaaacuccagcucuaucagcaccccugugcagacguccucuccgcugcagcccauggcgccuagccaugaaacacaacacgcccucuauaccacauccaccgagagcacccugcgcacacuuucugcugagagaauccaccccacgaaucggucccgcagaaacagcgaaguugagauuauccugacccucccucagggacugaagaaauacuauucucggcugcucaagcugcuucaucugacaauggaagaggauaccgaaggccuccaggaguggugcgugcgcguccugggccaaacaugugacgauuccuacuuccacaaaagacuugccgaguuuuucauuaccgggacgggauuuuucaaugaagugcugcucuuucggagccccuccacaccgaccaccaucaagccuucucccacaggcagcccuaccguugagcccuuccgcuccuacuaugcuaaagggucucugacaauugacagcggauacuuuuccgccaagugcuauccuagaacgagcaacucuggccugcagcucaucaaucugacccagcauuccguggaaauugccaacacacccgggccgaagcacagcucucuuaaaaccaucaauuguaucaacauuaaggcuuccacagauaaagagcacaaugaagucgagaucaacgugcugcucccucagguggcgauuaaccugagcaauugccaugucucuauccggagccacguuugugacuacucccuugauaccgacggaaagauucgccugccccaaaucagccaugagggcacguucauccccggcaccuauaaaauuaucauugauaagaaaaacaagcucaaugacagaugcucucugaucacauccugugugauuaaggggcgggaacugagaaaaggacagagcacccuccgccaguacaagacagagaucaaaaucggccagaccuccucugggagccggagacugcuuuccgaaucuagcgccuccggaugcauuucucgcacacaaaugaucaagagcgagaccgcugaaauucacgacgauaucuauggcgggccuggagagaaacugacgauuuguaacggcacaaccguggucgaccagcggcucggcuccgagcuggggugcuacaccaucaauagaauuaagacauacaagcugugugaaaacagcgugaaagagaagaccugcgaaaucgauucuguuccggugaaaugccgccagggacuuugucucaagaucacgcaggagggccgggggcaugucaaacuguccagaggaagcgagauugugcuggacaucugcgauucuuccugugaacucaugauucccaagggcacaggggacauccugguugauugcagcggcggacaacagcacuuucuucaggacaaucugguggaucucggcuguccuaacauuccccugcuggggaaggucgccaucuauaucugccgcaugucuaaucacccuaaaaccacaauggccuuccuuuucugguucuccuuuggauacgugauuaccuguauccucugcaagauucuguucuaucugcucaucauuacaggcacccuggggaaaaagcugaaacaguaccgggagcuuaagccccaaacguguaccaucugcgaaagcacaccugucaacgcuaucgacgccgagaugcaugaucucaauuguuccuauaacauuugccccuacugcgcgagcagacugaccucugacggacugauccgccacgugaaucuuuguccgaagcggaaagaaaagguugaggagacagaacucuaucugaaccuggagcgcauuccuugguucgugcggaaacuccugcaggucagcgaauccaccggcguggcucuuaagcgcucuagcuggcugcucauccugguuauucugcuuacgguguccaugucucccguccagagcgccccuaucaaucaacagagagccguggaggcuuaccaggcccgggaaggguacacaggcaucugccucuuuauucugggauccgugcuguucaugaccucuuggcucacaaaaggccugaucgacagcauuggggauuccuuuuuccccggacuuuuuguuuguaagaccugcagcaucggcucuauuaacggguucgagaucgagucccauagauguuauugcagccugcucuguugcccguacuguagaaccugcucugcugacaaagauucccaccagcugcaccugagcauuuguaagaagaaaaaggccggauccaacgucaugcuugcggugugcaaacggaugugcuuuaaggccacaaucgaagcuagcaauagagugcugcucauccgcagcauuaucaacacgaccuucauuaucuguaugcugauucucgucgugugcguuaucuccacaagcgccguggagauggaagaccugccugcuggcaccugggagagagaagaggaucuuacaaauuuuugucaucaagagugccaggucaccgaaacggagugucugugccccuaugaagccuucgugcuccggaaaccucuguuucugucuuccaucguuaaggggaagaaaaaccuucugaauagcgcgucucucgagacaagccuguccauugaggcccccuggggcgcuaucaacgcccagucuaccuucaagcccaccauuagcacagcuaauaucgcccucuccuggucuagcguggaacaccgcggaaacaaaguccugguguccggcagaagcgagucuauuaugaaacuugaggagcggaccgggaucuccuggaaucugggaguugaagacgccagcgagucccgcaugcucacagugucugucauggaucugagccagauguaccugccuguguuugaguaucuuuccggcgacagacaaguggaagaguggccgaaagcuacguguaccggggauugccccgaacgguguggaugcacaucuagcaccugucugcauaaggaguggccucacucccgcaacuggagaugcaaucccacauggugcuggggcgucgggaccggcuguacgugcuguggacucgacguuaaggaucuguucaccgacuacauguucgugaaauggaagguggaauauaucaaaacagaggcgauugucugcguggagcucaccagccaggaacggcaguguucucugaucgaggccggcacacgcuuuaaccuugggccuguuaccauuacacuguccgaacccagaaauauccagcaaaagcugccuagcgagauugugacgcuccauccgaaaaucgaagagggauucuuugaucugaugcacguccagaaggugcuuucugcuuccaccguuugcaagcugcagagcuguacacacggcguggccggggaccuccaagucuaccaugugggaaaccugcucaaaggcgacaagauuaauggccacucuauccauaaaaucgagccccaccugaacaccagcuggauguccugggaugggugcgaccuugauuacuauuguaacaugggagacuggccuucuugcaccuacacaggcguuacgcagcauaaucacgccgcuuucgugaaccugcugaauauugaaaccgauuauacaaagagcuuucacuuccauuccaaacgggucaccgcccacggggacacaccccagcucgaucugaaggcgagaccuauguacggagcuggcgagaucaccgugcuuguggaagucgccgacauggagcugcauagcaaaaacauugagaucuccgggcucaaguuugccucucugacguguagcggaugcuaugcuugcuccucuggcauuagcuguaagguucgcauccacguggaugaacccgacgagcucgccgugcacgucaaauccgaugaccuggaugugguugcggcuucuagcucccuuauggcccggaagaucgaauuuggcacagacagcaccuuuaaagccuucucuuccaugccgaaggagagccugugcuuuuacauuguggaaagagacuucuguaaaucuugcgcugccgaggauacccagaagugugucaaggcuaaacuggagcaaccucaguccauccucauugaacauaaggggacaaucauuggaaaacagaaugauaccugcagcacaaagaccucuuguuggcuggaguccuuuaagagcuucuucuauggccuuaagaacaugcuguccgggguguuuggaagcgccaucaugggcauccuccuguuccucgcgcccuuuauucugcuuauccuguucuuuuucuuuggguggcgcauucuguucugccuccgguguugcagacgcacgcggggacuguuuaaguacaaacacaucaaggacgacgaagaggccggcuacaaaaagauuaucgaaaaacuuaauaacaagaagggcgggacaucuaaacugcucgauggagagagacuggcugaccgcaagauugccgagcuguucagcaccaaagcucauaucggcuga

SEQ ID NO: 13555 - RNA, 5076 nt, Artificial Sequence
  derived and/or modified CDS sequence (opt5) from CCHFV(SCT ex Afghanistan)__KC344856.1__GP
augcaccaugccuaccagaucauguauacccugcucgugugcgcuauucuguguccccaaccuuggagccuugagggcacacacgucccgcugaacgggacgaagcauaauggaaccggcaucacagccgcgcccgggggaucccagggcccuaccucucccgcuagcacagccguuucccucaccccugaccccuucacaaccgaaccuacggccucugcuguggagcuggaaagcuccggggagggacacaccucucuuagcgugacaacccagggccugacauccccggaaaccacgcccggccucccuacagucaccgauacaggggugagcucuaccuccauuuuuggaaucggcauuagaguugccggggacacccccacaagcacgacccauacaggacugccuucuucccccagcaugccgucuaccgcucagggcccucaccacgccgugcgggggcugcucuccgucagcuccacacgccccggagaggcgucuaccaucacggugccuggcgaggccggcacagaagcuaacagcuccagcucugccaucuccaaaaagcccgcucccagcccuaccgccgaggcgauuaccgaagccaauaacucuagcaauccgagacaacccgagcuguccacacagccugcuauccccgggcuuguuaccucuagcgcccagccuauucugcuccaguccgcuacaagcacggccgcccaagauaucuaccccucuccgaccaaccgguccaaacgcaaucuggagauggaaauuauccuuacacugagccagggacucaagaaauauuacggcaagauucugagaauccuggaccucacccuggaggaagauacagaggggcuucuggaauggugcaagcggaaccucggacugaccuguaaugacaacuucuuucaggagcgcaucgaggaguucuuucuuacgggcgaagggcauuucaaugaagugcugcaguuuaaaaccccuucuacacucucccccaccgagccuacacacaccagaacgcccacagucaagccuuucaaaagcuauuuugcucggggauuccuguccauugauucuggcuacuuuagcgcgaagugcuauuccaaaaccucuaacagcggccugcaacucaucaauauuacacagcaucccgcccgcaucgcugacaccccggggccuaagauuaccaaccugaaggccaucaauuguaucaaccuuaaagccuccguguucaaggaacacagagagauugagaucaacgugcugcucccccaggucgcuguuaaucugagcaacugccacgugcuuauuaaaucucaugugugugauuacucccuggacaucgauggagccguccggcucccccacgugcaucacaagggcacauuuauuccugggacguacaaaaucguuaucgacaagcgcaauaaacaaaacgauagaugcacccuggugacaaauugugucauuaagggaaaggaaauccggaaaggccagagcgcgcugcgccaguauagaaccgagauucggaucgggaaggcuucugccggcuccagacgccuccugagcgaagagucuggagacgacugcauuagccggacacagcuucugagaaccgaaacggccgaggugcauaacgauaauuacggcgggccgggagacaaaaucacaauuuguaacggcuccaccaucguugaucaacgccucgggagcgagcugggaugcuauaccaucaaucgggugaagucuuucaaacugugcgaaaacuccgcuacaggcaagagcuguaagauugacuccacccccgucaaaugcagacagggguucugucuuaagaucacacaggagggccgcggacacgugaaacucucucggggcagcgaagucgugcuggaugccugcgacuccucuugugagauuaugaucccuaaggggacgggagauauucugguugacugcagcggcgggcagcaacacuuucucaaagauaaucugaucgaccuuggaugucccaacaucccucugcucggcaagauggcuauuuacaucugcagaauguccaaucaucccaagaccacaauggccuuccuguuuugguucucuuuuggguaugugauuaccuguaucuucugcaaagucaucuuuuaccugcuuauugugguuggcacacucggaaagaaauucaagcaguaucgcgagcugaaaccucagaccuguacgaucugcgaaaccacacccaccaacgcgauugaugccgagaugcacgaccugaauugcagcuacaacaucuguccguacugcgcuucccggcucacaagcgacggccuggccagacaugugacccaguguccuaagcgcaaggaaaaagucgaggaaacagagcuuuaucugaaccucgagcggauucccuggaucgugagaaagcugcugcaagugucugaauccaccgggguugcucuuaaacggagcucuuggcucauuguccugcuggugcuccugacggugucccuuagcccuguccagucugcccccaucggacacggcaagacaaucgagaccuaccagacccgcgaaggguauauuuccgugugccuguuuguucucggaggcauccuguucguggucagcugucugauuaaagggcuuguggauuccguuggcaauagcuuuuucccgggacucucuaucugcaagacauguagcauuggcuccgugaacggguuugagaucgaaucucacaaaugcuacuguagccugcugugcuguccuuauugcagacauugcuccaccgaccgggagauucaccagcuccaucugucuaucuguaagaagagacgcacgggaggcaaugucaugcuugcggugugcaaacggauguguuucagagccacaauggagguuagcaacaaggugcuguucauccgcaauauuaucaacaccacauuugucauuugcauccucauucuggcuguguguguggucuccaccucugccguugaaauggagagccugcccgcugggacaugggaaagagaggaagaucuuaccaauuucugccaccaagagugucaggugacggagaccgaaugccuguguccuuacgaggcccucgugcugcggaaaccccucuuucugaacuccaucgucaagggaaugaaaaaucuucugaacagcacaaaucucgaaaccucucuguccaucgaggcccccuggggcgcuauuaacgugcagagcacauucaagccuaccguuucuacggcgaauaucgcccuguccuggagcuccguggagcaucgcggcaacaagauucuugucucugggagaagcgaauccaucaugaaacuggaggaacggacaggaauuagcugggaccucggcguggaggaugcuucugaauccaagagccugaccguuucugugauggaccucagccaaauguauuccccggucuuugaguaccugucuggggaucgccagguggaggaauggcccaaagccacaugcaccggagacuguccugagagaugcggcugcaccagcuccacaugucuucacaaggaauggccccacucucggaauuggcgcugcaacccuacgugguguuggggaguugggaccggcugcacauguugcggccuggaugugaaagaccucuucaccgauuacauguuugucaaguggaagguggaguauaucaaaacagaagccaucgugugugucgagcugaccagccaggagagacagugcucccugauugaagcugggacgcgguucaaccuuggacccguuacaaucacccugagcgagccucgcaauauucaacagaagcucccgcccgaaaucauuacccugcauccuagaaucgaggaaggcuuuuucgaccucaugcacgugcagaaagugcugucugccuccacagucuguaaacuucagagcugcacccauggggugcccggagaucugcaaguuuaccacauuggcaaccugcucaaaggggacaagcugaauggacauaugauccacaagaucgagccucacuuuaacacauccuggaugucuugggacggcugugaucuugacuauuacugcaauaugggcgauuggcccagcugcacguauaccggggugacacagcauaaccacgcggcuuucgucaaucugcucaacauugagaccgacuacaccaaaaauuuucauuuccacuccaagcgggugacagcccacggagauacgccgcagcuggaccucaaagccagaccuaccuauggcgcuggggaaaucacaguucugguggaggucgccgauauggaacuucauaccaagaaaauugacaucucuggacugaaguucgcgagccugacaugugcuggcugcuacgccuguuccagcgggauuucuugcaaagugcgcauccacgucgaugagcccgacgagcucaccgugcauguuaaguccgaagaucccgacaucguggccgcuagcacaucucugauugcccggaaacuugagcugggaacggauuccaccuuuaaggcuuucagcgccaugccuaagacaucucucuguuuuuacaucgucgaaagagaguauugcaaaagcuguuccaaggaagacacccagaaaugcgugaacaccaagcuggagcacccccaaggcauucucaucgagcauaagggcacaauuaucgggaaacagaaugacacguguaccgcgaaggccggaugcuggcuggaaucuguuaagagcuucuuuuacggccuuaagaacaugcuguccgggaucuucggaaauguguuuauuggcaucuuccuguuucucgcuccuuucguccugcuuauucuguuuuucauguucggguggcgccuccuguuuuguuucaaaugcugccggagaacacgcggacucuuuaaguaucggcaccugaaggaggaugaagagagcggcuacagacgcaucauugaacggcuuaacaauaaaaagggcaaaaacaagcugcuggacggggagagacucgccgaucggcgcaucgcugagcuguucuccaccaaaacacacauuggauga

SEQ ID NO: 13556 - RNA, 5070 nt, Artificial Sequence
  derived and/or modified CDS sequence (opt5) from CCHFV(SPU 431/85)__KJ682812.1__GP
augcccgugaacaucauguacaccccucuggucugcgccguuauuugucuccagcuguggaaucuuggcgggacacuggugagcacgaacagaacccaacacaaugagacaggaaccguggcuacaccggaaggcacccuccggccccgccugccugucuccacagcccuucccaccaagucugacagaccuagcguggggcccgcggcuuccucuagcggacuggagggcuccggggaaccuaacacgucuccgagcaucaccacaaaaggacucacacccccugagaccacccccgcccugccuacggccacagauaccgacgcuuccagcacaggcguuguggaugucucuacccagaugaccaaggacauucccauguccacagccuauacgaauccgccuagcacccccucugcuccuuccacaccccagggcacccaucacacagcccgggggcugcucagcguggcgucuaccaaauccgaagagguuagcauguccacgucucccgccaagacaagcaccgagaccuccagcccuccgcccgcuacaucugaaaccccuacacccuccccuacgacccaggugcccacaggaaacaauaacccgaauaccagccgccaaccuacacccucugcccagccugcuaugagcaaccccgccaccuccccugcgcagcccaaucugucucagagcgccccgccuacggcugaucaaggcguccaucccucccccaccaacagaagcaaacggaaucuugagaucgaaauuauccugacacucucucaggggcugcgcaaguacuauggaaagauccuuaaacugcucgaccugacccuggaggaggauacagaaggccuccuggaguggugcaagagaaaccuugggcugaccugugacgauaauuucuuucagaaacggauugaagaguucuuucucacgggagaaggcuacuucaacgaggugcugcaguuuaaggugccuuccacacuuagcucuaccgagccgacacacaccagacccccuaccgucgaacccuucaaauccuauuuugccaagggcuuccugagcaugaacuccggguacuuuucugcuaagugcuauccuagaacaagcaauuccggacuccaacugaucaacguuacgaaacauucugccaagauugccgacacccccggcccuaaaaucacaaaucugaagaccauuaacuguaucaaucuccgggcuagcguguucaaagagcaccgcgaaguggagauuaacguccugcuuccccagguggcgguuaaucuguccaacugccacgcccagaucaagagccaugugugugauuacucucucgcuacagacgggauggucagacugccgcacauccaucacgaaggaaccuuuauuccuggcacguacaaaaucgugauugauaagaagaauaaacaaaacgaccggugcacacuuguuaccaauugugugaucaaggggcgcgaggucagaaaaggacaguccgcccugcggcaguauaagaccgagauuagaaucggcaaagccagcucuggcucccgccggcuccugagcgaagagucugacggggauugcaucagcagaacacagcugcuccgcaccgaaacaacggagauucacuccgacaacuacggaggccccggggauaagaucaccauuuguaauggaagcacaaucguggaccaacggcugggcucugaacuugggugcuauaccauuaacagagucaaguccuucaaacugugcgagaauagcgcuacaggcaaguccugugagaucgauucuaccccugugaaaugccgccagggauuuugucucaagaucacgcaggaaggccgggggcauguuaaacugagcagaggauccgagauugugcuggacgccugcgauucuaacugugaaaucaugauucccaagggcaccggggacauccuugucgauugcagcggaggccagcaacacuuccucaaggacaaccugauugaucugggguguccgaauaucccucuccugggcaaaauggcgauuuacaucugccgcauguccaaccaucccaagacaaccauggcuuuccuguuuugguucucuuuuggauaugugaucacauguauucugugcaaaguuaucuucuaccuccugauuguggccggcaccgucgggaagaaauuuaagcaguaucgggagcugagaccucagacauguaccaucugcgagacgauucccgugaaugccaucgacgcugaaaugcacgaccuuaacugcagcuacaauaucugucccuacugcgccucccgccucacaagcgauggacuggcucggcaugugaugcaguguccuaagagaaaagagaagguugaagagaccgaacuguaucucaaccuggagcggauuccgugggucgugcgcaaacuucugcaagugucugaguccaccggcgucgcccucaagagaagcucuuggcugacagugcugcuuguucuccugaucgugucccugagccccguccagucugcgccuauugggcacggaaaaaccaucgaaacguaccaggcccgggagggcuauacauccuucugccucuuuauucuggggagcauccuuuucgugguuuccugucuggugaagggccucaucgacagcgucggaaauagcuuuuuccccggccugucuauuugcaaaaccuguuccaucgggucuauuaacggauuugaaaucgagagccacaagugcuacuguucccuguucugcuguccuuauugcagacauugccccgcugaucgcgaaauucacaaacuucaucucucuaucuguaagaagcggaaaacaggcagcaaugugaugcuggccguuugcaagagaauguguuuucgcgcuaccaucgagguguccaacagagcccugcucauucggaauaucauuaacacaaccuucgucgugugcauccugacgcuugcggugugugucguuucuaccagcgccguggagauggaaucccugccugcugggacaugggagaaagaagaggaccucaccaauuucugccaccaggaaugucaagugacagagaccgagugccuguguccguacgaagcccugguccuucgcaagccccuguuucucgauagcauugugaagggacgcaaaaaccugcucaauucuacgucccuggagacaagccuuucuaucgaagcuccuuggggcgccauuaacguucaguccaccuucaagcccacagugagcgccgcuaacaucgcgcuguccuggucuagcgucgagcaccgggggaauaaaauccucguguccggccgcagcgagucuauuaugaagcuggaagagagaaccggaaucuccugggaccugggcguugaagaugccagcgagucuaaacuucugaccgugagcgucauggaccucucccagauguauucuccuguguuugaauaccugagcggggaucggcaaguugaggaguggcccaaggcuacaugcacgggagacuguccggaacgcugcggcugcaccuccucuacaugucuccauaaggaguggccucacagcagaaacuggcggugcaaucccaccugguguuggggaguggggacaggcugcaccuguugcggccuggaugucaaagaccuuuucacggauuacauguuugugaaguggaaaguggaauauauuaagacagaggccaucgucuguguugaacugaccucccaggagcgccagugcagccucauugaggccgggaccagauucaaccugggacccgugacaaucacccugucugaaccucggaauauccagcaaaaacuucccccugagauuaucacacugcauccgagaauugaagagggcuuuuucgaccucaugcacgugcagcgcguccuguccgcuagcacgguguguaagcuccaguccugcacccaugggguucccggagaccuucagguguaccacaucggcaaccuucugaagggggauaaagucaauggacaccugauucauaagaucgaaccucacuuuaacacaucuuggaugagcugggacggcugugaucucgacuauuacugcaauaugggcgauuggcccuccugcaccuauacaggggugacccaacauaaccacgccgcguucguuaaucugcuuaacaucgagacggacuacaccaaaaauuuucauuuccacucuaagcgggugacagcucacggagauaccccucagcuggaccucaaagccagacccacauauggcgccggggaggucaccgugcuggucgaaguggcugauauggagcuccauacaaagaaaauugaaaucagcggacugaaguuugccucccuuacguguaccggcugcuacgcguguagcucugggauuuccugcaagguuaaaauccacguggacgagccggaugagcugacaguccauguuaagagcgaagacccugauauuguggcugccggaucuucccugauggcccgcaaacucgaguucggcgcugacagcaccuucaaggccuuuucugcuaugcccaaaaccagccuguguuucuacaucguggaacgggaguauugcaaguccuguucuagagaagacacacgcaagugcgucaacacgaaacuugaucggccucagagcauucugaucgagcacaagggcaccaucauugggaaacagaauaacacauguaccgccaaggcguccugcuggcucgagagcgugaaauccuuuuucuacggacugaagaacaugcucucuggcaucuuugggaauguguucauuggaaucuuucuguucauugcccccuuuguucuucugauccuguucuuuauguucggcuggagaauccucuucuguuuuaagugcugccgccggacaagagggcuguucaaauaucggcaccuuaaggacgaugaagagaccggauaccgcaaaauuaucgaaagacugaacaauaagaaaggcaagaacaagcuccuggacggcgagcggcucgcugaucgcaaaauugccgaacuguuuagcacgaagucccauaucggguga

SEQ ID NO: 13557 - RNA, 5070 nt, Artificial Sequence
  derived and/or modified CDS sequence (opt5) from CCHFV(SPU 556/87)__KJ682811.1__GP
augacggugaacacagucugcacgccccugguuugugccguguucugccuccagcuguggaaucuuggcgggacccuggugccuacaaacagaacccaacacaauaagacaggaaccauggcuacaccggagggcacccucgggccccggcugccugucagcacggcccuucccaccaaauccgaccgcccuucugugggacccgcggcuccuagcuccggccuggaagggucuggagagccgaacacaagccccuccaucaccacaaagggccucgcccugccugaaaccacgcccgccccucccacagcuaccgauacagacgccucuagcaccggcguugugaaugucuccacccagaugacaaaagauauuccgaugagcacggcuuacaccaacccucccucuacaccuuccgcccccagcacgccccaggggacacaucacaccgcgagaggacugcucucuguggccuccaccaagagcgaggaaguuucuauguccacaagcccuggcaaaaccuccaccgagacaucuagcccgcccccugcuaccuccgagacacccgccccuagccccacgacccaggcuccgacagggaauaacaauccuaacaccucucggcaacccacaccuuccgcccagcccgcgaugagcaauccuaccacgucucccgcccagccgaaccugcuucagaaugcuccucccaccgccgaccaaggagugcaucccggcccuacaaaccgcagcaagagaaaucuggaaauggagaucauucucacccugucccaggggcuucggaaguauuacggaaaaauccugaaguuucucgaucugacacuggaagaggacaccgagggccuccuggaaugguguaaacgcaaccuuggccugacgugcgaugacaacuucuuucagaagagaauugaggaguucuuucucacaggggaaggauauuucaaugaaguccugcaguuuaaagugccgucuacccuuagcuccacagagcccacccacaccggcagcccuacaguggagcccuucaagucuuacuuugcuaagggguuccuguccaugaacagcggauauuuuucugccaaauguuacccucggacguccaauagcggccuccaacugaucaacgucaccaagcauuccgccaaaaucgcugauacacccgggccuaagauuaccaaucugaaaacaaucaacugcauuaaucuccgcgcgucuguuuucaaggaacacagagagguggaaaucaacgugcugcuuccccaggucgccgugaaucugagcaacugucacgcucagauuaaaucccauguuugcgacuauucucucgccaccgauggaauggugcggcugccgcgcauccaccaugagggcacguuuauuccuggcacauacaagaucgucaucgacaagaaaaauaagcaaaacgauagauguacccuugugaccaauugcguuauuaaagggcgggaagugcgcaagggacagagcgcccugagacaguacaaaacagagauccggauuggcaaggcuuccagcgggucuagacgccuccuguccgaggaaagcgacggagacuguaucucucggacccagcugcucagaacagagacggccgaaauucacuccgauaacuauggcgggcccggcgacaagaucaccaucugcaauggaagcacaauugucgaucaacgccugggcucugagcuugggugcuacaccaucaaccgggugaaaucuuucaagcugugugaaaacuccgcgacaggaaaaagcugcgagauugacucuaccccugucaaguguagacagggcuucugccucaaaaucacgcaggaggggcgcggacacgugaagcugucccggggcagcgaaauuguucuggaugcuugugacuccucuugcgagaucaugauccccaaggggaccggcgauauucuuguggacuguagcggaggccagcaacauuuucucaaagauaaucugaucgaccuggggugcccgaacauuccucuccugggaagaauggccaucuauauuugucgcauguccaaucaccccaagacaaccauggccuuccucuuuugguucucuuuuggcuacgucaucacaugcauucuguguaaagugaucuucuaucuccugaucguugcugggaccgugggaaagaaauuuaagcaguaccgggaacugagaccucagacaugcaccauuugcgagacgacacccgucaacgccaucgaugcugagaugcaugaccuuaauuguagcuauaacauuugccccuacugugccucccgccucaccucugacggccuggcgcggcacgugaugcagugcccuaagagaaaagaaaagaucgaggaaaccgagcuguaccucaaucuggaacggauuccgugggugguucgcaaacuucugcaagucagcgaguccacagggguggcccucaagagaagcucuuggcugaccgugcugcuuguccuccugaucgugucccugagccccguucagucugcuccuaucggccauggaaaaacgauugagacauaucaggcccgggaaggcuacaccuccuucugucucuuuauccuggggagcauucuuuucaucgugucuugccuggucaagggacucauugauuccgugggcaacagcuuuuuccccgggcuguccaucuguaaaacaugcagcaucggaucuguuaauggcuuugagauugaaagccacaaguguuauugcucccuguucuguugcccuuacugcagacacuguucugcugaccgcgagauccauaagcugcaccucagcauuugcaaaaagcggaaaaccggguccaacgugaugucugccgucuguaagagaaugugcuuccgcgcgacaaucgaagugagcaauagagcccugcugauucgguccaucaucaacaccacguuugcuguuuguauucucacccuggccgugugcgucgugucuacaagcgcuguggagauggagucccuucccgccggcaccugggaacgcgaggaagaucugacaaauuucugucaucaggagugccaagucaccgaaacggagugucucugcccuuaugaggcccugguucugagaaaaccgcuuuuucuggacagcaucgugaagggaaagaaaaaccuccuuaauucuacaucccucgaaaccagccugucuauugaggcucccuggggcgcgaucaacgugcaguccacauucaagccuaccgucagcgccgcuaacauugcccuuuccuggucuagcguggaacaccgggggaauaaaauccugguuuccggacgcagcgagucuauuaugaagcucgaggaaagaaccggcaucuccugggaucuggggguggaggacgccagcgaaucuaaacugcuuacagucagcgugauggaucugucccagauguacucucccguuuuugaguaucucagcggagaccggcaaguggaagaguggccuaaggcuacguguaccggcgauugccccgagcgcugcggcuguacauccucuaccugccugcacaaggaauggccgcauagcagaaacuggcgguguaauccuacauggugcuggggagucgggaccggcuguacgugcugugggcucgacgugaaagaucuguucacagacuacauguuuguuaaguggaaaguggaguacaucaagaccgaagccauugucugcguggagcuuaccucccaggaacgccaguguagccugaucgaggcgggaacaagauucaaccucggccccgugaccauuacacugucugagccccggaauauccagcaaaaacugccucccgaaauuaucacgcuucacccuagaaucgaggaaggguuuuucgaucugaugcauguccagaagguucucuccgcuagcaccgugugcaagcugcaguccuguacacacggagugccgggcgaccuccaggucuaucauauuggcaaccugcuuaaaggggacaaggugaauggacaccugauccacaaaauugagccccauuuuaacaccucuuggaugagcugggauggcugcgaccuggauuacuauugcaauaugggggacuggccuuccuguacauacaccggaguuacgcaacacaaccaugccgccuucgugaaucuccugaacaucgaaaccgauuauacaaagaauuuucacuuccauucuaaacgcgucaccgcucacggcgacacaccccagcuugaucugaaggcccggccuaccuacggggcgggagaggugacaguucucguggaggucgcugacauggaacugcacacgaaaaagauugagaucagcggccucaaguucgccucccugagcugcaccggcuguuaugccugcagcuccgggaucagcuguaaagugcgcauucaugucgaugaacccgacgagcuuacagugcacguuaagucugaggauccggacaucguggcugccggauccagccugauggcuagaaaacuggaauuuggcgccgauucuaccuucaaggcguuuagcgccaugccuaaaaccucccucugcuucuacauugucgagcgggaauacuguaagucuugcagcagagaggacacacagaagugugugaacacgaaacuggaacgcccccaguccauccuuauugagcauaaggggaccaucauuggaaaacaaaaugacacaugcaccgcuaaggccagcuguuggcuggaguccguuaaaucuuucuuuuauggccucaagagcaugcuguccgggaucuuuggaaacguguucaucggcauuuuucucuucaucgcuccuuuuguccugcuuauucuguucuucauguuuggcuggcggauccuguucugcuuuaagugcuguagacgcacacgggggcuuuucaaauacagacaccugaaggaugacgaagagaccggauaucggaaaauuaucgaacgccuuaacaauaagaaaggcaagaacaagcugcucgauggggagagacuggccgaccggaaaaucgccgaacucuuuucuaccaagagccacauuggauga

SEQ ID NO: 13558 - RNA, 5070 nt, Artificial Sequence
  derived and/or modified CDS sequence (opt5) from CCHFV(SPU 18/88)__KJ682810.1__GP
augcccuucaacaucauguacaccccucugcucugcgccauucugugucuucagcuguggagccucgagggcaucuaugggcuguccaauaagacacaacacaacgacacgucuaccauuaaagugccggaagagagccagaagacaucccuucccgcuaauaccgccucuccuaucacaagcgaucccuccucugcgaccagcacagcucuggccuccggaccugaaggcagcggggacaccucuacgucccccagcgucaccacacagggaccuacccuccuggagacaaccccggaaccccauacgacaauugauaucgacgagucuuccaccgccaucgcugauauuagcacacagaccguuaaagacaucccuacccccacaacgcacaccucucugccuuccacacccagcgccccgaccauuccucaagaggcucaucacacagccagaggccuccuguccgugaccucuacgaagcccggggaaacaagcaccccuaccucccccggagaggcgagcacagaagccucuucuccccagccuaccaucagcgagacaccgucucccccucccacgacccaggcuccuacagagauuaacaaucccaacaccagccggcagccgaugccuuccacacaacccgccgcuccuaauucugugacgcccccuguccagcccaccuuuagccaguccgaugugagcaccguugcccaggacauccauccgucuccuacaaaccgcuccaaaagaaaucuugaaauggagauuauccugacccucagccaaggccugaagaaguacuauggcaaagugcuuaagcugcucgaucugacacuggaagaggacaccgaagggcuccuggaguggugcaaacggaaccuuggacugacgugugaugacaauuucuuucagaagcgcaucgaggaguucuuucucacaggcgaagggcacuucaacgaaguccugcaguuuaaaacccccucuacacuuucccccaccgagccugcgagaguggaaagcccgaccguugagcccuucaaguccuacuuugccaagggauuccugucuauggauagcggcuauuuuuccgcuaaaugcuacccuaagucuagcaauuccgggcuccaacugauuaacgugacacagcacagcauccggauuacggacacccccggaccuaaaaucacaucucugaagaccauuaauuguaucaaccucaaagcccuggucuucaaggagcaucgcgaaaucgagauuaacgugcuucugccccagguggcugucaaucucuccaacugccacguucugaucaaaagccaugccugugacuauucucuugauauugacggcccugugagacugccccggauccaccacgaaggcacauuuauuccggggaccuacaagaucgugaucgauaagaaaaauaagcagaacgaccgcugcacgcucgucacaaauugugugauuaaaggaagagagauccggaagggccaauccguucugcgccaguacagaaccgaaauuaaaaucgggaaggccagcucuggaagccggcgccugcucuccgaggagagcaacgaugacugccugucuagaacccagcuucugcggacagaaaaugcugagauucauuccgauaacuauggcgggccuggagacaagaucaccauuuguaauggcagcacaaucguggaucagagacucggcuccgaacuggggugcuacacgaucaaccgcgucaaaucuuucaagcugugcgagaauagcgcgaccggaaaauccugugagauugacucuacacccgugcggugcagacaaggcuucugucuuaagaucacccaggaagggcgcggacacguuaaacucagccggggcuccgaggugguccuggaugccugcgacucuagcugugaaauuaugaucccuaaggggacaggcgacauucugguggauugcuccggaggccagcagcauuuucucaaggacaaccuggucgaucuugggugucccaauaucccgcugcucggaaaaauggcuaucuauauuugcagaaugagcaaccacccuaagaccacgaugggcuuccuguuuugguucucuuuuggguacgugaucaccuguauucugugcaaaguuaucuucuaucuucucauuguggucggaacacugggcaagaaauuuaagcaauaccgcgagcugaagccccagaccuguacaaucugcgaaaccaauccugugaacgccaucgacgccgagaugcaugaucucaacugcuccuauaauauuugucccuacugcgcuagccggcugacaucugacgggcuugccagacacguuaugcagugucccaaacgcaaggagaaaaucgaagagaccgaacuguaccucaaccuggagcggauuccuuggguggucagaaagcugcuucagguguccgaaagcacgggcguggcgcucaaaagaucuuccuggcugguuauccugcucguccugcuuacagugagccuguccccggugcaaagcgcucccauuucucacggagagaccgucgagguguaucagacccgggaaggcuacacaagcaucugccucuucguucugggguccauccuguuucuugugucuugucucaugaagggacuggucgauagcgugggcaauuccuucucuccugggcugagcauuugcaaaaccuguuccaucggaucuauuaacggcuuugagaucgaaagccauaagugcuauuguucccucuucugcugucccuacugcagacacugcagcgccgacauugagauccauaagcugcaccuuucuauuuguaaaaagcggaaaacgggguccaauguuaugcuggccgugugcaagcgcauguguuuuagagcuacagucgaagugagcaacaaagcccuccugauccggaauaucauuaacaccacauucguugugugcauccugauucuugcugucuguguggugucuaccuccgccgucgagauggagaaucugccugcgggcacaugggaaaaggaggaagaucucaccaacuucugccaccaggagugucaaguuacggagaccgaaugccugugucccuaugaggcccucgugcugagaaagccucuuuuucuggacagcaucgugaaaggaaagaaaaaucuccugaacuccacaucucuggaaaccagccuuuccauugaggcuccguggggcgccaucaauguccagagcacauucaagcccaccgugucugcugccaacaucgcgcuguccuggagcucuguugaacaucgcgggaauaaaauucucgugagcggacgguccgagucuaucaugaagcuggaggaaagaacgggcauuagcugggaucucggggucgaggacgccuccgaaucuaagcugcuuacagugagcguuauggaucugucccagauguacagcccuguguuugaguaucucucuggagaccgccaggucgaagaguggcccaaagcuaccugcacaggcgacuguccugagagaugcgggugcaccuccagcaccugucugcacaaggaauggccccauucccggaacuggcgcugcaacccgacaugguguuggggcgugggaacgggcugcaccuguugcgggcuggauguuaaagaccuuuucacagauuacauguuugugaaguggaaagucgacuacaucaagaccgaggccauuguguguguggaacugacaucucaagagagacagugcagccucaucgaagcuggaacccgguucaaucugggcccugucacgaucacacucuccgagccccgcaacauucagcagaagcugcccccugagaucguuacccuucaccccagaauugaagagggguuuuucgaucugaugcauauccaaaaagugcugucugccagcaccguguguaagcuccaguccugcacacacggagucccuggcgaccugcagauuuaucacaucggcaaucuucugaaaggggauaaggugaacggacaucucauucacaaaaucgaaccgcauuuuaauaccagcuggaugucuugggacggcugugaucuggacuacuauugcaacaugggggauuggcccuccugcagcuacacaggaguuacgcagcacaaucaugccgcuuucgugaacaugcucaauaucgagaccgacuauacaaagaacuuucacuuccacucuaaacgggucaccgcgcauggcgauacaccucaacuggaccuuaaggcccgccccaccuacggggcuggagagauuacggugcugguugaaguggccgacauggagcugcacaccaagaaaaucgaaauuuccggccucaaguuugccagccugacauguaccggcugcuaugcuuguucuagcgggaucuccugcaaaguccgcauucauguggaugagccugacgaacuuacaguccacgugaagucugaggaucccgacaucguugccgcgagcuccagccugauggcucggaaacucgaguucggaaccgauuccacauucaaggccuuuucugccaugccgaagacgagccuguguuucuacaucguggaacgcgaguacugcaaauccuguucuaaggaagacacccagaaaugcgucaauacaaagcucgagcagccucaaagcauucugaucgaacacaaaggcaccauuaucgggaagcagaacgauaccuguacaggaaaggcuggcugcuggcuugaguccauuaaauccuuuuucuaugggcugaagaauaugcugagcggaaucuuuggcaacguguucaucggcauuuuucucuuccuggcccccuuuaucaugcuuauucuguucuuuauguucggguggagaauccucuucuguuuuaaaugcugccggagaacgcgcggacuguucaaguaccggcaucucaaagacgaugaggaaauuggcuauagaaagaucauugagcgccugaagaauaaaaaggggaaaaacaaacuucuggacggagaacggcuggcggauagaaagaucgcugagcucuuuuccaccaagacacacaucggcuga

SEQ ID NO: 13559 - RNA, 5070 nt, Artificial Sequence
  derived and/or modified CDS sequence (opt5) from CCHFV(SPU 497/88)__KJ682808.1__GP
augcccuucaacaucauguacaccccucugcucugcgccauucugugucuucagcuguggagccucgagggcaucuaugggcuguccaauaagacacaacacaacgacacgucuaccauuaaagugccggaagagagccagaagacaucccuucccgcuaauaucgccucuccuaccacaagcgaucccccuuccgcgaccucuacagcuagcgccuccggacccgaaggcagcggggacaccucuacguccccuagcgucaccacacagggaccgacaccccuggagauuaccccugaaccccauaccacgaucgauaucgacaaaucuuccacaagcauugccgauaucucuaccagaacaguuaaggacauuccuacccccaccacacacacgucccucccgagcaccccuuccgcucccacaaucccucaggaggugcaucacaccgcccggggccugcugucugugacaagcaccaaacccgaggaggcuuccacgcucacaagccccggggaggccucuaccgaagcguccagcccucaaccgaccauuucugagacacccagcccucccccuaccacacaggcccccacggagaucaacaauccgaacaccucccgccagccuaugcccucuacacagccugcugcccccaauagcgucaccccucccgugcaaccgacauuuucccagagcgauguuucuaccgcugcccaggacauucauccuucccccacgaacagaagcaagcggaaucuggaaauggagaucauccuuacccugucucagggacucaagaaauacuauggcaaggugcugaaacuucuggaucucacacuggaagaggacaccgaaggccugcucgaguggugcaagcgcaaccuggggcuuacaugugaugacaauuucuuucaaaagagaauugaggaguucuuucugaccggagaaggccacuucaacgaaguccuccaguuuaagacgcccuccacacugagcccuaccgagccggcgcggguggaaucccccacaguugagccuuucaagucuuacuuugccaaaggguuccuuagcauggauuccggauauuuuucugcuaagugcuaccccaaaagcuccaauagcggccugcagcucaucaacgugacccaacaccugauucgcaucaccgacacaccugggcccaagauuacgaaucugaaaaccaucaacuguaucaaccucaaggcccuggucuucaaagagcauagagaaauugagaucaaugugcuucugccucagguggcugucaaccucucuaauugccacguucugauuaagucccaugugugugacuauagccuugauaucgacggacccgugcggcugccgcgcauucaccacgaaggcacauuuaucccuggcaccuacaagaucgucauugauaaaaagacaaaacagaacgacagaugcacccucgugacgaauuguguuaucaaggggcgggagauucgcaaaggacagucugugcugagacaauaccggacagaaaucaagauuggcaaggccuccagcgggucucgcagacugcucagcgaggaguccaacgaugacugccugagccggacccagcuucugagaaccgaaaaugccgagauccauucugauaacuauggaggccccggggacaaaauuacaaucuguaauggauccaccaucgucgaucagcgccucggcagcgaacugggcugcuacacaauuaaccgggugaaguccuucaaacugugcgaaaauucugcuacggggaaaagcugugagaucgacuccaccccuguuagaugccgccagggauucugucuuaaaauuacacaagaaggcaaggggcacgugaagcucucucggggaagcgaggucgugcuggaugcgugcgacuccucuugugaaaucaugauucccaaaggcaccggggacauccuggucgauugcagcggcggacagcagcauuuucucaaggacaaccugguggaucuuggcuguccgaauaucccucugcucgggaaaauggccauuuauaucugcagaauguccaaccaccccaagacaaccaugguuuuccuguuuugguucagcuuuggauacgugauuacguguauccugugcaaagucauuuucuaucuucucaucgugguuggcacccuggggaagaaguuuaaacaguaccgcgagcugaagccucaaacauguaccaucugcgaaacaaaucccgugaacgcuauugacgccgagaugcaugaucucaacugcucuuauaauaucugucccuacugcgccucccggcugaccagcgacggacuugcuagacacgucaugcaguguccuaaacgcaaggagaaaauugaagagacagaacuguaccucaaccuggagcggaucccguggguggugagaaagcugcuucagguuucugaauccaccggcgucgcccucaaacgcagcucuuggcuggugauucugcucgugcugcuuacggucucccugagccccgugcaguccgcgccuaucagccacggggagacaguugagguguaucaaacccgggaaggcuacaccucuaucugccucuucguccugggaggcauucuguuucuugugagcugucucaugaaggggcugguugauuccgugggaaauucuuucuuucccggccugagcaucugcaagacauguuccauugggucuaucaacggauucgagauugaaagccauaaaugcuauuguucccucuuuugcuguccuuacugcagacacugcucugcugacaucgagauucauaagcugcaccuuagcaucuguaaaaagcggaaaaccugguccaaugucaugcuggccgugugcaagcgcauguguuucagagccacgguugaagugagcaacaaggcucuccugauccggaauauuaucaacacaaccuucgucgugugcauucugauccuugccauuuguguggucucuacauccgcuguugagauggagaaucugcccgccggcaccugggaaaaagaggaagaucucacaaacuuuugccaccaggagugucaggugaccgagacggaaugccuguguccuuaugaggcgcucgugcugagaaagccgcuuuuccuggacagcaucgucaaagggaugcgcaaucuccugaacucuaccucccuggaaacaagccuuuccaucgaggcccccuggggcgcuauuaaugugcaaucuaccuuuaagccuacaguuagcgccgcuaacaucgcccuguccuggagcucuguggaacaucggggaaauaaaauucucgucuccggcagaagcgagucuaucaugaagcuggaggaacgcaccgggauuagcugggaucucggaguggaggacgcguccgaaucuaagcugcuuacgguuagcgugauggaucugucccagauguacucucccgucuucgaguaucucagcggcgacagacagguggaagaguggccuaaagccacaugcaccggggacugucccgagcggugcggaugcacauccagcaccugucugcacaaggaauggccgcauucucgcaacuggagaugcaacccuaccugguguuggggcguugggacaggcugcacguguugcggacuggaugugaaagaccuuuuuaccgauuacauguucgucaaguggaaaguggacuacaucaagacagaggcuaucgugugugucgaacugaccucccaggagcggcaaugcagccucauugaagccggcacacgcuuuaaucuggggcccguuaccaucacgcucuccgagcccagaaacauucagcagaagcugccucccgagaucgugacacuucacccucggauugaagagggauucuuugaucugaugcauauccagaaagugcugucugcuagcaccgucuguaagcuccaauccugcacccacggcgugccgggggaccugcagauuuaucacaucggaaaucuucugaaaggcgauaagguuaacggccaucucauccacaaaauugaaccccauuucaauacaucuuggaugagcugggacgggugugaucuggacuacuauugcaacaugggagauuggccuuccugcagcuacaccggcgugacacagcacaaucaugccgccuuugucaacaugcucaauaucgagacggacuauaccaagaacuuccacuuucacucuaaacgcgugacagcucauggggauacaccccagcuggaccuuaaggcgagaccuaccuacggagccggcgagauuaccguucugguggaagucgcugacauggagcugcacacgaagaaaaucgaaauuuccgggcucaaguucgccagccugaccuguacaggaugcuaugccuguucuuccggcaucagcugcaaagugcggauccaugucgaugagcccgacgaacuuaccgugcacguuaagucugaggauccggacauuguggcugccagcuccucucugauggcgcgcaaacucgaguucggcacagauagcaccuuuaaggcuuucuccgccaugccuaagacaagccuguguuuuuacaucgucgaaagagaguacugcaaauccuguucuaaggaagacacgcaaaaaugcgugaauaccaagcucgagcagccccagagcauucugaucgaacacaaagggacaauuaucggaaagcaaaacgauaccuguaccgcccgggcuuccugcuggcuugagucuaucaagagcuucuuuuauggccugaaaaauaugcuguccgggauuuucggaaacguuuuuaucggcauuuuccucuuuuucgccccuuuuaucaugcugauucuuuucuucauguuuggguggagaauccuguucuguuuuaagugcugccgccggacaagaggacucuucaaauaccgccaucugaaggacgaugaggaagugggcuaucggaaaauuaucgagagacucaauaacaagaagggcaaaaacaagcugcuugacggggaacgccuggcggaucggaaaaucgcugagcuguuuucuacgaagacccacauuggauga

SEQ ID NO: 13560 - RNA, 5070 nt, Artificial Sequence
  derived and/or modified CDS sequence (opt5) from CCHFV(SPU 130/89)__KJ682807.1__GP
augcccuucaacaucauguacaccccucugcucugcgccauucugugucuucagcuguggagccucgagggcaucuaugggcuguccaauaagacacaacacaacgacaauucuacgaccaaagcuccggaagagagccauaagacaucccuucccgccaacaccgcgucuccuauuacaagcgaucccccuuccaccacaucuaccacgagcgcuuccggacccgaaggcagcggggacaccucuacauccccuccggugaccacacagggacccgccagcccugagaccacgcccgaaccucacacaaccaucgauauugacaaaucuuccacagccaucgcugauaucagcacccagaccgucaaggacauucccacaccgacgacccauacaucucugccuuccacccucagcgcccccacaaucccucaggaggcucaccauaccgccagaggccugcuguccguuacgcggcacaaacccggggaggcgucuaagcccacaagcccuggagaagccuccaccgaggcuucuucuucccaaccgaccauuagcgaaacacccucuccucccccuaccacacaggcccccacggagaucaauaacccgaauaccagccgccagccuaugcccuccacacagccugcugcccccucuagcgugacccacccugcgcaacccacaccgucccagagcgaugugccuaccgccgcucaggacauucaucccucucccacgaacagauccaagcggaaucucgagauggaaaucauucugacccuuagccagggccugaaaaaguacuauggcaaaguccucaagcugcuugaucugacacucgaggaagacaccgaggggcugcuggaauggugcaaacgcaaccucggacugacaugugaugacaacuuuuuccaaaagagaaucgaggaguuuuuccuuaccggcgaagggcacuuuaaugaggugcugcaguucaagacgccuucuacacucuccccgaccgaacccgcccggguugagagcccuacaguggaacccuuuaaauccuacuucgcuaagggauuucugucuauggauagcggcuauuucuccgccaaaugcuacccuaagucuagcaauuccgggcuucagcugaucaacgucacccaacaucucauucgcaucaccgacacacccggaccuaaaauuacgaaucugaagaccaucaacuguauuaaccugaaagcccucguguuuaaggagcacagagagaucgaaaucaauguucugcuuccccagguggcugucaaccugagcaauugccacgugcucauuaagucucaugugugugacuauucccuggauaucgacggcccgguccggcuuccuagcauucaccaugagggcacauucauccccgggaccuacaaaauuguuaucgauaagaaaaacaagcagaaugaccgcugcacacuggugaccaacugugugaucaaaggaagagaaauucggaagggccagucuguccuccgccaauacagaacggagaucaagauugggaaagcguccagcggaucucggcgccugcugagcgaggaaccuaauuaugauugccucuccagaacacagcugcuucggaccgagaacgccgaaauccacagcgacaauuacggcgggcccggagauaagauuaccaucuguaacggcucuacaauuguggaccagagacugggcuccgagcucgggugcuauaccaucaaucgcguuaagagcuuuaagcugugcgaaaacuccgcuacaggaaaaucuugugagaucgauagcacgccggugcggugcagacagggcuucugucugaagauuacccaagaggggcgcggacaugucaaacuuucccggggcucugaagugguucucgacgccugcgauagcuccugugagaucaugauuccuaaagggacaggcgacauccugguggacugcucuggaggccagcagcacuuccugaaggauaaucucgucgaccuggggugucccaacauuccucuucugggaaaaauggccaucuacaucugcagaaugagcaaucaccccaagaccacaauggcuuuucucuucugguuuuccuucggcuaugugauuaccuguauccugugcaaagucaucuuuuaccugcuuauugugguugggacgcucggaaagaaguucaaacaguaucgcgaacugaagccccaaaccuguacaauuugcgagaccaacccugugaacgccaucgaugcggaaaugcaugaccugaauugcagcuacaacaucuguccguacugcgcuucucggcucacauccgauggccuggccagacacgucaugcagugucccaaacgcaaggagaaaauugaggaaaccgagcuuuaucugaaucucgaacggaucccuugggugguuagaaagcugcuucaggugagcgagucuacaggggucgcccuuaaacgcuccagcuggcucguggugcugcugguucuccugaccgucucucuuucccccgugcagagcgcuccuauuucccauggcgaaacgguggaggucuaccaaacacgggagggauauaccagcaucugccuguuugugcucggcucuauucuguuccugguuagcugucuuaugaaggggcucguggacuccgucggaaacagcuuuuuccccggccugagcaucugcaagaccuguuccaucgggucuauuaauggauuugaaaucgagagccacaaaugcuacuguucccuguucugcuguccuuauugcagacacugcucugccgauauugaaauccauaagcuccaccugagcauuuguaaaaagcggaaaacaggcuccaacgugaugcuugcuguuugcaagcgcauguguuuuagagccaccguggaggucagcaauaaggcgcugcucauccggaacauuaucaauacgacauucgugguuugcauccugauucuggccgugugugucgugucuaccuccgcuguggaaauggagaaccuuccggccgggacaugggagaaagaagaggaccugaccaauuucugccaucaggaaugucaggucacagagaccgagugccucugucccuacgaagcucugguucucagaaagccucugagccuugauucuaucgugaaaggcaugaagaaccugcucaauuccacgagccuggagaccucccugucuauugaagcccccuggggagcgaucaacgugcaaagcacauuuaaaccuaccgucuccgccgcuaauauugcccuuagcuggucuuccguggagcaccgcggcaacaagauccugguuagcgggcggucugaaagcaucaugaagcucgaggagagaacaggaauuuccugggaccugggcguggaagaugcuucugagagcaaacuccugaccgucuccgugauggaccuuucucagauguauagccccguuuucgaauaccuguccggggaucgccagguggaggaauggccgaaggccacgugcacaggagacuguccugagagaugcggcugcaccagcucuacaugucuccauaaagaguggccccacucccggaacuggcgcugcaaucccaccugguguuggggcgucgggaccggaugcacauguugcggccuggacgugaaggaucuguuuacggacuacauguucguuaaauggaagguggauuauaucaagaccgaagccauugucuguguggagcuuacaagccaggaaagacaaugcucccugaucgaggcugggacccgguuuaaccucggaccugugacaauuacccugucugaaccccgcaauauccagcagaaacucccuccggagaucgucacgcugcaccccagaauugaggaaggcuucuuugaccuuaugcauauccagaagguucugagcgcguccacaguguguaaacugcaaucuugcacccacggggugccuggagaucuccagauuuaccauaucggcaaccugcuuaagggcgacaaagucaaugggcaccugauucauaagaucgagccccacuucaacaccagcuggauguccugggauggaugugaccucgauuauuacugcaauaugggcgacuggccuagcugcucuuauacaggggugacccagcacaaccaugccgcuuuuguuaauaugcugaacauugaaacagauuacacgaaaaauuuccacuuucauuccaagcgggugaccgcccacggagacacaccccagcucgaucugaaggcccgcccgaccuauggcgcuggggagaucacaguccuuguggagguugccgacauggaacugcacaccaaaaagguggagaucagcggacugaaauucgcgucucucacguguaccggcugcuacgcuuguuccagcggcauuucuugcaaggucagaauccauguggacgaaccugaugagcugacaguccacgugaaaagcgaagaccccgauauuguugccgccuccucuagccuuauggcucggaagcuggaguuugggaccgacuccacauucaaggccuucagcgcgaugccuaaaaccucccucuguuuuuacaucguggagcgcgaacauugcaagucuuguagcaaagaggauacacaaagaugcgucaacacgaagcuggaacagccccaguccauucucaucgagcacaaaggaaccaucauuggcaagcaaaaugacacauguaccgcuaaggccucuugcuggcuggaaagcaucaaauccuucuuuuaugggcuuaagaacaugcugucuggaauuuucggcaauguguuuaucgggguuuuccuguuucucgccccuuucauuauccugauccuguuuuucauguuuggauggcggauucuguucuguuucaaaugcugcagacgcacccggggccuccugaaguacagacaucucaaagaugacgaggagaucggcuaucgcaagauuaucgaacggcugaacaacaagaaagggaagaauaaacuucuggauggagagagacuggcugaccgcaagauugccgaacucuuuagcacaaaaacgcacaucggcuga

SEQ ID NO: 13561 - RNA, 5070 nt, Artificial Sequence
  derived and/or modified CDS sequence (opt5) from CCHFV(SPU 383/87)__KJ682806.1__GP
augcccuucaacaucauguacaccccucugcucugcgccauucugugucuucagcuguggagccucgagggcaucuaugggcuguccaauagaacacaacacaacgacacgucuaccauuaaggugccggaagagagccagaaaacaucccuucccgcuaauaccgccucuccuaucacaagcgaucccccuuccaccacaucuaccgcgagcgcuuccggacccgaaggcagcggggacacgucuaccuccccuccggucacaacccagggacccacaccucccgagaccacgccugaaccccauacaaccauugauaucgacaagagcucuacagccaucgccgauauuuccacccagaccguuaaagacaucccgacaccuacgacccacacaagccugcccucuacccucuccgcuccuacaauuccccaagaggcccaucacaccgcucggggccugcugagcaucacguccacaaagcccggggaggccucuaccccuauuagcccgggagaagcguccaccgaggccagcucuccccagccuacaaucuccgaaacccccagcccucccccgacagcucaggccccuacggagauuaacucucccaauaccagccgccagccuaugcccuccacacaaccugcugcccccaacucugugacccauccggcgcagccuacacccagccaguccgaugugcccaccgccgcucaggacauccacccuaauccgaucaacagaagcaaacggaaucucgagauggaaauuauccugacgcuuucucaaggccugaagaaguacuauggcaaaguccucaagcugcuugaucugacccucgaggaagacacagaggggcugcuggaauccugcaaacgcaaccucggacugaccugugaugacaacuuuuuccagaagagaauugaggaguuuuuccuuacaggcgaagggcacuuuaaugaggugcugcaguucaaaacccccagcacgcucucuccuacagaacccgcccggguugaguccccuaccguggaacccuuuaagagcuacuucgcuaagggauuucuguccauggauucuggcuauuucagcgccaaaugcuacuccaagucuagcaauuccgggcuucaacugaucaacgucacacagcaucucauucgcaucaccgacaccccuggacccaaaaucacaaaucugaagacgauuaacuguaucaaccugaaagcccucguguuuaaggagcacagagagauugaaaucaauguucugcuuccccagguggcugucaaccugagcaauugccaugugcucauuaaaucucacgugugugacuauucccuggauaucgacggcccuguccggcuuccccgcauccaccaugagggcaccuucauuccugggacauacaagaucguuauugauaagaacaauaaacagaacgacagaugcacccuggugacaaauugugugaucaagggacgggaaauucgcaaaggccaaagcguccucagacaguaccggaccgagaucaagauugggaaagcgucuuccggaagccgcagacugcugucugaagagagcaacgaugacugccucucccggacgcagcugcuuagaacagagaaugccgaaauccacagcgauaacuauggcgggcccggagacaagaucaccauuuguaauggcucuaccaucguggaucagcgccugggcuccgagcucgggugcuacacaauuaaccggguuaagagcuuuaaacugugcgaaaauuccgcuaccggaaagucuugugagaucgacagcacaccggugagaugccgccaaggcuucugucugaaaauuacgcaggaggggcggggacaugucaaacuuuccagaggcucugaagugguucucgaugccugcgacagcuccugugagaucaugaucccuaaagggaccggcgacauucugguggauugcucuggaggccagcagcacuuccugaaggacaaccucgucgaucuggggugucccaauaucccucuucugggaaagauggccauuuauaucugccgcaugagcaaccaucccaaaacaaccauggcuuuucucuucugguuuuccuucggcuacgugauuacauguauccugugcaaggucaucuuuuaucugcuugugguuguggggacccucgggaaaaaguucaaacaauaccgggaacugaagccccagacguguaccauuugcgagacaaacccugucaaugccaucgacgcggaaaugcacgaucugaacugcagcuauaauauuuguccguacugcgcuucuagacucaccuccgacggccuggcccgccacgugauccagugucccaagcggaaagagaagauugaggaaacagagcuuuaccugaaccucgaaagaaucccuuggguugugcgcaaacugcugcaggucagcgagucuaccgggguggcccuuaagcgguccagcuggcucgugauccugcugguucuccugacagucucucuuucccccgugcaaagcgcuccuauuucccauggcgaaaccguggaggucuaucagacgagagagggauacacaagcaucugccuguuugugcucggcucuauucuguuccugguuagcugucuuaugaaagggcucguggauuccgucggaaauagcuuuuuccccggccugagcaucugcaagaccuguuccauugggucuaucaacggauuugaaauugagagccacaaaugcuauuguucccuguucugcuguccuuacugccggcauugcucugccgacaucgaaauccaccgccuccaccugagcauuuguaagaagagaaaaaccggcuccaaugugaugcuugcuguuugcaagcggauguguuuuagagccacaguggaggucagcaacaaagcgcugcucauccgcaauauuaucaacaccacguucgugguuugcauucugauccuggccgugugugucgugucuacauccgcuguggaaauggagaaucuuccggccgggaccugggagaaggaagaggaucugacaaacuucugccaucaggaaugucaagucaccgagacagagugccucugucccuaugaagcucugguucuccggaaaccucuguuucuugacagcaucgugaagggcaugaagaaucugcucaacucuaccucccuggagacgagccuguccauugaagcccccuggggagcgaucaaugugcagucuaccuucaaaccuacagucagcgccgcuaacauugcccuuuccuggagcucuguggagcacagaggcaacaagauccugguuuccgggcgcagcgaaucuauuaugaaacucgaggagagaaccggaaucagcugggaucugggcguggaagacgcuuccgagucuaagcuccugacagucagcgugauggaucuuucccagauguacucucccguuuuugaauaucugagcggggaccgccagguggaggaauggccgaaagcuaccugcacgggagacuguccugagcggugcggcugcacauccagcaccugucuccauaaggaguggccccacucuagaaauuggcggugcaaccccacaugguguuggggagucggcaccggaugcaccuguugcggccuggaugugaaggaccuguucacagauuacauguuuguuaaauggaagguggacuacaucaaaacggaagccauugucuguguggagcuuaccucccaagaacgccagugcagccugaucgaggccgggacaagauucaaucucggaccugugaccauuacacuguccgaaccccggaacauccagcagaagcucccuccggagauugucacccugcauccccgcaucgaggaaggcuuuuucgaucuuaugcacauucaaaaaguucugucugcgagcacgguguguaagcugcaguccugcacacacggggugccuggagaccuccagaucuaucauaucggcaaucugcuuaagggcgauaaagucaacgggcaccugauucauaagaucgagccccacuuuaauaccucuuggaugagcugggacggaugugaucucgacuacuauugcaacaugggcgauuggccuuccugcagcuacaccggggugacacagcauaaucacgccgcuuucguuaacaugcugaauauugaaaccgacuauacaaagaacuuucacuuccauucuaagagagugacggcccacggagauaccccgcaacucgaccugaaagcccggccgacauacggcgcuggggagaucaccguccuuguggagguugccgacauggaacugcauacaaagaaaauugagaucuccggacugaaguuugcgagccucaccuguacgggcugcuaugcuuguucuuccggcaucagcugcaaggugcgcauucacgucgaugaaccugacgagcugaccgugcacgucaaaucugaagaucccgacaucguggccgccagcuccucucuuauggcuagaaagcuggaguucgggacagauagcaccuucaaagccuuuuccgcgaugccuaagacaagccucuguuucuacauuguugagcgggaauacugcaaauccuguucuaaggaggacacccagaagugcgugaauacaaaacuggaacagccccaaagcauccucauugagcauaagggaacgaucuuuggcaaacagaacgauaccuguacagcuaaggccuccugcuggcuggaaucugucaaaucuuucuuuuaugggcuuaagaauaugcuguccggaaucuucggcaacguguuuauugggguuuuccuguuucucgccccuuucaucaugcugauucuuuucuuuauguucggauggagaauccuguuuuguuucaagugcugccgccggaccagaggccucuuuaaauaccgccaccugaaggacgaugaggagauuggcuaucggaaaaucauugaaagacucaacaauaagaaagggaagaacaagcugcuugacggagagcgccuggcugaucggaaaaucgccgaacuguucucuaccaagacacauaucggcuga

SEQ ID NO: 13562 - RNA, 5070 nt, Artificial Sequence
  derived and/or modified CDS sequence (opt5) from CCHFV(SPU 44/08)__KJ682805.1__GP
augcccuucaacaucauguacaccccucugcucugcgccauucugugucuucagcuguggagccucgagggcaucuaugggcuguccaauaacacacaacacaaugacacgucuaccauuaaggugccggaagagagccagaaaacaucccuucccgcuaacaccgccucuccuaucacaagcgaucccccucccaccacaccuaccgcguccgcuucuggaccggaaggcagcggggacacguccaccagcccgccugucacaacccagggacccacaccucccgagaccacgccggaaccucauacaaccauugauaucgacaagucuuccacagccaucgccgauauuagcacccagaccguuaaaaauauccccacaccuacggcucacaccucucugcccuccacacucagcgcccccaccaugccucaagaggcucaucacacagccagaggccugcugucugugaccuccacgaagccgggggaggcgagcacacccaccuccccuggagaagccucuaccgaggcuagcagcccccagccuacaauucgggaaacccccagcccgccucccacaacgcagaccccuacagagaucaacaaucccaacaccucucgccagccuaugcccuccacacaaccggccgcuccuagcucugugacccaucccgcccagcccacgccuagccaguccgacgucccgaccgcggcccaggauauucaccccucuccuacaaauagaagcaaacggaaccucgagauggaaaucauucugacccuuucccaaggccugaagaaguacuauggcaaagugcucaagcugcuugaccugacacucgaggaagauaccgaggggcugcuggaauggugcaaacgcaaucucggacugacgugugacgauaacuuuuuccagaagagaaucgaggaguuuuuccuuacaggcgaagggcacuuuaaugagguucugcaguucaaaacccccagcacacucucuccuaccgaacccgcucggguggaguccccuaccgucgaacccuuuaagagcuacuucgccaagggauuucugcuuauggacucuggcuauuucuccgcuaaaugcuaccccaagagcuccaacucugggcugcaacucaucaaugugacacagcaucugauucgcaucacggauaccccuggacccaaaauuacaaaccugaagaccaucaacuguauuaaucucaaagcccugguuuuuaaggagcacagagagaucgaaaucaacgugcuucugccucaggucgccgugaaucucagcaacugccaugugcugauuaaaucccacgucugugacuauucuaucgacauugauggccccguucggcuuccgcgcauccaccaugagggcacauucauuccugggaccuacaagaucgugaucgacaagaaaaauaagcagaacgauagaugcacgcuggugacaaauugugucauuaaaggacgggaaauccgcaagggccaaagcgugcucagacaguaccggaccgagauuaaaaucgggaaggcuuccagcggaucucgcagacugcuguccgaagagagcaacgacgauugccucucucggacccagcugcuuagaacagagaaugcggaaauucacuccgacaacuauggcgggcccggagauaagaucaccauuuguaauggcagcacaaucguugaccagcgccugggcucugagcucgggugcuacacgaucaaccgggugaaauccuuuaagcugugcgaaaauuccgccaccggaaaaagcugugagauugauucuacaccugucagaugccgccaaggcuucugucugaagaucacccaggaggggcggggacaugugaaacuuuccagaggcagcgaaguugugcucgacgcuugcgauuccucuugugagauuaugauccccaaggggacaggcgacauucuggucgacugcagcggaggccagcagcacuuccugaaggauaaccucguggaccuggggugucccaauaucccucuucugggaaaaauggccaucuauauuugccgcauguccaaccauccgaagaccacgauggccuuucucuucugguuuucuuucggcuacgucaucaccuguauucugugcaaagcuaucuuuuaucugcuuauugugguugggacacucggaaagaaauucaagcaauaccgggaacugaagccccagaccuguacaaucugcgagaccaacccugugaaugccaucgaugcggaaaugcacgaccugaacugcagcuauaauauuugucccuacugcgcuuccagacucacaucugauggccuggcccgccacgucaugcaguguccuaaacggaaggagaaaaucgaggaaaccgagcuuuaccugaaccucgaacgcauucccugggugguuagaaagcugcuucaggugagcgaguccacgggggucgcccugaaacggagcucuuggcucgugauccugcuggugcuccugacaguuucccuuagcccuguccaaucugcuccgauuucccauggcgaaaccguggagguguaucagaccagagagggauacacaagcaucugccuguuuguccucggcucuauccuguuccugguguccugucuuaugcgggggcucguugacagcguguccaauagcuuuuuccccggacugucuauuugcaagaccuguagcaucggcuccauuaacggguuugaaaucgagucucacaaaugcuauuguagccuguucugcuguccuuacugccgccauugcuccgccgauauugaaauccacaagcuccaccugucuauuuguaagaaaagaaagacgggaagcaaugucaugcuugcugugugcaaacggauguguuuuagagccacaguugagguguccaacaaggcgcugcucauccgcaauaucauuaacaccacauucgucgugugcauccugauucuggccguuuguguggucucuaccagcgcuguggaaauggagaaucuucccgccggcacaugggagaaagaagaggaccugaccaacuucugccaucaggaaugucaagugacggagaccgagugccucuguccuuaugaagcucugguccuccggaagccccuguuucuugauuccaucguuaaggggaugaaaaaucugcucaacagcacaucucuggagaccucccugagcauugaagccccguggggcgcgaucaaugugcagucuacauucaagccuaccguguccgccgcuaacaucgcccuuagcugguccucugucgagcacagaggaaacaaaauucuggugagcggccgcuccgaaagcaucaugaagcucgaggagagaacggggauuucuugggaccugggaguugaagaugcuuccgagagcaaacuccugacagugucugucauggaccuuagccagauguacucccccguguuugaauaucugucuggcgaucggcagguugaggaauggcccaaggcuaccugcacaggggacuguccugagcgcugcggaugcaccagcuccaccugucuccauaaggaguggccccacucuagaaauuggcggugcaacccuacaugguguuggggcguggggacgggcugcaccuguugcggacuggacgucaaagaucuguucacagacuacauguuugugaaguggaaaguugauuacaucaagaccgaagccauugugugugucgagcuuacaagccaagaacgccagugcucccugaucgaggccggcaccagauucaaucucgggccggugacgaucacacugagcgaaccccggaacauucagcagaaacucccucccgagaucgugacccugcauccucgcauugaggaaggauuuuucgaccuuaugcacauccaaaagguccugucugcguccaccguuuguaagcugcagagcugcacacacggcgugcccggggaucuccagauuuaucauaucggaaaucugcuuaaaggcgacaaggugaacggccaccugauucauaaaaucgagccgcacuuuaauaccuccuggaugucuugggaugggugugaccucgauuacuauugcaacaugggagacuggccuagcugcuccuacacaggcgucacgcagcauaaucacgccgcuuucgugaacaugcugaauaucgaaaccgauuauacaaagaacuuucacuuccauucuaaaagaguuaccgcccacggggacacaccccaacucgaucugaaggcccggccuaccuacggagcuggcgagauuacggugcuugucgagguggccgacauggaacugcauaccaaaaagaucgagauuagcgggcugaaguuugcgucccucacauguaccggaugcuaugcuuguagcucuggcaucuccugcaaaguucgcauucacguggacgaacccgaugagcugacaguccacgugaagucugaagacccugauaucgucgccgccucuuccagccuuauggcuagaaaacuggaguucggcaccgacucuacauucaaggccuuuagcgcgaugcccaaaacgucccucuguuucuacaucguggagcgggaauacugcaagucuuguagcaaggaggauacccagaaaugcguuaauacaaagcuggaacagccgcaauccauucucaucgagcauaaagggaccauuaucggaaagcagaacgacaccuguacagcuaaagccagcugcuggcuggaauccauuaagagcuuuuucuauggccuuaagaauaugcugagcgggaucuuuggaaacguguucaucggcauuuuucuguuccucgccccuuuuaucaugcugauucuuuucuuuauguucggguggagaauccuguucuguuuuaaaugcugccgccggacgagaggacucuucaaguaccgccaccugaaagaugacgaggagauuggcuaucggaagaucauugaaagacucaacaauaaaaagggcaagaacaaacugcuugauggggagcgccuggcugaccggaagaucgccgaacuguuuuccaccaaaacacauaucggauga

SEQ ID NO: 13563 - RNA, 5070 nt, Artificial Sequence
  derived and/or modified CDS sequence (opt5) from CCHFV(Matin)__AF467769.2__GP
augagcuucaacaucauguacacccugcuccugugcgccauucuuuguucccagcuguggucuagcgagggcauccacgggcucuccaaugaaacacaacauggaaacgcuucuacgauuaaggcccccgaggugagccagggccuggggcuuccugucuccaccgcgccgcccaucacaucugacccucccagcauuaccuccgcugccagcguuucuggaccugaaggcuccggggauacaaauaccagcccucccgugacaacccagggacugacgcucccggagaccacacuggaacugcucaccacaaccaacacgggcgccucuuccacagugaucgucgacgugagcacccagacaguuaaagauacccccgugucuaccgcucacacauccccucccggcacgccuagcgcccccaccacaccgcaagggacccaucacacagcuagaggacugcuuuccgucaccucuacgaaguccgaggaggccuccacacagaccaauccuaaaaagaccagcauggaaacaaacucucccggcccugcgaccuccgagacacccagccccucuccuacgacccaggccccgacagaaaauaacaaucccaacaccccucggcagcccacaccucccacccaaccggcuacgccuagccccgugaccuccccugcccugcucgcuucuagccagggggacacauccaccgccguucaggaugugcaucccagcccuacaaaucgcucuaaaagaaaccuggagauggagaucauucuuacccugucccagggacucaagaaguauuacggcaaaauccugaagcugcucgaccugacgcuugaagaggauacagaagggcugcucgaguggugcaaacggaaucugggacuugucugugacgauagcuuuuuccaaaagcgcauugaagaguuuuuccugaccggcgagggccacuuuaacgaagugcuccaguucaaaacacccucuacccuguccccgaccgagccugcgagagccgggagccccacaguggaacccuuuaaguccuauuucgcucggggacugcucucuauggacagcggcuacuuuuccgccaagugcuauccucgcgcuucuaauagcgggcugcagcuuaucaacauuacgcaacacuccgccagaaucaccgauacaccgggacccaaaauuaccaaccugaagacaaucaauuguaucaaccucaaagccagcaccuucaaggagcaucgggaaauugagaucaauguccugcuuccucagguugcugugaaccugucuuccugccacgugcucauuaaaagccaugucugugacuacucucuggauaucgacggccccgugcgccugccucggauucaccacgaggggacguuuauccccggaacauauaagaucguuauugacaaaaagaauaagcagaacgauagaugcaccaucgugaccaauugugucauuaaaggccgcgaaaucagaaagggccaguccgugcuccggcaauacaaaacagagauuaagaucgggaaagcgagcucuggaagccgcagacugcuuuccgaagagagcggcgacgauugcaucucucggacccagcugcucagaacagaaacggccgagauucauuccgacagcuacgggggaccuggcgauaagaucaccauuuguaacggguccacaguuguggaccagcgccugggcucugagcugggaugcuauaccaucaaucgggucaagagcuucaaacuuugcgaaaacuccgcuacaggcaagucuugugagauugauagcacccccgugaaaugcagacagggguuuugucucaagaucacgcaagaaggacgcggccacgucaaacugucccgggggucugaggugguucuggacgccugcgauagcuccugugagauuaugaucccgaagggaaccggcgacauccucguggauugcagcgggggccagcagcauuuccugaaggacaaucuuauugaccugggauguccuaacaucccccuccugggcaaaauggccauuuacaucugcagaaugucuaaucacccuaagacaaccauggucuuccuguuuugguucuccuuuggguaugugauuacauguauccuuugcaaaguuaucuucuaccuccugauuguggucggaacccugggcaagaaauuuaagcaguaucgcgaacucaagccccaaacauguaccaucugcgagacgacaccggugaacgcuauugaugccgaaaugcaugaccugaauugcagcuacaacaucuguccuuauugcgcgucucggcuuaccuccgaugggcuggcuagacacgugaugcagugucccaaacgcaaggagaaaauugaagagaccgagcucuaccugaaccuggaacggaucccuuggguugucagaaagcugcuccaggugagcgagucuacaggaguggcccugaaacgcuccagcuggcuggucgugcuccugguucuucugaccgugucccucagccccguccagucugcccccaucggccacgggaagacgguggaaacauaccaaauucgggagggcuauaccagcguuugccuguucgugcugggauccauccuuuuuauugucucuugucucaugaaaggccugguggacagcgaugggaauagcuucuuuccuggacugucuaucugcaagacauguagcauuggcuccaucaacggguucgaaaucgagucucauaagugcuacuguagccucuuuugcuguccguauugcagacacugcuccaccgaccgggagauucauaaacugcaccuuagcaucuguaagaaacgcaagacaggaucuaauguuaugcuggcugugugcaaaagaauguguuuccgggccaccgucgaaguguccaacaaggcucuccugauuagaagcaucauuaauacgaccuuuguggucugcauccugauucuugccguuuguguggugucuacauccgcggucgagauggaaagccugcccgccggcaccugggagcgcgaagaggaucucaucaacuucugccaccaggagugucaggugacagaaaccgagugccuguguccuuacgaagcucucguucugcggaagccccuuuuccuggacuccaucauuaaagggaugaagaaucuccugaacucuacgagccuggagacaucccuuagcaucgaggccccuuggggcgcuauuaaugugcaaucuaccuuuaaacccacaauguccgccgcgaacaucgcccugagcuggucuagcgucgaacauagaggaaauaagauucucguguccggccgcucugagagcaucaugaaacuggaagagagaaccgggaucuccugggaucucggaguugaagacgcuucugagagcaagcugcuuaccguguccgucauggaucugagccagauguauucuccuguguucgaguaccucuccggcgaccggcagguugaagaguggccgaaggccacaugcacgggggauugucccgaacgcugcggaugcaccagcuccacaugucugcacaaagaguggccucauucuagaaacuggcggugcaaucccaccugguguuggggcgugggcacagggugcaccuguugcggacuggacgucaaggaccuuuuuacggauuauauguucgugaaauggaagguggaauacauuaaaacagaggucaucguuuguguggagcugaccagccaggaacgccaaugcucccucauugaggcuggcaccagauuuaaccuggggccugugacaaucacccucucugaaccccggaauauucagcagaagcugccgccugagaucgucacacuucacccccgcaucgaagagggauucuuugaccugaugcaugugcagaagguucugagcgccuccacgguguguaaacuccaaagcugcacccacggcguccccggggaucuucagguguaccacauuggaaaccuucugaagggcgacaaaguuaacggccaucucauccacaagauugagccucauuucaauacaucuuggauguccugggaugggugugaccuggauuauuacugcaacaugggagacuggcccagcugcucuuauaccggcgugacacagcacaaucaugccgcuuuugucaacaugcucuccaucgaaaccgauuacacgaaaaauuuccacuuucacagcaagagagugaccgcgcauggggacacaccucagcuggaucuuaaagcccggccgaccuauggagcuggcgagauuacaguccugguggaaguugccgacauggagcugcacaccaagaagaucgagauuucugggcucaaauucgccagccugacauguacgggaugcuacgcuuguuccucuggcaucagcugcaaggugcgcauccaugucgaugaacccgacgagcuuaccgugcacguuaaauccgaagacccugauauuguggccgcgagcuccucucugauggcuagaaagcucgaguuuggcacagacagcaccuucaaagccuucuccgccaugcccaagaccucucuguguuuuuauaucgucgaacgggaguacugcaagagcuguuccaaagaggauacacaaaagugcgugaacacgaaacucgaacagccucagucuauucugaucgagcacaaggggaccauuaucggaaaacaaaaugacacauguaccgcuaaggccagcugcuggcuugaauccguuaagagcuucuuuuacggccugaaaaacaugcugucugggaucuucggaaauguguuuauuggcaucuuccucuuucuggcgcccuucgcccuucugauucucuuuuucauguuuggguggagaauccuguucuguuucaagugcugccgccggacaagaggacucuuuaaauaucgccaucugaaggaugacgaggaaaccggcuaccggaaaauuaucgagagacuuaacaauaagaagggcaaaaacaagcugcuggauggggagcgccucgcugaccggaaaaucgccgaacuguucuccacgaagacacacgucggauga

SEQ ID NO: 13564 - RNA, 5070 nt, Artificial Sequence
  derived and/or modified CDS sequence (opt5) from CCHFV(TADJ/HU8966)__AY179962.1__GP
augcccgugagcaucaugcacaugcugcucaugugcgccguccugugucuucagcuguacggccucgggggaacccugagauccaacaauggcacagagcauaacaagacgaauguucuuaccacaccuggggacaaacugucuccggaacccccugugagcaccgcucuccccgugacaccugauuccucuaccgucacacccaccacgccugccagcggacuggagggcuccggggaaguguauaccucuccgcccauuacaaccaagggacugagcccuuccgaggcgacaagcgaacccccugcuaccacgggcaugggcaucucuuccgccagcgggguugacuucucuacacaagccgcucgggauaccuccacacucaccgugcugaccagcccgcccaacucuccuaauacacccccuacgucccaggacacccaccaucccguccgcagccuucuguccgugacaucucccagaccugaggagaccacagccccgagcaaauccggaaaggaaagccccgcugccaacucuucccacccuguuaccagccggcccucuagcccucucauuacggugcgcggccccacagaaaauuccucucauaacaccaccgggcagcuggaaagcaugacacaguccaccacacuugucccgauggcgagcccuacgcaaaccgugcugucucaguccgugacaagcaucgccguccaggaugcucaccccucuuccaccaauagaagcaaacggaaccucgagauggagauuauccugacacugccucagggacucaagaaguacuauggcaaaguucugcgccuucugcaacucacccuggaagaggacacggaagggcuucuggaguggugcaagagaaaucucggacuggauugugacgauaccuuuuuccagaaacggaucgaagaguuuuucauuacaggcgagggccacuuuaacgaagugcugcaguuccgcacccccgggacacucuccaccacggagucuacacaugccggaagcccuaccgcugaacccuuuaaguccuacuucgccaaaggcuuucugucuaucgacagcggguauuucuccgcgaagugcuacagcagaacaucuaauuccggacuucggcugauuaacgugacccgccacagcaccagaaucgccgauacaccgggcccuaagauuacgaaucucaaaaccaucucuuguauuaaccugcgggcuuccaucuuuaaggagcaucgcgaagucgagaucaacgugcuucugccccagguugccgugaaucucagcaacugccacgucgcuauuaaaucucacgugugugacuauagccuggauguugacgggacagugagacugccccauauccaccauggaggcaccuucauuccuggcacauacaagaucgucauugacaaaaagaauaaacucaacgaucggugcacccuguuuacgaauugugugaucaaggggagagagguccgcaagggacaauccauccuucggcaguacaaaacagaaauuagaaucggcaaggccagcaccgggucucgccggcugcucuccgaggaaagcggagacgauugcauuuccagaacccagcugcugcgcacagagaccgccgaaauccacggcgacgauuaugggggcccgggagacaaaauuacaaucuguaacggcucuacgaucguggaucaacggcuugggagcgagcucggaugcuacaccauuaauagaguuaaguccuucaaacugugcgagaacucugcuacaggcaagaauugugaaaucgacagcgugcccgucaagugccgccagggguauugucugaaaauuacccaggagggacggggccaugugaagcucuccagagggucugaaguugugcuggaugcgugcgacagcuccugugaggucaugaucccuaaaggcacaggagauauuagcguggacugcucuggcgggcagcaacacuuccuuaaggacaaccugaucgaucucggaugucccaaaauuccucugcugggcaagauggccaucuacaucugccgcauguccaaucaccccaagaccacgauggcuuuucuuuucugguuuagcuucggguaugugauuacccggauccucuguaaagccaucuuuuaccugcugauuauuguuggaacacucggcaagagauucaaacaguaucgggagcugaagccucagaccugcacaaucugugaaaccacacccgccaacgcuaucgacgccgagaugcaugaucuuaauugcucuuacaacauuugcccguacugugcgucccgccugaccagcgacgggcucgcuagacacgucacgcagugcccuaaacggaaggaaagaguggaggaaacagagcuguaucugaaucuugagcgcauccccuggauugugcggaagcuccugcaagucucugaauccaccggcguggcccugaaaagaagcuccuggcucaucguucugcuugugcuguuuaccgucagccucucuccugugcagagcgcccccauuggauacggcaacacaaucgagaccuaucaggcucgcgaagaguacacguccaucugucuguucguucuggggucuauucuuuuuaucgugagcugccucaugaagggacuggucgauuccauuggcaacaucuucuuuccggggcugacaauuuguaaaaccugcucuaucggaagcaucaauggcuucgaaauugagucccauaaguguuauugcucucuccuguguugcccuuacuguagacacugcagcgccgaccgggagauccaccagcuucaucuguccauuugcaaaaagcgcaaaacagggagcaacgugaugcucgcuguuuguaagagaaugugcuuucgggccaccauggaagugucuaauaaggcgcugcugauccgcuccauuaucaacacaaccuucgucguguguauucuuauccuggccgugugcaucgucagcacgucugcuguugagauggaaucccuccccgccggcaccugggagagagaagaggaucugacaaauuucugucaccaagagugccaggugaccgaaacagagugucucugcccuuaugaagcucuggugcuucggcgcccccuguuucucgacagcauugucaaaggaaugaagaacccccugaauagcaccucucuggagacgagccuuuccaucgaggccccuuggggcgcgauuaacgugcagagcacauacaaaccgaccguuucuacagccaauaucgcucuguccuggagcucuauugaacauagagggaacaauauccucgugagcggacgguccgagucuaucaugaagcuggaggagcgcaccggcauuagcggggaucucggagucgaagacgccuccgagucuaaacugcuuaccgugagcguuauggaucugucccagauguacagccccguguucgaguaucucucuggcgacagacaagucgaagaguggccuaaggcuacauguacgggcgauugccccgaacggugugggugcaccuccagcacaugccugcacaaggaguggccucauuccagaaacuggcgcuguaaucccaccuggugcuggggagugggcacaggguguaccugcuguggacuggacguuaaagaccuuuuuaucgauuacauguucgugaaguggaaagucgacuauauuaagacggaagccaucgugugcguggagcugacaucucaggagcggcaguguagccucgucgaagccggcaccagauuuaaccuggggccuguuaccauuacacucuccgagccgcgcaauauccaacagaaacugcccccugaaaucauuacccuucacccccggaucgaggaaggauucuuugaucugaugcacgugcagaaggugcugucugcuagcacagucugcaagcuccaguccuguacgcauggcgugccuggcgaccugcaaguuuaccacauugggaaccuucugaaaggagauaaggagaacggccaucucauccacaaaauugagccccauuucaauaccagcuggaugucuugggacgggugcgaucuggacuauuacuguaacaugggagauuggccguccugcacauauaccggcgugacacagcacaaucacgcgagcuuugucaaccuccugaauaucgaaaccgacuacacgaagucuuuccauuuucacuccaaaagagugaccgcccauggggauacaccucagcuugaccugaaggcucgccccaccuacggagccggcgagauuacaguucugguggaagucgccgauauggagcuccacaccaagaaaaucgagaucacaggccugaaguucgcuagccuuacgugcaccggguguuaugccugcucuagcggaauuuccuguaaagugcggauccacgucgacgaacccgacgagcugacagugcauguuaagucugaugacccugauguggucgcggcuagcuccagccucauggccagaaaacuggaauuuggcaccgacuccaccuucaaggccuucucugcuaugcccaaaacaagccucugcuuuuacauuguggagcgcgaauaucggaaguccuguucuaaggaggauacgcagaaaugcguuaacaccaagcuggagcaaccucagagcauccuuauugaacacaaagggacaaucaucggaaagcagaauaacaccuguacagccaaagcguccugcuggcuggagucugugaaguccuucuuuuacggccugaagaauaugcucuccgggauuuucggaaacgucuuugugggcaucuuccuguuucuugcuccguucauucugcucauccuguuuuucauguuuggcuggcggauucucagcuguuucaaaugcuguagacgcaccagagggcugcuuaagcaucggcaccugaaagacgaugaagagacgggauaucgcagaaucaucgaacggcugaauaacaagaaaggcaagaauaagcuccuggacggggagagacuugccgaucgccggauugccgagcuguucucuacaaaaacccauaucggauga

SEQ ID NO: 13565 - RNA, 5070 nt, Artificial Sequence
  derived and/or modified CDS sequence (opt5) from CCHFV(88166)__AB069675.1__GP
augagcuucuccgugauguacacaccccugcucugcgccguccugugucuucagcuguggucucucgagggcagccacgggcuguccaacaagacccaacauucuaauacgagcaccacaaaagcuccugaaguuucccaggagcuuggacugccggugucuaccgugagcacaaucaccuccgaucccccuagcauuacaucugccgucuccgugagcggcucugaaggguccggagacaccaacacgagccccucuguuaccacacagggcccuacccuccccgagacaacccuggaaccucugacgacaaccgacacagaugcguccagcaccguggucguggacguuuccacccagacagugaaggauacgccgaucucuaccacauauaccagccuccccuccacaccuagcgagcccaccacgccucaagggacacaccauaccgcuagaggacugcuuucugucaccuccacaaaacccgaggaagccagcacccaggccaauccgggcaagauuucuauggagacaaacagcccucggcuggcuaucuccgaaacgcccucuuuuagcccuaccacacaggcccccaccgaaaauuccaaccccauuacaagcaaacagcucaugcugucugcucaaccugugaccccgaaucccaugacguccccugugcagcccgcccuuagccagucugacaccuccacagcgauccaggauauccacccuagccccaccggccgcuccaagagaaaccuggagauggaaauuauccucacacugucucaagggcugaagaaauacuauggaaagauucucaaacugcuugaccugacccucgaggaagauacggagggccugcuugaauggugcaagcggaaucuggggcucgucugugacgauaacuucuuucagaaacgcaucgaggaguucuuucugacaggaaagggccauuucaaugaaguucugcaguuuaagaccccgagcacacucuccccuaccgggcccgccagaaccggaucuccuacaguggagcccuucaaaagcuacuuugcuaagggcuuccuguccauggacagcggcuauuuuucugccaaaugcuacccucgggcuuccaacagcgggcuucaacugauuaaugugacgcagcacucuacccgcaucacagauacccccggaccgaagauuacaaaccucaaaaccaucaauuguaucaaccugaaggccuccgucuucaaagaacacagagagauugaaaucaacgugcuucugccucagguugcggugaaucucagcucuugccauguccugauuaagagccacgugugugacuauucccuggacaucgauggccccguucggcucccccgcauucaucacgaggggacguuuaucccuggaacauacaagaucgugauugacaaaaagaacaaacagaaugauagaugcacccuggucaccaacugugugaucaagggccgggagauucgcaaagggcaaagcguccuuagacaguaccggacagaaaucaagauuggaaaggccucuuccggcagccgcagacugcucuccgaggaaucuggcgacgauugcaucagccggacccagcugcugagaacagagacggcugaaauccacuccgacaauuaugggggaccgggcgauaaaauuaccaucuguaacgggucuacagugguugaccagcgccuuggaagcgagcucggcugcuacaccauuaaucgggugaaguccuucaaacugugcgagaacucugccacaggcaagagcugugaaaucgauuccacccccgucaaaugcagacaaggguucugucugaagauuacgcaggagggacgcggccaugugaagcucagccgggggucugaaguugugcuggacgcuugcgauuccagcugugagaucaugauuccuaaaggaaccggcgacauccuugucgacugcucugggggacagcagcacuuucugaaggauaaucucaucgaccugggcugucccaacauuccucugcuugggaaaauggccaucuauauuugcagaauguccaaucaucccaagacaaccaugggcuuccucuuuugguucagcuuuggauacguggugacauguauccugugcaaaguuauuuucuaucugcucaucgucgugggcacccuggggaagaaguuuaaacaauaccgcgagcuuaagccucagacauguaccaucugcgaaacgacacccgugaacgccauugaugcugagaugcacgaccugaauugcucuuauaacaucuguccguacugcgcgucccggcucaccagcgauggacuggccagacaugucaugcaguguccuaaacgcaaggaaaagauugaggaaaccgagcuguaccuuaaucucgagcggauccccugggugguuagaaagcugcuucagguguccgaaagcacaggcgucgcucucaaacgcucuagcuggcuggugguucuucuggugcuccugaccgucucccugucuccugugcaaagcgcccccauugggcacggaaagacgguugagacauaucagacccgggaaggcuacacauccaucugccuuuucgugcucgggucuauccuguuuauugucagcugucugaugaagggccucguggacuccgugggaaacucuuucuuuccgggccugagcaucugcaaaaccuguuccauugggagcgucaacggauucgagaucgaaucucacaagugcuauuguucccuguuuugcuguccuuacugcagacauugcagcgccgaucgggagauucaccgccugcaucucucuaucuguaaaaagagaaaaacaugguccaauguuaugcuggcugugugcaagcggauguguuucagagccaccguggaggucagcaacaaggcgcugcuuauccgcaauauuaucaacacgaccuucgugcugugcauucucauccuggcuguuuguguggucuccacaucugccguggaaauggagagccuccccgccggcaccugggaacgggaggaagaccugacaaauuuuugccaccaggagugucaaguuaccgagacggaaugccuuuguccuuaugaggcucuggugcucagaaaaccccuguucuccgauagcauugucaaggggaugaaaaaccugcuuaauucuacaucccuggaaaccagccucucuaucgaggcccccuggggagcuauuaacgugcagagcacauuuaagccuaccauguccgccgcgaauaucgcccugucuuggagcuccguugagcaccgcggcaacaaaauccucgugucugggagaagcgaauccauuaugaagcuggaggaacggaccggcaucagcuggaaucuuggagucgaggacgcuucugaauccaagcugcucacagugagcgugauggaucugucccagauguacucuccggucuucgaguaucugagcggcgaccgccagguugaggaauggcccaaagccacgugcaccggggauuguccugagagaugcggaugcacauccucuaccugucuucauaaggaauggccccacagccggaacuggcgcugcaauccuacaugguguuggggcguggggaccggaugcacguguugcggccuggacgugaaagaccucuuuacagauuacauguucauuaaguggaaagucgaguacaucaagaccgaagcuauuguguguguugagcugaccucccaagagagacagugcacacucaucgaagccggcacccgguuuaaccuggggcccgugacaaucacgcuuagcgagccucgcaauauucagcagaagcugccgcccgaaaucgucacccugcauccuagaauugaggaaggauucuuugaccucaugcacgugcaaaaaguucugucugcguccacaguguguaaacuucagagcugcacccauggcguccccggggaucuccagguguaucacaucggaaaccugcugaaaggcgacaaggucaacgggcaccucauucauaaaaucgagccucacuucaauacaucuuggauguccugggauggaugugaccuggauuacuauugcaacaugggcgacuggcccagcugcaccuacacgggcgugacccagcauaaucacgccgcuuuuguuaacaugcuuaauaucgagacagauuauaccaagaacuuccauuuucacucuaaacgggugacagcccacggggacaccccgcaacuggaucugaaggcucgcccuacauacggagccggcgaaauuacgguccucguggagguugccgacauggaacugcauaccaagaaaaucgagauuagcgggcuuaaguucgcuucccugacauguaccggaugcuaugcguguucuagcggcaucuccugcaaagugcggauucacgucgaugagcccgacgaacucaccgugcauguuaagagcgaggaccccgaucugguggccgcuuccucuagccucauggccagaaaacuggaguucgggacagacuccacguuuaaggccuucucugcuaugccuaagaccagccuuuguuuuuacaucgucgagagagaauacugcaaauccuguucuaaggaggauacacagaaaugcgugaauaccaagcuggagcagccccaaagcauucugaucgaacacaaaggaacaaucauuggcaagcagaacaauaccuguacggccaaggcguccugcuggcucgagagcgugaaaucuuucuuuuauggccugaagaacaugcuuuccgggaucuucggaaaugucuuuauuggcguguuccuguuuuucgcuccuuuuauccuccugauucucuucuucauguuuggguggcgcauccuguucuguuuuaaaugcugccggagaacacgcggacuuuucaaguaccggcaccugaaagacgaugaagagaccggcuauagaaagaucauugaacgccugaacaauaagaaagggaagaacaaacuccuggacggagagcggcuugccgauagaaagaucgccgagcuguuuagcaccaaaacacauauuggcuga

SEQ ID NO: 13566 - RNA, 5070 nt, Artificial Sequence
  derived and/or modified CDS sequence (opt5) from CCHFV(8402)__AB069674.1__GP
augagcuucuccgugauguacacaccccugcucugcgccguccugugucuucagcuguggucucucgagggcagccacgggcuguccaacaagacccaacauucuaauacgagcaccacaaaagcuccugaaguuucccaggagcuuggacugccggugucuaccgugagcacaaucaccuccgaucccccuagcauuacaucugccgucuccgugagcggcucugaaggguccggagacaccaacacgagccccucuguuaccacacagggcccuacccuccccgagacaacccuggaaccucugacgacaaccgacacagaugcguccagcaccguggucguggacguuuccacccagacagugaaggauacgccgaucucuaccacauauaccagccuccccuccacaccuagcgagcccaccacgccucaagggacacaccauaccgcuagaggacugcuuucugucaccuccacaaaacccgaggaagccagcacccaggccaauccgggcaagauuucuauggagacaaacggcccucggcuggcuaucagcgaaacgcccuccuuuucuccuaccacacaggcccccaccgagaauagcaaccccauuacauccaaacagcucaugcugagcgcucaaccugugaccccgaaucccaugacgucuccugugcagcccgcccuuucccagagcgacaccucuacagcgauccaggauguccacccuucccccaccgggcgcagcaagagaaaccuggagauggaaaucauucucacacugucccaaggacugaagaaauacuauggcaagauccucaaacugcuugaccugacccucgaggaagauacggaggggcugcuugaauggugcaagcggaaucugggacucguuugugacgauaacuucuuucagaaacgcauugaggaguucuuucugacaggcaaggggcauuucaaugaagugcugcaguuuaagaccccgucuacacucagcccuaccggacccgccagaaccggcuccccuacaguggagcccuucaaaucuuacuuugcuaagggcuuccugagcauggacuccggguauuuuagcgccaaaugcuacccucgggcuucuaacuccggacuucaacugaucaaugucacgcagcacagcacccgcauuacagauacccccggcccgaagaucacaaaccucaaaaccauuaauuguaucaaccugaaggccucuguguucaaagaacacagagagaucgaaauuaacguucuucugccucagguggcggucaaucucuccagcugccaugugcugaucaagucucacguuugugacuauagccuggacauugaugggcccgugcggcucccccgcauccaucacgagggaacguuuauuccuggcacauacaagaucgucaucgacaaaaagaacaaacagaaugauagaugcacccuggugaccaacugugucauuaaggggcgggagauccgcaaaggacaauccgugcuuagacaguaccggacagaaauuaagaucggcaaggccagcucuggcucccgcagacugcucagcgaggaauccggggacgauugcauuucucggacccagcugcugagaacagagacggcugaaauccacaaugacaacuauggaggcccgggggauaaaaucaccauuuguaauggaagcacaguuguggaccagcgccuuggcuccgagcucgggugcuacaccaucaaccgggucaagucuuucaaacugugcgagaauagcgccacaggcaaguccugugaaauugauucuacccccgugaaaugcagacaaggauucugucugaagaucacgcaggagggccgcgggcauguuaagcucagccggggauccgaagugguccuggacgcuugcgauagcucuugugagauuaugaucccuaaaggcaccggggacauucuuguggacugcuccggaggccagcagcacuuucugaaggauaaccucaucgaccuggggugucccaauaucccucugcuuggcaaaauggccauuuauaucugcagaaugagcaaccaucccaagacaaccauggccuuccucuuuugguucucuuuuggauacgugguuacauguauucugugcaaagucaucuucuaucugcucauuguggugggcacccuggggaagaaguuuaaacaauaccgcgagcuuaagccucagacauguaccaucugcgaaacgacacccgucaaugcuaucgaugcggagaugcacgaccugaacugcuccuauaauauuuguccguacugcgccagccggcucaccucugauggacuggcuagacaugugaugcaguguccuaaacgcaaggaaaagaucgaggaaaccgagcuguaccuuaaccucgagcggauucccuggguugugagaaagcugcugcaggucuccgaaagcacaggcguggcccucaaacgcuccagcuggcugguugugcuucugguccuccugaccgugucucugagcccuguucaauccgcccccaucgggcacggaaagacgguggagacauaucagacccgggaaggcuacacaucuauuugccuuuucguccucgggagcauccuguuuaucguguccugucugaugaagggccucguggacucugucggaaacagcuucuuuccgggccuguccauuugcaaaaccuguucuaucgggagcguuaauggauucgagauugaaucccacaagugcuauuguagccuguuuugcuguccuuacugcagacauugcucugcugaucgggagauccaccgccugcaucucuccauuuguaaaaagagaaaaacaggcagcaacgugaugcuggccgugugcaagcggauguguuucagagcgaccgucgaggugucuaauaaggcucugcuuauccgcaacaucauuaauacgaccuucguucugugcauccucauucuggccgugugugucguguccacaagcgccguugaaauggagucccuccccgcugggaccugggaacgggaggaagaccugacaaacuuuugccaccaggagugucaagugaccgagacggaaugccuuuguccuuaugaggcccugguccucagaaaaccccuguucucugauagcaucgugaagggaaugaaaaaucugcuuaacuccacaagccuggaaaccucucucuccauugaggcucccuggggcgccaucaauguucagagcacauuuaagccuaccgugucugcggccaacauugcucugagcugguccucugucgagcaccgcgggaauaaaauccucgugagcggcagauccgaaucuaucaugaagcuggaggaacggaccggaauuagcugggaccuuggcguggaggaugccuccgaaagcaagcugcucacagucucuguuauggaccugucccagauguacagcccgguguucgaguaucuguccggggaucgccagguggaggaauggcccaaagcuacgugcaccggagacuguccugagagaugcggcugcacaucuagcaccugucuucauaaggaauggccccacucccggaacuggcgcugcaauccuacaugguguuggggagucgggaccggcugcacguguugcggccuggacgugaaagaucucuuuacagacuacauguucaucaaguggaaaguugaguacauuaagaccgaagccaucgugugugucgagcugaccucucaagagagacagugcacacucauugaagcggggacccgguuuaaccugggacccgugacaaucacgcuuagcgagccucgcaauauccagcagaagcugccgcccgaaauuguuacccugcauccuagaaucgaggaaggcuucuuugaucucaugcacgugcaaaaaguccuguccgccagcacaguguguaaacuucagucuugcacccaugggguccccggagaccuucagguguaucacauuggcaaccuccugaaaggggauaagguuaacggacaccucauccauaaaauugagccucacuucaauacauccuggaugagcugggacggcugugaucuggacuacuauugcaacaugggcgauuggcccucuugcaccuacacgggggugacccagcauaaucacgcugccuuugucaacaugcuuaauaucgagacagacuauaccaagaacuuccauuuucacuccaaacgggugacagcucacggagauaccccgcaacuggaccugaaggcccgcccuacauacggcgccggggaaaucacgguucucguggaggucgcugauauggaacugcauaccaagaaaauugagaucagcggacuuaaguucgcgucucugacauguaccggcugcuaugccuguagcuccgggauuucuugcaaagugagaauccacguggacgagcccgacgaacucaccguucaugucaagagcgaggaucccgacauuguggcugccuccagcucccugauggcccggaaacucgaguucggaacagauucuacguuuaaggcuuucagcgccaugccuaagaccucccuguguuuuuacaucguggaaagagaauacugcaaaucuuguagcaaggaggacacacagaaaugcgucaauaccaaacuugagcagccccaauccauucugaucgaacacaagggcacaaucauuggcaagcagucuaacaccuguacggcgaaggcuagcugcuggcuggaguccgugaaauccuucuuuuaugggcucaagaauaugcugucuggaaucuucggcaacguuuuuauugggguguuccuguuuuucgccccuuuuauccuucucauucuguucuucauguuuggauggcgcauccucuucuguuuuaaaugcugccggagaacacgcggccuguucaaguaccggcaccuuaaagaugacgaagagaccggguauagaaagaucauugaacgccugaauaacaagaaaggaaagaauaaacugcucgauggcgagcggcuggccgacagaaagaucgcugagcuuuuuagcaccaaaacacauauuggcuga

SEQ ID NO: 13567 - RNA, 5070 nt, Artificial Sequence
  derived and/or modified CDS sequence (opt5) from CCHFV(7803)__AB069672.1__GP
augcccgugagcaucaugcacauuucccugaugugcgccgugcucugucugcagcuuuacggccugggggagacccauggaucuagcaacgaaacagagcacaauaagacgaacguugugaccacaccuggcgacucccaaucuccggaaccccucgugagcaccacacugccugucacccuugauuccucuacagugacccccacgaccccugcuagcgagcccgaaggguccggagagguuuauacaagcccuccgaucaccacagagggccugucucccuccgaagccaccagcgagcucccugugacgacagggauuggaaucucuuccgcgagcgacgucgauucuuccacccaggcugccggcgacacaagcacccccaccgugagaacauccccucccaauucuccgagcacgccucccaccucccaggauacacaucacccuaugcggaaccugcugagcguuaccucucucaaauccgaagagacaagcgcccccucuaagagcggcaaagagucccccgcugccucuagcccucauccgguggcuuccagacccccuacccaccccauuacggcccaggggccuacagaaaauaacagccacaauaccaccggacaacuggagucugucacacaguccgcgacccuuggccccauggccagcccgacacagacggugcugucucagaacgugaccuccaucgcuauccaagacacacauccuagccccaccaaucgcuccaagcggaaccucgaaauggagauuauccugacacuuccucaggggcugaaaaaguacuauggaaagguccuccgccugcugcagcucacccuggaagaggauacggagggccuucuggaauggugcaaaagaaaucucgggcuggacugugaugacaccuucuuucagaagcggauugaggaguucuuuaucacaggagaaggccacuucaacgaaguucuucaauuucgcacccccggcacacugucuaccacggagagcacacaugccgaguccccuaccgcugaacccuucaaaucuuacuuugccaagggguuccucagcauugauuccggauauuuuagcgcgaaaugcuacucuagaacauccgacagcggccugcagcugaucaaugugacccggcacucuacccgcauugccgauacaccggggccuaagaucacgaaccucaagaccaucuccuguauuaaucugaaagcuagcguguucaaggagcacagagaagucgagaucaacgugcuucugccccagguugccgugaaccucucuaauugccaugucacaauuaaaagccacgugugugacuauucccuggacaucgauggaaccguucggcuuccccauauucaccaugaaggcacauuuaucccugggaccuacaagaucgugauugacaaaaagaacaaacugaaugaucgcugcacgcucuuuacaaacugugucaucaagggaagagaggugcggaagggccaaagcguccugcgccaguacaaaaccgagauuagaaucggcaaggcuucuaccgggucccggagacugcucagcgaagaguccggagacgauugcauuucucgcacacagcugcuucggaccgaaacagccgagauccacggcgacaauuaugggggaccgggcgauaaaaucacgauuuguaacgggagcaccaucguggaccagagacugggcuccgagaugggaugcuacacaauuaaucgcguuaagucuuuuaaacucugcgaaaacagcgccaccggcaaguccugugagaucgauucuauucccgugaagugccggcaaggguauugucugaaaaucacacaggaaggaagaggccacgucaagcugagccgcggguccgaggugauucuugacgcuugcgauagcucuugugaaguuaugaucccuaaaggaaccggcgacauccucguggacugcuccgggggccagcagcauuuccugaaggauaaucugauugaccucggaugucccagcaucccucugcuuggcaaaauggcgauuuacaucugccggaugucuaaccaccccaagacgaccauggccuuccuguuuugguucuccuuuggguaugucauuacauguauccucugcaaggcuaucuucuaccugcugauuaucgugggaacccuuggcaaaagauuuaagcaauaucgcgagcucaaaccucagacauguaccauuugcgagacaacccccgccaaugccaucgaugcugaaaugcaugaccugaacugcagcuacaauauuuguccguacugcgccucucggcugacguccgaugggcucgcgagacacgugacacaguguccuaagcgcaaagagaagguugaagagaccgaacuguaucuuaaccuggagcggauccccugggucgugagaaagcuccuucaggugagcgaguccaccggagucgcucugaaacggagcucuuggcuuaucgugcuccugguucuguucgccauuagccucuccccugugcaaucugcccccaucagccacggcaagacaauugaaaccuaccaggcucgcgaggaauauacguccaucugccuguuuguccuugggucuauucuguucaucgugagcugucucaugaaaggccugguugacuccaucggaaauauuuucuucccgggccugucuaucugcaagacauguagcauuggguccaucaacggauuugagauugaaagccauaaaugcuacuguucucuucucugcuguccuuauugcagacacugcuccgccgaucgggagauccaucagcugcaccugagcauuuguaagaaaagaaagaccggcucuaacgugaugcucgcugccugcaagcgcauguguuuccgggcgacaauggaggucuccaauaaagcccugcuuaucagaagcaucauuaacaccacauuugugguuuacauccugauucucgcugugugcgucguguccaccucugccguggaaauggagagccugcccgcugggacgugggaacgcgaggaggaccugaccaauuucugucaucaggaaugccaagucacagagaccgaaugucuuugcccuuaugaggcccugguucucagacggccccuguuccucgauuccaucgugcgcggaaugaagaacccccugaauagcacaucucuugaaaccucccugagcauugaggcgccuuggggcgccaucaacgugcagucuacguacaaaccgacagucagcaccgcuaauaucgcccucuccuggucuagcguggagcacagagggaacaagauucugguuuccggccggucugaaagcaucaugaaacuggaggaacgcacaggaauuuccugggaccuuggcguggaggaugcuagcgaaucuaagcugcucaccgucuccgugauggaccugagccagauguacucccccguuuuugaguaucucucuggggauagacaaguggaggaauggccuaaggccaccuguacaggagacugccccgagcgguguggcugcacgaccagcacaugccugcacaaagaauggccucauucccgcaauuggagauguaaccccaccuggugcuggggagucgggacaggcuguaccugcuguggccuugacgugaaggaucuguucacggacuacaugaucguuaaauggaagguggaguauauuaaaacacgggggaucgucugcguggaacucaccucucaggagcgccaguguagccugaucgaggccggaaccagauuuaaucugggcuccgugacaauuacccuuagcgaaccucggaacauccagcaaaagcugccgcccgagauuaucacacuccacccuagaauugaagagggguucuuugaucugaugcauguccagaagguucucucugcuuccacggugugcaaacugcagagcuguacccacggagugcccggcgaccuucaggucuaccauguggggaaucugcugaagggagauaaaguuaacggccaccucauccacaagauugagccucaucugaauacaucuuggauguccugggacggcugcgaucuugacuauuacuguaacaugggggauuggcccagcugcaccuauacaggagugacccaacacaaccaugcgucuuucgucaaucugcucaacaucgaaacggacuacaccaagagcuuucacuuccacuccaaacgcgugacagcccauggcgauaccccgcagcuggaccucaaggcucggccuacauacggggccggagagaucaccguucugguggaagucgccgauauggaguuuacacccaaaaagauugaaaucucuggccuuaaauucgcuagccugacgugcaccggguguuaugccugcuccagcggaauuuccuguaaggugagaauccacgucgacgagcccgacgagcugacagugcauguuaaaucugaugacccugauguggucgcggcuagcuccucucucauggcccgcaagcuggaauuuggcaccgacagcaccuucaaagccuuuuccgcuaugcccaagacaucucuuugcuucuacauuguggagcgggaauauuguaagagcugcuccaaagaggauacgcagaaguguguuaauaccaaacuggaacagccucaaagcauccucaucgagcacaagggcacaauuaucgggaaacagaacaauaccugcacagccaaggcgucuuguuggcuggaguccgucaagagcuucuuuuacggacucaaaaacaugcugucuggcauuuucgggaacuuuuucaugggaaucuuucuuuuccuggcuccguuuauucugcucauccuguucuuuauguucggcuggagaauccuguuuugcuucaaguguugccgccggaccagagggcuguucaaauaucgccaucucaaggacgaugaagagacgggauaccggagaauuaucgaacggcugaauaauaaaaagggcaagaacaaacuccuggacggcgagcgccuugccgauagacggauugccgaacuguuuuccacaaagacccacaucggguga

SEQ ID NO: 13568 - RNA, 5070 nt, Artificial Sequence
  derived and/or modified CDS sequence (opt5) from CCHFV(75024)__AB069671.1__GP
augcccgugagcaucaugcacauuucccugaugugcgccguccucugucugcagcuuuacggccugggggagacccauggaucuagcaacgaaacagagcacaauaagacgaacguugugaccacaccuggcgacucccaaucuccggaaccccucgugagcaccacacugccugucacccuugauuccucuacagugacccccacgaccccugcuagcgggcccgagggauccggcgaaguuuauacaagcccuccgaucaccacagaggggcugucucccuccgaggccaccagcgaacucccugcgacgacaggaauuggcaucucuuccgcuagcgacguggauucuuccacccaggccgccggcgacacaagcacccccaccgucagaacauccccucccaauucuagcuccacgccgccuaccagccaggauacacaucaccccaugcggaaccugcugucugugaccucccucaaaccugaggaaacaagcgcucccucuaagagcgggaaagagucccccgccgcuucuagcccucauccgguugccuccagacccccuacgcccccuacgacagcgcagggacccauugagaauaacagccacaauaccaccggccaacuggaaucugugacacaguccgccacccuugggccgauggcuagcccuacacagacgguccugucucagaacgugaccuccaucgccauccaagacacacaccccagcccuaccaaucgcuccaagcggaaccucgagauggaaauuauccugacacuuccccagggacugaaaaaguacuauggcaaggugcuccgccugcugcagcucacccuggaggaagauacggaggggcuucuggaguggugcaaaagaaaucucggacuggacugugaugacaccuucuuucagaagcggauugaagaguucuuuaucacaggcgaaggccauuucaacgagguccuucaauuucgcaccccugggacacugucuaccacggaaagcacacacgcugagucccccaccgccgagccguucaaaucuuacuuugcgaagggauuccucagcauugauuccggcuauuuuagcgccaaaugcuacucuagaacauccaauagcgggcugcagcugaucaacguuacccggcauucuacccgcauugcugacacaccuggacccaagaucacgaaucucaagaccaucuccuguauuaaccugaaagccagcguguucaaggaacacagagagguggaaaucaacguccuucugccccagguggcuguuaaucucucuaacugccacgugacaauuaaaagccaugucugugauuauucccuggacaucgacggcaccgugcggcuuccucacauucaucacgaggggacauuuaucccgggaaccuacaagaucguuauugauaaaaagaauaaacugaacgaccgcugcacccucuucacaaauugugugaucaagggcagagaaguccggaagggccaaagcgugcugcgccaguacaaaaccgagauuagaaucgggaaggccucuaccggaucccggagacugcucagcgaggaauccggcgaugacugcauuucucgcacacagcugcuucggaccgagacagccgaaauccauggggauaacuauggaggccccggggacaaaaucacgauuuguaauggcagcaccaucgucgaucagagacugggauccgagaugggcugcuacacaauuaaccgcgugaagucuuuuaaacucugcgagaauagcgcuaccgggaaguccugugaaaucgacucuauuccuguuaagugccggcaaggauauugucugaaaaucacacaggagggcagagggcacgugaagcugagccgcggauccgaagucgugcuugaugcgugcgacagcucuugugagguuaugauucccaaaggcaccggggauauccucguggacugcuccggcggacagcagcacuuccugaaggacaaccugaucgaucucggcuguccuagcauuccccugcuugggaaaauggccaucuacauuugccggaugucuaaucauccuaagacgaccauggcuuuccuguuuugguucuccuuuggauaugucaucacauguauucucugcaaggccaucuucuaccugcugaucauugugggcacccuugggaaaagauuuaagcaauaucgcgaacucaaaccccagacauguaccaucugcgagacaaccccggccaacgcuauugacgccgagaugcacgaucugaauugcagcuacaacaucuguccuuacugcgcgucucggcugacguccgacggacucgcuagacaugugacacagugucccaagcgcaaagaaaagguugaggaaaccgagcuguaucuuaaucuggaacggauuccuugggucgugagaaagcuccuucaggugagcgaguccaccggcgucgcccugaaacggagcucuuggcuuaucgugcuccugguucuguucgccaucagccucucccccgugcaaucugcuccgauugggcacggcaagacaaucgagaccuaccaggcccgcgaagaguauacgagcauuugccuguuuguccuuggauccauccuguucauugugucuugucucaugaaaggccugguugauagcaucgggaacaucuuuuucccuggacuguccauuugcaagacauguucuaucggcagcauuaacggguuugaaaucgagucccacaaaugcuacuguagccuucucugcugucccuauugcagacauugcucugcugaccgggaaauucaccagcugcaucuguccaucuguaagaaaagaaagaccggaagcaaugugaugcucgccgucugcaagcgcauguguuuccgggcgacaauggaggugucuaacaaagcccugcuuauuagauccaucaucaauaccacauuuguugugugcauucugauccucgcugucuguguggugagcaccuccgccgucgagauggaaucucugccugcuggcacgugggagcgcgaagaggaucugaccaacuucugccaccaggagugucaaguuacagaaaccgagugccuuugucccuacgaagcccuggugcucagacggccccuguuccucgacagcauugugcgcgggaugaagaaucagcugaacuccacaagccuugagaccucucuguccaucgaagcgccuuggggcgccauuaauguccagagcacguauaaaccgacagugucuaccgcuaacaucgcccucagcugguccucuguugagcauagaggaaauaagauccuggugagcggccgguccgagucuauuaugaaacuggaggaacgcacagggaucagcugggaucuuggagucgaagacgcuuccgagagcaagcugcucaccgugucuguuauggaucugucccaaauguacagccccguguuugaauaccucuccggcgacagacaggucgaggaguggccuaaggcuaccugcacaggggauugucccgaacggugcggaugcacgaccucuacaugucugcacaaagaguggccucacagccgcaacuggagaugcaaucccaccugguguuggggcgugggcacagggugcaccuguugcggacuugacguuaaggaccuguucacggauuauaugauugugaaauggaaggucgaauacaucaaaacagaggccauuguguguguggaacucaccucccaggagcggcagugcucucugaucgaggcuggcacccgcuuuaaccuggggagcgucacaaucacccuuuccgaaccuagaaauauucaacagaagcugccgcccgagaucauuacacuccauccucggaucgaagagggauucuuugaccugaugcacguucagaaggugcucagcgcgucuacgguguguaaacugcaguccugcacccauggcguccccggggaucuucaaguguaucacguuggaaaccugcugaagggcgacaaagugaauggccaucucauucacaagaucgagccucaccugaacacaagcuggaugucuugggaugggugugaccuugauuacuauugcaacaugggagacuggcccuccugcaccuacacaggcgucacccagcauaaucacgccagcuucgugaaccugcucaauauugaaacggauuauaccaaaucuuuucauuuccacagcaagagaguuacagcucacggggacaccccgcagcuggaucucaaggcccgcccuacauacggagccggcgagaucaccgugcuggucgaaguggcugacauggaguuuacacccaaaaagaucgaaauuuccgggcuuaaauucgccucucugacguguaccggaugcuacgcguguagcuccggcaucagcugcaagguccggauucauguggaugagcccgacgagcugacaguucacgugaaauccgacgauccugacgucguggcugccucuagcucccucauggccagaaagcuggaauuuggcaccgauucuaccuucaaagccuuuagcgccaugcccaagacaucccuuuguuucuauaucguugagcgcgaauacugcaagucuuguagcaaagaggacacgcagaagugcgugaacaccaaacuggaacaaccucaguccauucucaucgagcauaaggggacaaucauuggaaaacagaauaacaccuguacagcgaaggcuagcugcuggcuggagucugucaaguccuucuuuuauggccucaaaaauaugcugagcgggaucuucggaaaccuuuuuaugggcauuuuccuguuucuggccccguucauccuccugauucuguuuuucauguuuggguggcggauccuguucuguuuuaagugcugcagacgcacccggggacucuucaaauacagacaccugaaggaugacgaagagacgggcuaucgccggaucauugaaagacucaauaacaaaaagggcaagaauaaacugcuugauggggagcggcuggccgaccgcagaaucgcugaacuguucucuacaaagacccauauuggauga

SEQ ID NO: 13569 - RNA, 5070 nt, Artificial Sequence
  derived and/or modified CDS sequence (opt5) from CCHFV(66019)__AB069669.1__GP
augcccgccaacaucauguacacccugcucgugugcgcuguccuguguccucagcuuuggagccuggagggcacacacguuccgcauaaugaaacgaagcacaacgggaccggaauuacagccgcgcccggcgagucccaagggccuaugucucccgcuagcaccgccgugccucucacacccgaaccuccgaauaccaaacccgccgcuuccgccucugagcuggaaagcuccggagagggccauacaucucuucuggcuaccacgcaggggcucaccagcccugaggccacacccgaacugccuaccacaaccgacacgggaguguccagcacaucugucguggauaucggcacccagauggcgaaggacacacccaccuccaccgcccacacaagccugccgucuaacccuuccgcucccagcacggcccagggcacccaucacacaauuagagggcuccugucuguuaccuccacaaaaccugaggaagcuagcacccccacggaucccggaaaggccggcgcggagacaggguccccucggccggccaucucucgcaaacccacccuuagcccuaccgcugaggcccccacagaaauuaauaacuccagcaccccuaagcaacccgagccgucuauccagccugcuacacccucccuggugaucagcccugcccagcccgccuucccucagucugcuacgagcaccgcggcccaagacauuuauuccucucccacaaauagaagcaagcggaaccucaaaauggaaaucauucugacccuuucccagggacugaagaaauacuauggcaagauccagaaaacacucgggcugacccuggaggaagauacggagggacuccuggaguggugcaagcgcaaucuuggccugaccugugacgauaacuuuuuccagaagagaauugaagaguuuuuccucacaggcgaaggguacuuuaaugagguccugcaauucaaaaccccgagcacaccuggaucuaccgaacccacgcacacagaggcucccaccgugaagccuuuuaaauccuauuucgcccggggcuuucuuacaaucgacagcggguacuucucugccaagugcuauucccgcaccagcaacuccggacugcagcucauuaauguuacccagcauccggcuagaaucgccgauacacccggcccuaaaaucacgaaccugaagaccauuaauuguaucaaccugaaagcgucuguguuuaaggagcaccgggaaauugagaucaacguccuccugccccaaguggcugugaaucuuagcaacugccauguccugauuaagucccacguuugugacuacucucucgauaucgacgggacaauccgccugccuagaauuuaccacgaaggaaccuucauccccggcacauauaaaauugugaucgauaagcgggacaaacagaaugaccgcugcacccuugugacgaacugugucauuaagggcagagaggugcggcgcgggcagagcgcccugagacaguaccggacagaaaucagaaucggaaaagccuccgcuggcagccgccggcuccugucugaggaguccggggaugacugcauuagcagaacccaacugcuccgcaccgaaacagccgagguucauggagauaauuauggcgggccuggcgacaagaucaccauuuguaacggaucuacaaucguggaucagcggcugggcuccgaacuugggugcuacacgauuaauagagucaagagcuuuaaacugugcgagaacucuggaaccggcaagagcuguaaaaucgacaauacacccgugaagugccgccagggguucugucucaaaauuacccaggagggacggggccacguuaagcuguccagagggagcgaagugguccuggaugcuugcgacucuuccugugagaucaugaucccgaagggcacaggagauauucuuguggacugcagcggcgggcaacagcauuuccucaaagauaaccuggucgaccugggauguccuaauaucccccuccugggcaagauggccauuuauaucugccgcauguccaaccacccuaaaaccacgauggcguuucuuuucugguuuucuuucggguacgugauuaccuguaucuuuugcaagaucauuuucuaucugcucaucguugugggaacacugggcaaaaaguuuaagcaguaccgggaacugaaaccccagaccuguacaauuugcgagaccacaccgaccaaugccaucgacgcugaaaugcaugaucuuaagugcagcuacaacauuuguccuuauugcgccuccagacucacgucugacgggcuggcucgccacgucacacaaugucccaaacggaaggagaaaguggaggaaaccgagcuguaccucaaucuggaaagaaucccuuggaucguucggaaacuucuccaggugagcgaguccaccggcgucgcccugaaacgcucuagcuggcugauugugcugcuugugcuccugacaguuucccugagccccguccagucugcgcccaucggacacggcaagaccauugaagccuaucagacgagagagggguacacauccgugugccucuucaugcugggaggcauccuuuuuguggucagcugucugaugaaggggcucguggauucuguuuccaacagcuucuuuccuggacugucuauuugcaaaaccuguuccaucggcagcgugaacggguucgagaucgaaucccauaagugcuauuguagccugcuuugcugucucuacugccggcacugcucugcugacagagagauucaucaacugcaccugagcaucuguaaaaagcgccgggccggcggaaaugucaugcucgcugugugcaaaagaaugugucugcgcgccacaauggaaguuuccaacaaggugcuuuuuauuagaucuaucauuaauaccacauucgucaucugcauucuggugcucgccguuuguaucgugagcaccuccgcugucgagauggaaucucugccggcgggcacgugggagcgggaggaagaucugaccaacuucugccaccaggagugucaggugacagaaaccgagugccuuugucccuaugaggcccuggugcuccgcaagccucuguuuagcgacuccaucgucaaagggaugaagaaucuccugaacucuacaagccuugaaaccucccugagcauugaggcucccuggggagccaucaauguucaaucuacguucaaaccuacaguguccaccgccaacauugcucucagcuggucuuccguggaacauagaggcaauaagauccuggucagcgggcgguccgagucuauuaugaaacuggaagagagaacaggaaucagcugggaucuuggcguggaggacgccuccgaaagcaagcugcucaccguuucugugauggaucugucccagauguacagccccgucuuugaguaccucucuggcgacagacagguggaagaguggccuaaggcgaccugcacagggaacuguccggaucggugcggaugcacgagcuccaccugucugcacaaagaauggccccauucucgcaauuggagaugcaacccuacaugguguuggggcguugggaccggaugcacauguugcggccuugacgugaaggaucuguucaccgacuauauguuugucaaauggaagguggaguacaucaaaacggaggcuauuguuuguguggaacucaauagccaggagcggcaaugcucccugaucgaagccgggacacgcuucaaccugggacccgucaccauuacccuuucugagccuagaaauauccagcagaagcugcccagcgaaauuaucacacuccacccgcggaucgaggagggcuuuuucgaccugaugcaugugcagaaggugcucuccgccagcaccgucuguaaacugcaaucuugcacacacggcguuccuggggaucuucagauuuaucacaucggaaaccugcugaagggcgacagagugaacgggcaucucauucacaaaaucgaaccccauuuuaauacguccuggaugagcugggauggaugugaccuggauuacuauugcaacaugggcgacuggcccuccugcaccuacacaggggugacccagcacaaucaugcugccuucgucaaccuucugaauauugagacagauuauaccaagaacuuucacuuccacucuaaacgcgugacggcgcauggagacaccccucagcucgaucugaaggcucggcccacauacggcgccggcgaaaucaccguucucguggaggucgccgacauggagcugcacacaaagaagauugcuaucagcgggcuuaaguuugccucccugaccuguacaggaugcuacgcuuguucuagcggcaucuccugcaaagugcgcauucauguugaugaaccugacgagcugacggugcacgucaagagcgaagauccggacaucguggccgcgucuuccagccucauggcccgcaaacuggaguucgggaccgacucuacauucaaggcuuuuuccgccaugcccaaaaccagccuuuguuucuauauugucgaacgggaguacugcgagucuuguagcaaggaagauacccaaaagugcgugaauacaaaacuggagcagccucaguccauccucauugaacacaagggaacgaucaucggcaaacaaaacgacaccuguacagcuaaggccucuugcuggcuggagagcguuaaauccuuuuucuaugggcucaagaauaugcugagcggaauuuuuggcaacguguucaucggcauuuuucuuuuccuggcccccuuuauccugcucauucuguucuuuauguucggguggagaauccuuuucuguuuuaagugcugccgccggaccagaggacuguucaaauaccgcuaucucaaggaugacgaagaguccggcuaccggagaaucauugagcggcugaauaacaaaaaggggaaaaauaagcuccuggauggagaacgccuugcugacagacggaucgcggagcuguuuucuacaaagacccauauuggcuga

SEQ ID NO: 13570 - RNA, 5070 nt, Artificial Sequence
  derived and/or modified CDS sequence (opt5) from CCHFV(BA8402)__AF350449.1__GP
augagcuucuccgugauguacacaccccugcucugcgccguccugugucuucagcuguggucucucgagggcagccacgggcuguccaacaagacccaacauucuaauacgagcaccacaaaagcuccugaaguuucccaggagcuuggacugccggugucuaccgugagcacaaucaccuccgaacccccuagcauuacaucugccgucuccgugagcggcucugagggguccggagacaccaacacgagccccucuguuaccacacagggcccuacccuccccgaaacaacccuggagccucugacgacaaccgauacagacgcguccagcaccguggucguggauguuuccacccagacagugaaggacacgccgaucucuaccacauauaccagccuccccuccacaccuagcgagcccaccacgccucaagggacacaccauaccgcuagaggacugcuuucugucaccuccacaaaacccgaagaggccagcccgcaggccaauccuggcaagauuucuauggaaaccaacggcccccggcuggcuaucagcgagacaccuuccuuuucucccacgacccaggcccccacagagaauagcaacccuauuaccuccaaacagcucaugcugagcgcucaaccggugacacccaauccuaugaccucucccgugcagccugcccuuucccagagcgauacgucuaccgcgauccaggacguccaccccuccccgacagggcgcagcaagagaaaccuggaaauggagaucauucucacccugucccaaggacugaagaaauacuauggcaagauccucaaacugcuugaucugacacucgaagaggacaccgaagggcugcuugaguggugcaagcggaaucugggacucguuugugaugacaacuucuuucagaaacgcauugaggaguucuuucugacgggcaaggggcauuucaaugaggugcugcaguuuaagacaccuucuacccucagccccacaggaccugccagaaccggcucccccaccguggaaccuuucaaaucuuacuuugcuaagggcuuccugagcauggauuccggguauuuuagcgccaaaugcuacccccgggcuucuaacuccggacuucaacugaucaaugucacacagcacagcacgcgcauuaccgacacaccgggcccuaagaucaccaaccucaaaacaauuaauuguaucaaccugaaggccucuguguucaaagagcacagagaaaucgagauuaacguucuucugccccagguggcggucaaucucuccagcugccaugugcugaucaagucucacguuugugauuauagccuggacauugacgggcccgugcggcucccucgcauccaucacgagggaaccuuuauuccgggcacguacaagaucgucaucgauaaaaagaacaaacagaaugacagaugcacacuggugaccaacugugucauuaaggggcgggaaauccgcaaaggacaauccgugcuuagacaguaccggaccgagauuaagaucggcaaggccagcucuggcucccgcagacugcucagcgaagaguccggggaugacugcauuucucggacacagcugcugagaaccgaaacagcugagauccacaaugauaacuauggaggccccggggacaaaaucacgauuuguaauggaagcaccguuguggaucagcgccuuggcuccgagcucgggugcuacacaaucaaccgggucaauucuuucaaccugugcgaaaauaccgccacaggcaagagcugugagauugacuccaccccugugaaaugcagacaaggauucugucugaagaucacgcaggaaggccgcgggcauguuaaacucucucggggaagcgaggugguccuggaugcuugcgaguccagcugugaaauuaugauccccaagggcaccggggacauucuuguggauugcucuggaggccagcagcacuuucugaaggacaaccucaucgaccugggguguccuaauaucccccugcuuggcaaaauggccauuuauaucugcagaauguccaaccauccuaagacaaccauggccuuccucuuuugguucagcuuuggauacgugguuacauguauucugugcaaagucaucuucuaucugcucauuguggugggcacccuggggaagaaauuuaagcaauaccgcgagcuuaagccccagacauguaccaucugcgaaacgacaccggucaaugcuaucgaugcggagaugcacgaccugaacugcucuuauaacauuuguccuuacugcgccucccggcccaccagcgauggacucgcuagacaugugaugcaguguccuaaacgcaaggagaaaaucgaagagaccgcccuguaccugaaucuugaacggauucccuggguugugagaaagcuccugcaggucucugaguccacaggcguggcccugaaacgcagcuccuggcucguugugcugcuuguccugcucaccgugagccugucuccgguucaaagcgcuccuaucgggcacggaaagacgguggaaacauaucagacccgggagggcuacacauccauuugccuguucguccuugggucuauccucuuuaucgugagcugucugaugaaaggccugguggacuccgucggaaacucuuucuuucccggccucagcauuugcaagaccuguuccaucgggucuguuaauggauucgaaauugagagccacaagugcuauuguucccuguuuugcuguccuuacugcagacauugcagcgccgaucgggagauccaccgccuucaucugucuauuuguaaaaagagaaaaacaggcuccaacgugaugcucgcggugugcaagcggauguguuucagagcuaccgucgaagugagcaauaaagcccugcugauccgcaacaucauuaauacgaccuucguucuuugcauccugauucucgccgugugugucgugucuacauccgcuguugagauggaaagccugcccgccgggaccugggagcgggaagaggaccucacaaacuuuugccaccaggagugucaagugaccgaaacggagugccugugucccuaugaagcucuuguccugagaaagccucucuucuccgauucuaucgugaagggaaugaaaaaucugcugaacagcacaucccuugagaccagccugucuauugaggccccguggggcgcgaucaauguucaguccacauuuaagcccaccgugagcgccgcuaacauugcccucucuuggagcuccgucgaacaccgcgggaauaaaauccuggugucuggcagaagcgaguccaucaugaagcucgaagaacggaccggaauuucuugggaccugggcguggaagaugcuagcgaguccaaacuucugacagucagcguuauggaccucucucagauguacuccccuguguucgaguaucugagcggggaucgccagguggaagaguggcccaaggccacgugcaccggagacuguccugaaagaugcggcugcacauccucuaccugucugcauaaggaguggccccacagccggaacuggcgcugcaauccuacaugguguuggggagucgggaccggcugcacguguugcggccuugaugugaaagaccuguuuacagacuacauguucaucaaguggaaaguugaauacauuaagaccgaggcgaucgugugugucgagcucaccucccaagaaagacagugcacacugauugaggccgggacccgguuuaaccucggaccggugacaaucacgcugucugaaccccgcaacauccagcagaaacuuccucccgagauuguuacccugcauccuagaaucgaagagggcuucuuugaucugaugcacgugcaaaagguccucagcgcuuccacaguguguaagcugcagagcugcacccaugggguccccggagaccuucagguguaucacauuggcaaucugcucaaaggggauaagguuaacggacaccugauccauaaaauugagccgcacuucaauacaucuuggauguccugggacggcugugaucuccauuacuauugcaacaugggcgacuggccuagcugcaccuacacgggggugacccagcacaaucaugccgcuuuugucaacaugcugaauaucgaaacagauuauaccaagaacuuccacuuucacucuaaacgggugacagcccauggagacacaccccaacuugaucugaaggcccgccccaccuacggcgcuggggagaucacgguucugguggaagucgcggacauggagcuccacaccaaaaagauugagaucuccggacugaaguucgccagccuuacauguaccggcugcuaugcuuguucuagcgggauuuccugcaaagugagaauccauguggaugaaccugacgagcugaccguucacgucaagucugaagaucccgacauuguggccgccagcuccagccucauggcucggaaacuggaguucggaacagacuccacguuuaaggccuucucugcgaugccuaaaaccagccucuguuuuuacaucguggaaagagaguacugcgaguccuguucuaaggaagauacacagaagugcgucaauaccaaacuggagcagccgcaaagcauucuuaucgaacacaagggcacaaucauuggcaaacaguccaacaccuguacggcuaaggccucuugcuggcuggagagcgugaaauccuucuuuuaugggcugaagaauaugcucagcggaaucuucggcaacguuuuuauugggguguuccuguuuuucgcccccuuuauccuucugauucucuucuucauguuuggauggcgcauccuguucuguuuuaagugcugccggagaacacgcggccucuucaaauaccggcaucugaaggacgaugaagagaccggguauagaaaaaucauugagcgccuuaauaacaagaaaggaaagaauaagcugcuggacggcgaacggcucgcugauagaaaaaucgccgagcuguuuucuaccaagacacacauuggcuga

SEQ ID NO: 13571 - RNA, 5070 nt, Artificial Sequence
  derived and/or modified CDS sequence (opt5) from CCHFV(BA66019)__AF350448.1__GP
augcccgccaacaucauguacacccugcucgugugcgcuguccuguguccucagcuuuggagccuggagggcacacacguuccgcauaaugaaacgaagcacaacgggaccggaauuacagccgcgcccggcgagucccaagggccuaugucucccgcuagcaccgccgugccucucacacccgaaccuccgaauaccaaacccgccgcuuccgccucugagcuggaaagcuccggagagggccauacaucucuucuggcuaccacgcaggggcucaccagcccugaggccacacccgaacugccuaccacaaccgacacgggaguguccagcacaucugucguggauaucggcacccagauggcgaaggacacacccaccuccaccgcccacacaagccugccgucuaacccuuccgcucccagcacggcccagggcacccaucacacaauuagagggcuccugucuguuaccuccacaaaaccugaggaagcuagcacccccacggaucccggaaaggccggcgcggagacaggguccccucggccggccaucucucgcaaacccacccuuagcccuaccgcugaggcccccacagaaauuaauaacuccagcaccccuaagcaacccgagccgucuauccagccugcuacacccucccuggugaucagcccugcccagcccgccuucccucagucugcuacgagcaccgcggcccaagacauuuauuccucucccacaaauagaagcaagcggaaccucaaaauggaaaucauucugacccuuucccagggacugaagaaauacuauggcaagauccagaaaacacucgggcugacccuggaggaagauacggagggacuccuggaguggugcaagcgcaaucuuggccugaccugugacgauaacuuuuuccagaagagaauugaagaguuuuuccucacaggcgaaggguacuuuaaugagguccugcaauucaaaaccccgagcacaccuggaucuaccgaacccacgcacgcugaggcccccacagugaagccuuuuaaauccuauuucgcccggggcuuucuuaccaucaacagcggguacuucucugcuaagugcuauuccuggacaagcaauuccggacugcagcucauuaacguuacccagcauccggcccgcaucgcggacacccccggcccuaaaaucacaaaucugaagacgauuaacuguaucaaccugaaagcuagcguguuuaaggagcacagagaaauugagaucaauguccuccugccccaaguggccgugaaccuuagcaauugccauguccugauuaagucccacguuugugauuacucucucgacaucgaugggaccauccggcugccucgcauuuaccacgaaggaacauucauccccggcaccuauaaaauugugaucgacaagagagauaaacagaacgaccggugcacacuugugaccaauugugucauuaagggccgcgaggugagaaaagggcagagcgcccugcggcaguaccgcacggaaaucagaaucggaaaggcuuccgccggcagccggagacuccugucugaggaguccggggacgauugcauuagccgcacacaacugcuccggaccgaaaccgcugagguucauggagacaacuauggcgggccuggcgauaagaucacaauuuguaauggaucuaccaucguggaccagagacugggcuccgaacuugggugcuacacaauuaaccgcgucaagagcuuuaagcugugcgaaaauucuggaacgggcaaaagcuguaagaucgauaaacaccccgugaagugccggcagggguucugucucaagauuacccaggagggaagaggccauguuaaacugucccgcgggagcgaagugguccuggacgccugcgauucuuccugugagaucaugaucccgaagggcacaggagacauucuuguggauugcagcggcgggcaacagcacuuccucaaagacaaccuggucgaucugggauguccuaauaucccccuccugggcaagauggcgauuuauaucugccggauguccaaccauccuaaaaccacaauggccuuucuuuucugguuuucuuucggguacgugauuaccuguaucuuuugcaagaucauuuucuaucugcucaucguugugggaacgcugggcaagaaauuuaagcaguacagagaacugaaaccccagaccuguacaauuugcgagaccacaccgaccaaugcuaucgacgccgaaaugcacgaccuuaagugcagcuacaacauuuguccuuauugcgcuucccgccucacaucugaugggcuggcccggcacgucacccaaugucccaaaagaaaggagaaaguggaggaaacggagcuguaccucaaucuggaacgcaucccuuggaucguucggaaacuucuccaggugagcgaguccacaggcgucgcgcugaagagaucuagcuggcugauugugcugcuugugcuccugaccguuucccugagccccguccagucugcccccaucggacauggcaaaaccauugaggcuuaucagacacgggagggguacaccuccgugugccucuucaugcugggaggcauccuuuuuguggucagcugucugaugaaggggcucguggacucuguuuccaacagcuucuuuccuggacugucuauuugcaaaacguguuccaucggcagcgugaacggguucgagaucgaaucccacaagugcuauuguagccugcuuugcugucucuacugccgccauugcucugccgauagagagauucaccaacugcaccugagcaucuguaaaaagcggagagcuggcggaaaugucaugcucgccgugugcaagcgcaugugucugcgggccacaauggaaguuuccaacaaagugcuuuuuauuagaucuaucauuaauaccacauucgucaucugcauucuggugcucgcuguuuguaucgugagcaccuccgcggucgagauggaaucucugccggccggcacaugggagcgcgaggaagaccugaccaacuucugccaucaggagugucaggugacggaaaccgagugccuuugucccuaugaggcucuggugcucagaaagccucuguuuagcgauuccaucgucaaagggaugaagaaucuccugaacucuacaagccuugaaaccucccugagcauugaggcccccuggggagccaucaauguucaaucuacauucaaaccuaccguguccacggcuaacauugcccucagcuggucuuccguggaacaccggggcaauaagauccuggucagcgggcgcuccgagucuauuaugaagcuggaagagagaacaggaaucagcugggaccuuggcguggaggaugcguccgaaagcaaacugcucaccguuucugugauggaccugucccagauguacagccccgucuuugaguaccucucuggcgaucgccagguggaagaguggccuaaggcuacaugcaccggggacuguccggaucggugcggaugcaccagcuccacaugucugcauaaagaauggccccacucuagaaacuggcggugcaauccuacgugguguuggggcguugggaccggaugcacauguugcggccuugacgugaaggaucuguucaccgacuauauguuugucaaauggaagguggaguacaucaagacagaggccauuguuuguguggaacucaacagccaggagcgccaaugcucccugaucgaagccgggaccagauucaaucugggacccgucacgauuacacuuucugagccucggaacauccagcagaaacugcccccggaaauuaucacccuccauccucgcaucgaggagggcuuuuucgaccugaugcacgugcagaaggugcucagcgcuuccaccgucuguaaacugcaaagcugcacacacggcguucccggggaucuucagauuuaucauaucggaaaucugcugaagggcgacagagugaacgggcaccucauucauaaaaucgaaccccacuuuaacaccucuuggauguccugggauggaugugaccuggauuacuauugcaauaugggcgacuggccuagcugcacauacacgggggugacccagcauaaccacgccgcguucgucaaucuucugaacauugagacagauuauaccaagaauuuucacuuccauuccaaacgggugacagcucacggagacacgccccagcucgaucugaaggccagaccuaccuacggcgccggcgaaaucaccguucucguggaggucgcugacauggagcugcauacaaagaaaauugccaucucugggcuuaaguuugcuagccugaccuguacaggaugcuacgccuguuccucuggcaucagcugcaaagugcgcauucacguugaugaaccggacgagcugaccgugcacgucaaguccgaagaucccgacaucguggcggccucuucuucccucauggcucggaaacuggaguucgggacagacagcacguucaaggccuuuucugcuaugccuaagaccucccuuuguuucuauauugucgaaagagaguacugcgagagcuguucuaaagaagauacacaaaagugcgugaacaccaaacuggagcagccccagagcauccucauugaacauaagggaaccaucaucggcaaacaaaaugacacauguacggccaaggccuccugcuggcuggagucuguuaagagcuuuuucuaugggcucaaaaacaugcuguccggaauuuuuggcaauguguucaucggcauuuuucuuuuccuggcuccuuuuauccugcucauucuguucuuuauguucggguggcgcauccuuuucuguuuuaagugcugccggagaacccgcggacuguucaaauaccgguaucucaaggaugacgaagagagcggcuacagacgcaucauugagcggcugaacaauaaaaaggggaagaacaaacuccuggauggagaaagacuugcggaccggcgcaucgccgagcuguuuuccacaaagacccacauuggcuga

SEQ ID NO: 13572 - RNA, 5070 nt, Artificial Sequence
  derived and/or modified CDS sequence (opt5) from CCHFV(BA88166)__AF338470.1__GP
augagcuucuccgugauguacacaccccugcucugcgccguccugugucuucagcuguggucucucgagggcagccacgggcuguccaacaagacccaacauucuaauacgagcaccacaaaagcuccugaaguuucccaggagcuuggacugccggugucuaccgugagcacaaucaccuccgaucccccuagcauuacaucugccgucuccgugagcggcucugaaggguccggagacaccaacacgagccccucuguuaccacacagggcccuacccuccccgagacaacccuggaaccucugacgacaaccgacacagaugcguccagcaccguggucguggacguuuccacccagacagugaaggauacgccgaucucuaccacauauaccagccuccccuccacaccuagcgagcccaccacgccucaagggacacaccauaccgcuagaggacugcuuucugucaccuccacaaaacccgaggaagccagcacccaggccaauccgggcaagauuucuauggagacaaacagcccucggcuggcuaucuccgaaacgcccucuuuuagcccuaccacacaggcccccaccgagaauagcaaccccauuacaagcaaacagcucaugcugucugcucaaccugugaccccgaaucccaugacguccccugugcagcccgcccuuagccagucugacaccuccacagcgauccaggauauccacccuagccccaccggccgcuccaagagaaaccuggagauggaaauuauccucacacugucucaagggcugaagaaauacuauggaaagauucucaaacugcuugaccugacccucgaggaagauacggagggccugcuugaauggugcaagcggaaucuggggcucgucugugacgauaacuucuuucagaaacgcaucgaggaguucuuucugacaggaaagggccauuucaaugaaguucugcaguuuaagaccccgagcacacucuccccuaccgggcccgccagaaccggaucuccuacaguggagcccuucaaaagcuacuuugcuaagggcuuccuguccauggacagcggcuauuuuucugccaaaugcuacccucgggcuuccaacagcgggcuucaacugauuaaugugacgcagcacucuacccgcaucacagauacccccggaccgaagauuacaaaccucaaaaccaucaauuguaucaaccugaaggccuccgucuucaaagaacacagagagauugaaaucaacgugcuucugccucagguugcggugaaucucagcucuugccauguccugauuaagagccacgugugugacuauucccuggacaucgauggccccguucggcucccccgcauucaucacgaggggacguuuaucccuggaacauacaagaucgugauugacaaaaagaacaaacagaaugauagaugcacccuggucaccaacugugugaucaagggccgggagauucgcaaagggcaaagcguccuuagacaguaccggacagaaaucaagauuggaaaggccucuuccggcagccgcagacugcucuccgaggaaucuggcgacgauugcaucagccggacccagcugcugagaacagagacggcugaaauccacuccgacaauuaugggggaccgggcgauaaaauuaccaucuguaacgggucuacagugguugaccagcgccuuggaagcgagcucggcugcuacaccauuaaucgggugaaguccuucaaacugugcgagaacucugccacaggcaagagcugugaaaucgauuccacccccgucaaaugcagacaaggguucugucugaagauuacgcaggagggacgcggccaugugaagcucagccgggggucugaaguugugcuggacgcuugcgauuccagcugugagaucaugauuccuaaaggaaccggcgacauccuugucgacugcucugggggacagcagcacuuucugaaggauaaucucaucgaccugggcugucccaacauuccucugcuugggaaaauggccaucuauauuugcagaauguccaaucaucccaagacaaccaugggcuuccucuuuugguucagcuuuggauacguggugacauguauccugugcaaaggcauuuucuaucugcucaucguugucgggacccugggaaagaaguuuaaacaauaccgcgagcuuaagccucagacauguaccaucugcgaaacgacacccgugaacgccauugaugcugagaugcacgaccugaauugcucuuauaacaucuguccguacugcgcgucccggcucaccagcgauggccuggccagacaugugaugcaguguccuaaacgcaaggaaaagauugaggaaaccgagcuguaccuuaaucucgagcggauccccugggucgugagaaagcugcugcagguuuccgaaagcacagggguggcucucaaacgcucuagcuggcuggucgugcuucugguucuccugaccgugucccugucuccuguccaaagcgcccccauuggacacggcaagacgguggagacauaucagacccgggaaggguacacauccaucugccuuuucguucucggcucuauccuguuuauugugagcugucugaugaagggacucgucgacuccgugggcaacucuuucuuuccggggcugagcaucugcaaaaccuguuccauuggaagcgugaacggcuucgagaucgaaucucacaagugcuauuguucccuuuucugcuguccuuacugcagacauugcagcgccgaucgggagauucaccgccugcaucucucuaucuguaaaaagagaaaaacaugguccaaugucaugcuggcuguuugcaagcggauguguuucagagccaccguggaggugagcaacaaggcgcugcuuauccgcaauauuaucaacacgaccuucguccugugcauucucauccuggcuguguguguuguguccacaucugccgucgaaauggagagccuccccgccgggaccugggaacgggaggaagaccugacaaauuuuugccaccaggagugucaagugaccgagacggaaugccuuuguccuuaugaggcucugguucucagaaaaccccuguaccuggauuccauugugaagggaaugaaaaaccuucugaauagcacaucucucgaaaccucccugagcaucgaggcccccuggggcgcuauuaacguccagucuacauucaagccuaccaugagcgccgcgaauaucgcccucuccuggucuagcguggagcaccgcgggaacaaaauccugguuuccggcagaucugaaagcauuaugaaacuugaggaacggaccggaaucuccuggaaucugggcguggaggacgcuagcgaaucuaagcuccugacagucuccgugauggaucugagccagauguauuccccgguguuugaguaccuuucuggggaccgccaggucgaggaauggcccaaagccacgugcaccggagauuguccugagagaugcggcugcacaagcuccaccugucugcauaaggaauggccccacucucggaacuggcgcugcaauccuacaugguguuggggaguugggaccggcugcacguguugcggccucgacgugaaagaccuguucacagauuacauguuuauuaaguggaaaguggaguauaucaagaccgaagcuauugucuguguggagcucaccagccaagagagacagugcacacugaucgaagccgggacccgguucaaccuuggacccguuaucauuacacuguccgagccucgcaauauccagcagaagcugccgcccgaaauugugacgcuccauccuagaaucgaggaaggcuuuuucgaccugaugcacguccaaaaagugcuuagcgcgucuaccguuuguaagcugcaguccugcacacauggggugcccggagaucuccaggucuaccacauuggcaaccugcucaaaggggacaaggugaacggacaccugauccauaaaaucgagccucacuuuaauaccagcuggaugucuugggauggcugugaccuugauuauuacugcaacaugggcgacuggcccuccugcacauauaccggggucacgcagcauaaucacgccgcuuucgugaacaugcugaauauugagaccgauuacacaaagaacuuucauuuccacagcaaacggguuaccgcccacggagacacaccgcaacuggaucucaaggcucgcccuaccuauggcgccggggaaaucacagugcuggucgagguggccgacauggaacuucauacgaagaaaauugagaucucuggacugaaguuugcuagccucaccuguacaggcugcuacgcguguuccucugggauuagcugcaaaguuagaauccacguggaugagcccgacgaacugaccguccaugugaaguccgaggaccccgauauuguggccgcuagcuccucucucauggcccggaaacuggaauuuggaaccgacagcacauucaaggccuuuuccgcuaugccuaagacgucucuuuguuucuacaucguugagagagaauauugcaaaagcuguuccaaggaggauacccagaaaugcgucaauacaaagcuggagcagccccaaucuauccugauugaacacaaaggcaccaucauuggcaagcagaacaauacauguaccgccaaggcgagcugcuggcucgaguccgugaaauccuuuuucuacgggcugaagaacaugcuuucuggaaucuuuggcaauguguucauuggggucuuucuguucuuugcuccuuucauccuccugauccucuuuuucauguucggauggcgcauucuguuuuguuucaaaugcugccggagaacgcgcggccuuuuuaaguaucggcaccugaaagacgaugaagagacaggguacagaaagaucauugaacgccugaacaauaagaaaggaaagaacaaacuccuggacggcgagcggcuugccgauagaaagaucgccgagcuguucuccaccaaaacccauauuggcuga

SEQ ID NO: 13573 - RNA, 5070 nt, Artificial Sequence
  derived and/or modified CDS sequence (opt5) from CCHFV(UCCR4459)__KY484032.1__GP
augagcuucuccaucauguacacaccccugcucugcgccgugcugugucuucagcuguggucucucgagggcagccacgggcuguccaacaagacccaacauucuaauacgagcaccacaaaagcuccugaagucucccaggaguuuggacuuccgguuucuaccgugagcacaauuaccuccgaucccccuagcaucacaucugccguguccgucagcggcucugaaggguccggagacaccaacacgagccccucugugaccacacagggccugacccucccugagacaacccuggaacugcucacgacaaccgacacagaugcguccagcaccguuguggucgacguguccacccagacaguuaaggauacgcccauuucuaccacacacaccagccugccuuccacaccgagcgcuaccacgacaccccaagggacccaucacaccgccagaggacuucugucugugacauccaccaaaccugagggcgccagcacacaggcuaaucccgagaagaucucuauggaaacgaacagcccucggcucgccauuuccgagacccccucuuucagcccgacaacccaggcuccuacagaaaauuccaaccccaucaccagcaaacagcugaucuuuucugcccaaccugucacgcccaaucccgugaccccuccggugcagcccgcgcuuucccagagcgacacaucuaccgccauucaggauauccauccuucccccacaagccgcuccaagagaaaccuggagauggagauuauccucacccugucucaaggccugaagaaauauuacgggaagauucucaaacugcuugaccugacgcucgaagaggauacagaaggacugcuugaguggugcaagcggaaucugggccucgucugugacgaugacuucuuucagaaacgcaucgaagaguucuuucugaccggggagggacacuucaacgaaguucugcaguuuaagacaccuagcacccucucccccaccggcccggcuagaacagggucuccuacgguggagcccuucaagagcuauuuugccaaaggauuccuguccauggauagcggcuacuuuucugcuaagugcuauccucgggccuccaauagcggccuucaacugauuaacgugacccagcacucuacacgcaucaccgacacacccgggccuaaagucaccaaucucaagacgaucaacuguauuaaucugaaagcguccguguucaaggaacauagagagaucgaaauuaacguucuucugccccagguggccgucaaccucagcucuugccacgugcugaucaaaagccauguuugugacuacucccuggauauugacggaccggugcggcucccucgcauccaccacgagggcacauucauccccgggaccuauaagcuggucauugauaagaaaaauaagcagaacgacagaugcacccuuaucacaaauugugugauuaaaggacgggagauccgcaagggccaaagcguccugagacaguaccggaccgaaauuaaaaucgggaaggcuucuuccggaagccgcagacuccuguccgaggaaucuggcgaugacugcaucagccggacacagcuguccagaacggagaccgccgaaauucauucugauaacuacggcgggcccggagacaagaucacaauuuguaauggcagcaccaucguggaucagcgccuuggguccgagcucggaugcuauacaauuaaccggguuaaaucuuuuaagcugugcgagaauagcgcuaccggcaaauccugugaaaucgacagcacgccuauuaagugcagacaaggguucugucugaaaaucacccaggagggccgcggacacgugaagcucucucggggcuccgaagucgugcuggaugccugcgacagcucuugugagaucaugauuccgaaggggacaggagacauccuuguugauugcuccggcgggcagcagcauuuucugaaagacaaccucauugaucugggaugucccaauaucccucugcuuggcaagauggccauuuacaucugcagaaugagcaaccaccccaaaaccacaauggcuuuccucuuuugguucucuuuuggguaugugaucaccuguauucugugcaaggucaucuucuaccugcucauuguggugggcacacuggggaaaaaguuuaagcaauaucgcgagcuuaaaccucagaccuguacgaucugcgaaacaacccccguuaaugcgauugacgccgagaugcaugaucugaacugcuccuacaauaucuguccuuauugcgcuagccggcucaccuccgacggccuggccagacacgucaugcagugucccaagcgcaaagaaaagguggaggaaacagagcuguaccuuaaccucgagcggaucccguggguggucagaaaacugcuucaggugagcgaaucuaccgggguugcccucaagcgcagcuccuggcuggugguccuucuggugcuccugacgguuucucugagcccugugcaauccgcucccauuggacacggcaaaacagucgagaccuaccagacacgggaaggguauaccucuaucugccuuuucgugcucggaagcauucuguuuaucguuuccugucugaugaagggccucguggauucugucgggaauagcuucuuuccuggccuguccauuugcaagacauguagcaucggaucuaucaacggcuucgagauugaaucccauaaaugcuacuguagccuuuucugcugucccuauugcagacacugcucugccgaccgggagauccauaagcugcaccucuccauuuguaaaaagcgcaaaaccgggagcaacgugaugcuggcggugugcaagagaauguguuuucgggcuacggucgagguuuccaauaaggcccugcuuaucagaaacauuaucaauaccacauucguggugugcauucugauccucgccgucugugugguuucuaccagcgcuguggaaauggagucccugccggccggaacaugggaacgcgaggaagaucucaccaacuuuugccaccaggagugucaagucacggagacagaaugccuguguccuuacgaggcucuugugcugcggaaaccccucuucagcgacucuaucguuaagggcaugaaaaaucugcugaacuccaccagccuugaaacaucucugagcauugaggccccuuggggagcgaucaaugugcaguccaccuuuaagcccaccgucucugccgcuaacauugcccucagcugguccucuguggagcauagaggaaauaaaauccugguuagcggccgcuccgaaagcauuaugaagcucgaggaaagaacagggaucucuugggaucugggcguggaggacgcuuccgaaagcaagcugcugacggucuccaucauggaucucucucagauguauagccccguguucgaguaccuguccggagaccgccagguggaggaauggccuaaagcgaccugcacaggcgacuguccggagcggugcgggugcaccucuagcacaugucugcacaaggaauggccccauuccagaaacuggcggugcaauccuaccugguguuggggagucggcacggggugcacauguugcggacuugauguuaaagaccuguuuaccgauuauauguucgugaaguggaaaguggaguacauuaagaccgaagccaucgucuguguggagcucacaagccaagagcgccagugcucucugauugaagccggcaccagauuuaaccucggccccguuacaaucacgcuguccgagccucggaauauucagcagaaacuucccccugaaaucgugacccugcacccgcgcaucgaggaaggguucuuugaccugaugcaugucaagaaggugcucagcgcuucuacaguuuguaaacugcaauccugcacccacggagugcccggcgaucuucaggucuaccacauugggaaccugcucaagggagacaaagugaauggccaucugauccacaagauugagccucauuucaacacaagcuggaugucuugggaugggugugaccucgauuauuacugcaacaugggagacuggcccagcugcuccuauaccggcgucacgcagcacaaucaugccgcuuuugugaacaugcugaauaucgagaccgauuacacaaaaauuuuccacuuccacucuaagagaguuaccgcccauggcgacacaccucagcuugaucugaaggcccggcccaccuauggggcuggagaaaucacagugcuggucgagguggcggacauggaacuccacacgaaaaagauugagaucagcggccugaaauuugccucccuuaccuguacagggugcuacgcuuguagcuccggaaucucuugcaagguucgcauucauguggacgagccggaugaacugaccguccacgugaaaagcgaggacccugauaucguggccgccuccucuagccucauggcuagaaagcuggaguucggcaccgacuccacauuuaaggccuucucugcgaugcccaaaacgagccucuguuuuuauauuguugaacgggaauacugcaaguccuguagcaaagaggauacccaaaagugcgucaacacaaaacuggagcagccccagucuauccuuauugaacacaaggggaccaucaucggaaagcaaaaugacacauguaccuccaaagcuggcugcuggcuggagagcgugaagucuuucuuuuacggccugaaaaacaugcucuccgggauuuucggaaauguguuuaucggcauuuuccuguuucuugccccuuucauccugcucauucuguucuuuauguucggguggagaauccucuuuuguuucaagugcugccgccggacgagaggacuguuuaaauaucgccaucuuaaggaugacgaagagacaggcuaccggaagaucauugaaagacugaacaauaaaaaggggaaaaacaagcugcucgauggagagcgccuggccgaccggaaaaucgcugagcuuuucagcaccaagacccacauuggcuga

SEQ ID NO: 13574 - RNA, 5070 nt, Artificial Sequence
  derived and/or modified CDS sequence (opt5) from CCHFV(K168_125)__KX013460.1__GP
augcccaucagcaccaugcacauuucccugaugugcgccgugcucugucugcagcuuuacggccuugggggaacacauggccuccacaacgggacggagcauaauaagaccaacgcugucacaaccucuagcaauucccaaucuagcgaauccccugccagaacagcgccgcccguuaccccugacucucccacagugaccccuacgacccccgcuagcgccccugagggauccggcgaagcccacagcucuccgcccaacaauacagaggggccuucccugcccgaaagcaccucugagccucccgcugccacauccaccggaaucccgagcgcuucugaugugaacuccagcacgcaggccgcgcgggacacauccaccccuacaguccgcaccucucccccuaauagccccuccacacccccuaccccgcaggagacgcaucaccccgugagaaaccuucugagcguuaccucucacaaaccugaagagacauccgcccccagcgaaucuggcaaggagagcccugcugccaauucuccccauccgguggcuucccggccucccaccccuagcacaaccgcccagggccccacggagaacaauaacuauaauacaaccgggcaacucgaaucccugacccagagcacaacccugggaccuaugacaucucucacgcagaccgaucugccccaguccgucacaagcauugcggugcaagacacccacccgucuccuacaaaccgcuccaaaagaaaucuugagauggaaaucauucugacccucccccagggccugaagaaauacuaugggaagguucuucggcugcuccagcugacgcuggaggaagauaccgagggacuccuggaguggugcaagcgcaaccuuggccuggacugugaugacacauucuuucagaaaagaaucgaagaguucuuuaucaccggggaaggacauuucaacgaggugcuccaauuucggacacccggcacccugagcacgacagaauccacccacgccggccuuccuacagcugagccguucaagucuuacuuugccaaaggguuccugagcauugauuccggauauuuuucugcuaagugcuacagccgcaccuccaauagcggccuccagcugaucaacgucaccagacacucuacacggauugccgacacgcccgggcugaaaaucaccaaucucaagacaauuuccuguaucaaccugaaggccagcguguucaaagagcaucgcgaaguggagauuaauguccuucugccucagguugcugugaaccucucuaauugccacgugaccaucaagucccaugucugugauuauagccuggacaucgauggaacagugagacuuccccacauucaucacgacggcaccuuuaucccugggacguacaaaauuguuaucgaccggaagaacaaacugaaugaucgcugcacacucuucaccaacugugugauuaagggaagagaaguccggaaaggccaaucugugcugagacaguacaagaccgagauccgcaucggcaaggcgagcacagggucccggagacugcucagcgacgaaucuggagaugacugcauuucccgcacccagcugcuucggacagagacggccgagauccacggcgauaauuaugggggacccggcgacaaaauuaccaucuguaacgggagcacaauuguugaucagagacugggcuccgaacucggaugcuacaccaucaaucgcgugaagucuuuuaaacugugcgagaacagcgcuacaggcaaguccugugaagucgacucuaucccugugaaaugccggcaaggguauugucugaagauuacccaggagggaagaggccaugucaagcugagccgcggguccgaggugguucucgaugccugcgacucuagcugugaagugaugauccccaaaggaacgggcgauauucuggucgacugcuccgggggccagcagcacuuccugaaggacaaucucaucgaucugggauguccgaaagugccucuucugggcaagauggccauuuacaucugccggaugagcaaccaucccaaaaccacaauggcuuuccucuuuugguucucuuuuggguauguuauuaccuguaucgugugcaaggccaucuucuaccugcugauuaucgucggaacacuuggcaagagauuuaaacaauaucgcgagcucaagccucagaccuguacaauuugcgaaaccacgcccacaaacgcgaucgacgcugagaugcacgaucugaauugcuccuacaacauuuguccguacugcgccagccggcugaccucugacgggcucgccagacacgugacccauuguccuaaacggaaggaaaaaguggaggagacagaacuguaucuuaaucuggagcgcauccccuggguugucagaaagcuccuucagguguccgaaagcaccggaguggcucugaagcggucuuccuggcuuaucguccuccuggugcuguucgccguuagccucuccccugugcagagcgcucccauuggccacgggaaaacgaucgagacauaccaagucagagaagaguauaccucuauuugccuguuugugcuuggcagcauccuguucauuguuuccugucucaugaagggacuggugaacucugucggcaauaucuuuuuccccgggcugagcaucugcaaaacauguuccauuggaucuaucaacggcuuugagauugaaagccauaagugcuacuguucccuucucugcuguccuuauugccgccacugcucugccgaucgggagauccaucagcugcaccugagcauuuguaaaaagagaaaaaccggguccaaugugaugcucgcgguuugcaagcgcauguguuucagagccacaguggaagucagcaacaaggcucugucuauccgguccaucauuaauaccacguuuguggugugcauccuuauucuggccgucuguguugugagcaccucugcuguggagauggaaucccucccggccggaacaugggagcgcgaggaagaccugaccaacuucugccaccaggagugucaggucacagaaaccgagugccugugucccuacgaggcgcuugugcugagacggccucucuuccuggauagcaucguuaaaggcaagaaaaaucuccugaacuccacgucucuugaaacaagccuguccauugaggcccccuggggcgcuaucaaugugcaaagcaccuauaagccuacagucucugccgcuaacauugcccucuccuggagcucuguggaacaucgcgggaauaaaauccugguuagcggaagauccgagucuaucaugaagcuggaggaacggaccggcauuagcugggaccuugggguggaggaugccuccgaaucuaagcugcucaccgucagcgugauggaccugucccagauguacagccccguuuuugaguaccucucuggagaucgccagguggaagaguggccuaaagcuacaugcacgggcgacuguccggaaagaugcgggugcaccuccagcacaugucugcacaaggaguggccccauucccggaacuggcgcugcaacccuaccugguguuggggagucggcacaggcugcaccuguugcgggcuugaugugaaagaccuguucacggacuauauguuugugaaguggaaagucgaguacaucaagacagaagcgauuguuuguguggagcucaccucucaagaaagacagugcagccugaucgaggccggaacccgguucaaucugggccccgugacaauuacccuuuccgaaccuagaaacauccagcagaagcugcccccggagaucauuacacuccacccucgcaucgaggaaggguuuuucgaucugaugcauguccaaaaagugcucucugcuagcacgguuuguaagcugcaguccugcacccacggagugcccggcgaccuucaggucuaucacauugggaaucugcugaaaggagauaaggugaacggccaucucauccacaaaauugagccccauuuuaauacaagcuggaugucuugggacggcugugaucuggacuacuauugcaacaugggggauuggccuuccugcaccuacacaggaguuacccagcacaaucacgccagcuucaucaaccuucugaauaucgaaacggacuauaccaagucuuuucauuuccacuccaagcgggugacagcccauggcgauacaccccaacucgaccugaaagcuagaccuaacuacggggccggagagauuaccguccucguggaggucgcggauauggaacugcacaccaagaaaaucgagauuagcggccuuaaguuugcuucucugacauguacggggugcuacgccuguagcuccggaaucucuugcaaagugcgcauucauguugacgaaccggaugagcugaccgugcacgucaagagcgacgaccccgaugugguugccgcuuccagcucccucauggcccggaaacuggaguucggcacagacucuaccuuuaaggcguucagcgcuaugccuaagaccucccuuuguuucuauaucguggaaagagaguacugcaaaucuuguagcaaggaagauacacagaaaugcgucaauacgaagcuggagcacccccaguccauucucaucgaacauaaaggcaccaucauugggaagcagaacaauacauguaccgccaagacaucuugcuggcuggagagcgugaaauccuuuuucuauggacucaagaacaugcugagcggcaucuuugggaauguguucguuggaauuuuucuuuuccuggccccuuuuauccugcucauucuguucuuuauguucggcuggcgcauccuguuuuguuucaaaugcugccggagaacccgcgggcuguuccgguacaagcaccucgaagacgaugaggagacgggauauagacggaucauugaacgccugaacaacaaaaagggcaagaauaaacuccuggacggcgagagacuugcugaucggcgcaucgccgaacuguuuucuacaaagacccauauuggguga

SEQ ID NO: 13575 - RNA, 5070 nt, Artificial Sequence
  derived and/or modified CDS sequence (opt5) from CCHFV(K168_40)__KX013457.1__GP
augcccaucagcaccaugcacauuucccugaugugcgccgugcucugucugcagcuuuacggccuugggggaacacauggccuccacaacgggacggagcauaauaagaccaacgcugucacaaccucuagcaauucccaaucuagcgaauccccugccagaacagcgccgcccguuaccccugacucucccacagugaccccuacgacccccgcuagcgccccugagggauccggcgaagcccacagcucuccgcccaacaauacagaggggccuucccugcccgaaagcaccucugagccucccgcugccacauccaccggaaucccgagcgcuucugaugugaacuccagcacgcaggccgcgcgggacacauccaccccuacaguccgcaccucucccccuaauagccccuccacacccccuaccccgcaggagacgcaucaccccgugagaaaccuucugagcguuaccucucacaaaccugaagagacauccgcccccagcgaaucuggcaaggagagcccugcugccaauagcccccauccgguggcuucucggccucccaccccuagcacaaccgcccagggccccacggagaacaauaacuauaauacaaccgggcaacucgaaucccugacccagagcacaacccugggaccuaugacaucucucacgcagaccgaucugccccaguccgucacaagcauugcggugcaagacacccacccgucuccuacaaaccgcuccaaaagaaaucuugagauggaaaucauucugacccucccccagggccugaagaaauacuaugggaagguucuucggcugcuccagcugacgcuggaggaagauaccgagggacuccuggaguggugcaagcgcaaccuuggccuggacugugaugacacauucuuucagaaaagaaucgaagaguucuuuaucaccggggaaggacauuucaacgaggugcuccaauuucggacacccggcacccugagcacgacagaauccacccacgccggccuuccuacagcugagccguucaagucuuacuuugccaaaggguuccugagcauugauuccggauauuuuucugcuaagugcuacagccgcaccuccaauagcggccuccagcugaucaacgucaccagacacucuacacggauugccgacacgcccgggccuaaaaucaccaaucugaagacaauuuccuguaucaaccucaaggccagcguguucaaagagcaucgcgaaguggagauuaauguccugcuuccccagguugcugugaaccugucuaauugccacgugaccaucaagucccaugucugugauuauagccucgacaucgauggaacagugagacugccucacauucaucacgacggcaccuuuauccccgggacguacaaaauuguuaucgaccggaagaacaaacuuaaugaucgcugcacacuguucaccaacugugugauuaagggaagagaaguccggaaaggccaaucugugcucagacaguacaagaccgagauccgcaucggcaaggcgagcacagggucccggagacugcugagcgacgaaucuggagaugacugcauuucccgcacccagcuccugcggacagagacggccgagauccacggcgauaauuaugggggaccuggcgacaaaauuaccaucuguaacgggagcacaauuguugaucagagacuuggcuccgaacugggaugcuacaccaucaaucgcgugaagucuuuuaaacucugcgagaacagcgcuacaggcaaguccugugaagucgacucuauccccgugaaaugccggcaaggguauugucugaagauuacccaggagggaagaggccaugucaagcugagccgcggguccgaggugguucuugaugccugcgacucuagcugugaagugaugaucccgaaaggaacgggcgauauucucgucgacugcuccgggggccagcagcacuuccugaaggacaaucugaucgaucucggauguccuaaaauuccccugcuuggcaagauggccaucuacauuugccggaugagcaaccauccuaaaaccacaauggcuuuccuguuuugguucucuuuuggguaugugaucaccuguaucguuugcaaggccauuuucuaccuccugaucauugugggaacacugggcaagagauuuaaacaauaucgcgagcuuaagccccagaccuguacaaucugcgaaaccacgccgacaaacgcgauugacgcugagaugcacgaucucaauugcuccuacaacaucuguccuuacugcgccagccggcugaccucugacgggcuggccagacacgucacccauugucccaaacggaaggaaaaaguggaggagacagaacucuaucugaaucuugagcgcaucccuugggugguuagaaagcugcuccaggucuccgaaagcaccggaguggcucugaagcggucuuccuggcugauugugcuucucguccuguucgccgugagccugucccccguucagagcgcucccaucggccacgggaaaacgauugagacauaccaagugagagaagaguauaccucuaucugccucuuuguccugggcagcauucuuuucaucguguccugucugaugaagggacucguuaacucugugggcaauaucuuuuucccugggcugagcauuugcaaaacauguuccaucggaucuauuaacggcuuugagaucgaaagccauaagugcuacuguucccugcuuugcuguccguauugccgccacugcucugccgaucgggagauucaucagcuccaccugagcaucuguaaaaagagaaaaaccggguccaaugucaugcuggcggugugcaagcgcauguguuucagagccacaguugaagugagcaacaaggcucucucuauccgguccauuaucaauaccacguuugucgugugcauucugauccuugccgugugugucguuagcaccucugcuguggagauggaaucccugcccgccggaacaugggagcgcgaggaagaccucaccaacuucugccaccaggagugucaggugacagaaaccgagugccuguguccuuacgaggcgcugguccuuagacggccccuguuccucgauggcauugugaaagggaugaagaaucugcucaacagcacgucccuggaaacaucucuuagcaucgaggccccuuggggcgcuauuaauguucaauccaccuauaaacccacagugagcgccgcuaacaucgcccugucuugguccagcgucgaacaucgcggaaauaagauccucgugucuggcagaagcgaguccauuaugaaacuggaggaacggaccgggaucucuugggaccugggaguugaggaugccagcgaauccaagcugcugaccgugucugucauggaccucagccagauguacuccccuguguuugaguaccugagcggcgaucgccagguugaagaguggccgaaggcuacaugcacgggggacugucccgaaagaugcggaugcaccucuuccacaugucuccacaaagaguggccucauagccggaacuggcgcugcaaccccaccugguguuggggcgugggcacagggugcaccuguugcggacuggaugucaaggaccuuuucacggacuauauguuugugaaauggaagguggaguacauuaaaacagaagcgaucgucuguguugagcugaccucccaagaaagacagugcucucucauugaggccggcacccgguucaaucuggggccugugacaaucacccugagcgaacccagaaacauccagcagaagcugccgccugagauuaucacacugcacccccgcauugaggaaggauuuuucgaucucaugcaugugcaaaagguccuguccgcuucuacgguguguaaacuccagagcugcacccacggcguucccggggaccuucagguguaucacaucggaaaucuucugaagggcgauaaagucaacggccaucugauucacaagaucgagccucauuuuaauacauccuggaugagcugggacgggugugaucucgacuacuauugcaacaugggagauuggcccucuugcaccuacacaggcgugacccagcacaaucacgccuccuucaucaaccugcuuaauauugaaacggacuauaccaaauccuuucauuuccacucuaagcggguuacagcccauggggauaccccucaacuggaccucaaggcuagaccgaacuacggagccggcgagaucacagugcuggucgagguggcggauauggaacuccacaccaaaaagauugagaucuccgggcugaaauuugcuagccuuacauguacgggaugcuacgccuguucuagcggcauuuccugcaagguccgcauccauguggacgaacccgaugagcugaccguucacgugaaaucugacgacccugaugucguggccgcuagcuccagccugauggcccggaagcucgaguucggcacagacuccaccuuuaaagcguucucugcuaugcccaagaccagccuguguuucuauauuguugaaagagaguacugcaaguccuguucuaaagaagauacacagaagugcgugaauacgaaacuugagcacccucagagcauccugaucgaacauaaggggaccauuaucggaaaacagaacaauacauguaccgccaagacauccugcuggcucgagucugucaagagcuuuuucuauggccugaaaaacaugcucuccgggauuuuuggaaauguguucgugggcaucuuucuguuccuugcccccuuuauucugcugauccucuucuuuauguucggguggcgcauccuguuuuguuucaagugcugccggagaacccgcggacuuuuccgguacaaacaccuggaagacgaugaggagacgggcuauagacggauuaucgaacgccucaacaacaagaaaggcaagaauaagcugcucgacggggagagacuggcugaucggcgcauugccgaacuuuuuagcacaaaaacccauaucggauga

SEQ ID NO: 13576 - RNA, 5070 nt, Artificial Sequence
  derived and/or modified CDS sequence (opt5) from CCHFV(K128_76)__KX013454.1__GP
augcccaucagcgugaugcacauuucccugaugugcgccguccucugucugcagcuuuacggccucgggggaacccauggcucucacaacgagacagaacauaauaagacgaacgcuguuaccacaagcuccgacucucaaagcccugagccgcccaccagaacaacccugccugugacacccgauuccccuaccgugacgcccaccaccccugccucugcgccggaagggagcggagagguccacacauccccgccuaauacaaccgaaggccccagccugccugagucuacgcccgagccgccuacagcuaccuccacagggauccccagcgccucugacgugaacuccagcacccaggccgcucgggauaccucuacaccuacgguucauaccuccccucccaauagccccuccacaccgcccacccuucaggaaacacaccacccuaugcgcaaccugcucucugugaccagccauaaacccgaggaaacguccgccccuagcgagucuggaaaggagucccccgcugccaauagcccgcacccugucgcggacagacccucuacaagcuccaccaccgcccagggcccuacagaaaacaauucuuauaacaccacagagcaacuggaaagccugacgcaguccaccacacucggccccaugaccagccugacacagaccgugcuuucucaguccguuacgagcauugcugugcaagauacccaucugucuccuacaaaucgguccaaacgcaaccucgagauggaaaucauucugacccuuccccaggggcugaagaaauacuauggaaagguccucagacugcugcagcucacacuggaggaggacaccgaaggccuucuggaguggugcaagcggaaucucgaucuggacugugaugacacguucuuucagaaacgcaucgaagaguucuuuaucacaggggaaggauacuucaacgaggugcuucaauuuagaaccccgggcacacugagcaccaccgaguccacacacgccgggcucccuacggcugaacccuucaagucuuauuuugccaaaggauuccugagcauugauuccggcuacuuuucugcgaagugcuauagccggaccuccaauagcggccugcagcucaucaacgugacacgccacucuaccagaauugccgacacacccgggccuaaaaucaccaaccugaagacgauuuccuguaucaaucuuaaggcuagcgucuucaaagagcaucgggaaguugagauuaacgugcugcucccccagguggccgucaaucugucuaacugccacgugacaaucaagucccauguuugugauuacagccuugacaucgacggaaccgugaaacugccccacauucaucacgauggcaccuuuaucccugggacauacaagauugucaucgaccgcaaaaauaagcucaacgauagaugcacccuguucacaaauugugugauuaaaggacgggaaguucgcaagggccaaucugugcugagacaguauaagacggagauccggaucgggaaagcuagcaccggauccagacgccuccugagcgacgagucuggcgaugacugcauuucccggacacagcuucugagaaccgaaacagccgagauccacggcgauaacuacgggggacccggcgacaagauuaccaucuguaaugggagcacgauugucgaucagcgccucggauccgaacugggcugcuauaccaucaaccgggugaaaucuuuuaagcugugcgagaauagcgccacagggaaauccugugagaucgacucuauuccugucaagugcagacaaggcuacugucuuaagaucacccaggaaggacgcggccaugugaaacucagccggggguccgagguugugcuggaugcuugcgacucuagcugugaagucaugauucccaagggaacaggcgacauccugguggauugcuccgggggacagcagcacuuccucaaagacaaccugauugaucuuggcuguccuaagaucccccugcucgggaaaauggcgauuuauaucugcagaaugagcaaucauccgaagaccacaauggccuuccuguuuugguucucuuuuggcuacguuaucaccuguauugugugcaaggcuaucuucuaucugcuuauuaucgucggaacgcucggcaaacgcuuuaagcaauaccgggagcugaaaccucagacauguaccauuugcgaaaccacacccaccaacgccaucgacgccgagaugcacgaucugaauugcuccuacaacaucuguccuuauugcgcuagcagacucacgucugacgggcuggcccgccacgugacacauugucccaagcggaaagagaagguggaagagaccgaacuuuaccugaaccucgagcgcauuccguggguuguccggaagcugcuucagguguccgaaagcacaggaguggcgcugaaaagaucuuccuggcucaucguccugcugguucucuucgcugugagccuguccccugugcagagcgcccccauuucucacggcaagaccaucgagacauaucaagucagagaggaauacaccagcauuugccuuuuugugcugggguccauccucuucaucguuucuugucugaugaaaggacuggugaauagcgucggcaacaucuuuuucccugggcuuuccauuugcaagacguguucuauuggcagcaucaauggauuugagauugaaucccauaaaugcuauuguucucuccugugcugucccuacugccggcacugcagcgccgauagagagauccaucagcugcaccucuccaucuguaagaaacgcaagaccggcagcaacgugaugcuggcuguuugcaagcggauguguuucagagccacaauggaagugucuaauaaagcucuuuuuauucgcuccaucauuaacaccacauucgucgugugcauccugauucucgccgugugugucguuagcaccucugcgguggagauggagucccugcccgccgggacgugggaaagagaggaagaccugacaaauuucugccaccaggagugucaggugaccgagacagaaugccuuuguccuuaugaggcucugguccuccggcgcccgcuguuucaagauagcaucgugaagggaaugaaaaaccuccuuaauuccaccucucuggaaaccagccuguccauugaggcccccuggggcgcuaucaacguucagagcacauacaagccugccgugucugcggccaauaucgcucucuccuggagcucugucgaacauagagggagcaaaauucugguguccggacggucugagagcaucaugaagcuggaggaacgcacgggcauuuccugggaccuugggguugaggaugccucugaaagcaagcugcucaccguguccgucauggaccugagccagauguacucucccguguucgaguaucucuccggcgauagacaaguugaagaguggccuaaagcuacaugcaccggagacugucccgagcggugcggcugcacaagcuccaccugucugcacaaggaauggccucauucucgcaacuggagaugcaauccgacgugguguuggggaguggggacaggcugcaccuguugcgggcuugacgucaaagaucuguuuaccgacuacauguucgugaaguggaaaguggaguauaucaagacagaagccauugucuguguugagcucaccagccaggaacggcagugcucccugaucgaggccggaacacgcuuuaaccugggccccgugacgaucacccuuucugagccuagaaauauucagcaaaagcugcccccugaaaucauuacacuccacccccggaucgaggaaggcuucuuugaucugaugcaugugcagaaaguccucagcgcuuccaccguguguaagcugcagagcugcacacacgggguuccgggagaccuucagguguaccacauuggcaaccugcugaaaggggauagagucaacggacaucucauccacaagaucgagccucauuucaauaccucuuggauguccugggacggcugugaucuggacuauuacugcaacaugggggauuggcccagcugcacguauaccggagugacacaacacaaucacgcgucuuuuguuaaccuucugaauauugagaccgacuacacaaaauccuuccauuuucacagcaagcgcgugaccgcccauggcgauacaccccagcucgaccugaaggcucggccuaacuacggcgccggggaaaucacgguccucguggaggucgccgauauggaacugcacaccaaaaagauugagaucucuggacuuaaauucgcuagccugacauguaccggcugcuaugccuguuccucugggauuagcugcaaggugagaauccauguugacgaacccgacgagcugaccgugcacgucaaauccgaugacccugaugugguugcggcuagcuccucucucauggcccgcaagcuggaguuuggaacagacagcacguucaaagccuucuccgcuaugccgaagaccucucuuuguuuuuacauuguggaacgggaguauugcaagagcuguuccaaagaagauacacagaagugcgucaauaccaaacuggagcagccccaaucuauccucaucgaacacaagggcacaauuaucgggaaacagaacaauaccuguacggccaagacaagcugcuggcuggaguccguuaagagcuucuuuuacggacucaaaaacaugcugucuggcauuuucggcaauguguuuguggggaucuuccuuuuucuggcgccuuucauucugcucauccuguuuuucauguuuggauggagaauccuuuucuguuucaagugcugccgccggaccagaggccuguuucgcuauaaacaucucgagaacgacgaagagaccggguaccggagaauuaucgaacggcugaauaacaagaaaggaaagaauaagcuccuggauggcgagcgccuugcugacagacggauugccgaacuguucuccacaaaaacccacaucggguga

SEQ ID NO: 13577 - RNA, 5070 nt, Artificial Sequence
  derived and/or modified CDS sequence (opt5) from CCHFV(Hodzha)__KX013448.1__GP
augcccgugagcaucaugcacauucugcucaugugcgccguccugugucuucagcaauacggccugggggagacccauagaccuaacaauggaacagaacacaacaagacgaauguucucaccacaccguccgacaaacugucucccgagccucccgugagcaccgcucuuuccgugacaccugauucuagcaccgucacacccaccacgccuguguccggccuggaagggucuggagagguuuauaccagcccgcccgugacaaccaagggccucuccccuagcaaagccacaucugaacugcccgcgaccacggggaucgacacauccagcgcuucugaugucgacuccagcacccaggccgcccgggauacaucuacccugaccgugcgcacauccccucccagcuccccgucuacgccucccaccagccaggacacauaccaucucguuagaaaccugcuuuccgugaccagcccucggcccgaggagacaaccgcucccucuaaguccggaaaagaaagcccugucgccaauucuccgcaccccgugacgagccgcccuuccucucccccuauuacagugcagggccccaccgagaacagcucccauaauaccacaggccaacuggaaagcauggcucagucuaccacacucgucccgauggccuccccuacgcagaccguucugagccagucugugacaucccuugcggugcaagaugcccaccccagcccuaccaacagauccaagcggaaucuggagauggagaucauucucacacugccccaggggcugaagaaauauuacggaaagguccuccgccugcuucagcugacccucgaagaggacacggaaggccugcuugaguggugcaaaagaaaccuggggcucgauugugacgauaccuucuuucagaagcggaucgaagaguucuuuaucacaggagagggccacuucaaugaagugcugcaauuuaaaaccccuucuacacugagcaccacggaguccacacaugcuguuucucccaccgccgaaccguucaagagcuauuuugcuaagggguuccucuccauugacagcggauacuuuucugccaaaugcuauuccaagacaagcaacucuggccugcagcuuaucaaugugacccgccacuccaccagaauugcggauacaccuggccccaaaaucacgaaccugaagaccauuagcuguaucaaucucaaagccucugucuucaaggagcaucgggaaguggagauuaacguucugcuuccccagguggcugucaaccugagcaauugccacgugacaaucaaaucccacgucugugacuacagccucgacguggaugggaccguucgccugccucauauccaccauggaggcacauuuauuccggggaccuacaagaucgugauugacaagaaaaacaagcugaaugauagaugcacgcucuauacaaacugugucaucaaaggacgggaggugcgcaagggccaaucuauucugagacaguacaaaaccgaaauccggaucgggaaggccuccaccggaagcagacgccuucuguccgaggaaucuggcgacgauugcauuagccggacacagcuccugagaaccgagacagcugaaauccacggcgacgauuaugggggacccggcgacaagauuacgaucuguaauggguccaccauuguugaucagcgccugggaucugagcuuggcugcuacacaaucaaccgggugaaauccuucaagcucugcgagaauagcgccaccgggaaaucuugugaaaucgacagcacaccugucaagugcagacaaggcuauugucugaaaauuacccaggagggacgcggccaugugaagcugucccgggggagcgaagugguucucgaugccugcgacucuuccugugaggucaugauccccaagggaacgggcgacauucugguggauugcagcgggggacagcagcacuuucuuaaagacaaccugaucgaucucggcuguccucgcauuccccugcuggggaagauggcuaucuacauuugcagaaugucuaaucacccugagaccacaauggcguuccuuuucugguuuuccuucggcuaugugaucaccuguauccucugcaaagccaucuuuuaccugcugauuauugucggaacacucggcaagcgguucaaacaauacagagaacugaagccccagaccuguacaaucugcgagaccacgccggcuaacgccauugacgccgaaaugcaugaucuuaauugcagcuauaacaucuguccuuacugcgcuucucgccugacauccgacgggcucgcccggcacgugacccagugucccaagagaaaagagaagguugaagagaccgagcuguaucugaaucuugaacggaucccuuggauugugcgcaaacuccugcaggucagcgaguccacaggaguggcgcugaagagaagcucuuggcucaucguucugcuugugcuguuugcugucagccucucccccgugcaaucugccccgauuggccaugggaaaaccaucgaaacguaccaggcccgggaggaauauacaagcauuugccuguucguucugggauccauccuuuuuaucgugucuugucucaugaagggccuggucgauagcauugggaacaucuucuuuccuggccugaccauuugcaaaacauguuccaucggaucuauuaauggcuucgagaucgagagccacaagugcuacuguucccuccugugcugucccuauugcagacacugcccugcugaccgcgaaauccaucagcuucaccugagcauuuguaagaaacggaagaccgggucuaacgugaugcucgccgugugcaaaagaauguguuuucgcgcuacaauggaggucuccaacaaggcccugcugaucagaagcauuaucaauaccacguucguugugugcauucuuauccuggcggugugugucgugucuaccuccgccguugaaauggagagccuccccgcuggaacaugggaacgggaggaggaucugaccaacuuuugccaucaggaaugucaagugacagagaccgaaugccucugucccuacgaggcccugguccuucgcagaccucuguuccucgacuccauugugaaaggcaagaagaaucugcugaacucuacgagccuugagacaucccugagcaucgaagcuccguggggagccaucaauguucagucuaccuacaaacccacaguguccaccgcgaacauugcccucagcuggucuagcgucgagcaccgggggaauaagauccugguguccggccgcucugaaagcauuaugaaacucgaggaaagaaccgggaucuccugggaucugggcguugaggacgcuucugagagcaaacuucugacaguguccgucauggaucucagccagauguauucuccuguguucgaauaccuguccggagaccggcaaguggaggaauggcccaaagccacgugcaccggcgacuguagcgagcgcugcgggugcacauccucuaccugucugcauaaggaauggccucacagcagaaacuggcggugcaaucccacaugguguuggggagucggcaccgggugcacguguugcggacuugauguuaaggaccuguuuacagauuauauguucgugaaauggaagguggacuacauuaaaaccgaggcuaucgucuguguggagcucaccucccaggaacgccagugcucucugguugaggccggcacaagauuuaaccucggcccugugaccaucacacugagcgaaccgcggaauauucagcaaaaacuucccccugagaucauuacgcugcaccccagaaucgaagagggguucuuugaucugaugcauguccagaaggugcucuccgccagcaccguuuguaagcugcagucuugcacacacggagugccuggcgaccuucaggucuaucauauugggaaccugcucaagggagauaaagugaauggccaccugauccauaagaucgagccccacuucaacaccuccuggaugagcugggacgggugugaucucgacuacuauugcaauaugggagauuggccgucuugcacauacaccggcgucacgcaacacaaccaugcuuccuuugugaaccugcuuaauauugaaaccgacuacacaaagagcuuccacuuucauucuaagcgcguuaccgcgcacggcgauacaccucagcuggaccugaaagcccggcccaccuauggggcuggagagaucacagugcucgucgaaguggccgacauggagcugcacacgaagaaaauugagaucaccggccuuaaguucgccagccugacauguaccgggugcuacgcuuguuccucuggaauuagcugcaagguuagaauccauguggaugaacccgacgagcucaccguccacgugaaauccgaugacccugaugugguugccgcgagcuccucucugauggcucgcaagcucgaauuuggcacagacagcacguucaaagccuuuuccgccaugcccaagaccucucuguguuucuauauugucgagcgggaauacugcaaaagcuguuccaaggaggauacacagaagugcgugaacaccaaacuugagcagccucaaucuauccugaucgaacagaaggggacaauuaucggaaaacagaauaacaccuguacggcuaaggccagcugcuggcuggaguccgugaaaucuuucuuuuauggccucaagaauaugcugagcggcauuuucgggaacgucuuugugggaaucuuccuuuuucuggcgccguucauucuccugauccucuuuuucauguuuggcuggagaauccuguucuguuuuaagugcugccgccggacaagagggcuuuucaaauacaagcaucugaaagacgaugaagagaccggauaucgccggauuaucgaaagacugaauaacaagaaaggcaagaauaagcuccuggacggggagcggcuugcugaucgcagaauugccgagcuguucuccaccaaaacacacaucggauga

SEQ ID NO: 13578 - RNA, 5070 nt, Artificial Sequence
  derived and/or modified CDS sequence (opt5) from CCHFV(Hy13)__AY900145.1__GP
augagcuucuccaucauguacacaccccugcucugcgccgugcugugucuucagcuguggucucucgagggcagccacgggcuguccaacaagacccaacauucuaauacgagcaccacaaaagcuccugaagucucccaggaguuuggacuuccgguuucuaccgugagcacaauuaccuccgaucccccuagcaucacaucugccguguccgucagcggcucugaaggguccggagacaccaacacgagccccucugugaccacacagggccugacccucccugagacaacccuggaacugcucacgacaaccgacacagaugcguccagcaccguuguggucgacguguccacccagacaguuaaggauacgcccauuucuaccacacacaccagccugccuuccacaccgagcgcuaccacgacaccccaagggacccaucacaccgccagaggacuucugucugugacauccaccaaaccugagggcgccagcacacaggcuaaucccgagaagaucucuauggaaacgaacagcccucggcucgccauuuccgagacccccucuuucagcccgacaacccaggcuccuacagaaaauuccaaccccaucaccagcaaacagcugaucuuuucugcccaaccugucacgcccaaucccgugaccccuccggugcagcccgcgcuuucccagagcgacacaucuaccgccauucaggauauccauccuucccccacaagccgcuccaagagaaaccuggagauggagauuauccucacccugucucaaggccugaagaaauauuacgggaagauucucaaacugcuugaccugacgcucgaagaggauacagaaggacugcuugaguggugcaagcggaaucugggccucgucugugacgcugauuucuuucagaaacgcaucgaagaguucuuucugaccggggagggacacuucaacgaaguucugcaguuuaagacaccuagcacccucucccccaccggcccggccagaacagggucuccuacgguggagcccuucaagagcuauuuugcuaaaggauuccuguccauggacagcggcuacuuuucugccaagugcuauccucgggcguccaauagcggccuucaacugauuaacgugacccagcacucuacacgcaucaccgauacacccgggccuaaagucaccaaucucaagacgaucaacuguauuaaucugaaagccuccguguucaaggaacauagagagaucgaaauuaacguucuucugccccagguggcugucaaccucagcucuugccacgugcugaucaaaagccauguuugugacuacucccuggacauugauggaccggugcggcucccucgcauccaccacgagggcacauucauccccgggaccuauaagcuggucauugacaagaaaaauaagcagaacgauagaugcacccuuaucacaaauugugugauuaaaggacgggagauccgcaagggccaaagcguccugagacaguaccggaccgaaauuaaaaucgggaaggccucuuccggaagccgcagacuccuguccgaggaaucuggcgacgauugcaucagccggacacagcuguccagaacggagaccgcugaaauucauucugacaacuacggcgggcccggagauaagaucacaauuuguaauggcagcaccaucguggaccagcgccuuggguccgagcucggaugcuauacaauuaaccggguuaaaucuuuuaagcugugcgagaauagcgccaccggcaaauccugugaaaucgauagcacgccuauuaagugcagacaaggguucugucugaaaaucacccaggagggccgcggacacgugaagcucucucggggcuccgaagucgugcuggacgccugcgauagcucuugugagaucaugauuccgaaggggacaggagacauccuuguugacugcuccggcgggcagcagcauuuucugaaagauaaccucauugaccugggaugucccaauaucccucugcuuggcaagauggcuauuuacaucugcagaaugagcaaccaccccaaaaccacaauggcguuccucuuuugguucucuuuuggguaugugaucaccuguauucugugcaaggucaucuucuaccugcucauuguggugggcacacuggggaaaaaguuuaagcaauaucgcgagcuuaaaccucagaccuguacgaucugcgaaacaacccccguuaaugccauugaugcugagaugcaugaccugaacugcuccuacaauaucuguccuuauugcgccagccggcucaccuccgauggccuggccagacacgucaugcagugucccaagcgcaaagaaaagguggaggaaacagagcuguaccuuaaccucgagcggaucccguggguggucagaaaacugcuucaggugagcgaaucuaccgggguugcucucaagcgcagcuccuggcuggugguccuucuggugcuccugacgguuucucugagcccugugcaauccgcccccauuggacacggcaaaacagucgagaccuaccagacacgggaaggguauaccucuaucugccuuuucgugcucggaagcauucuguuuaucguuuccugucugaugaagggccucguggacucugucgggaauagcuucuuuccuggcuccagcauuugcaagacauguucuaucggauccaucaacggcuucgagauugaaagccauaaaugcuacuguucucuguucugcugucccuauugcagacacugcuccgcggaucgggagauccauaagcugcaccugagcauuuguaaaaagcgcaaaaccggguccaacgugaugcucgcugugugcaagagaauguguuuucgggccacggucgagguuucuaauaaggcccugcugaucagaaacauuaucaauaccacauucguggugugcauucuuauccuggcugucugugugguuagcaccuccgccguggaaauggagagccucccggcuggaacaugggaacgcgaggaagaccugaccaacuuuugccaccaggagugucaagccacggagacagaaugccucuguccuuacgaggcgcugguccuucggaaaccccuguucucugauuccaucgugaagggcaugaaaaaucuccugaacagcaccucucuggaaacaagccuuuccauugaggccccuuggggagcuaucaauguucagucuaccuuuaagcccaccgugagcgccgcuaacauugcccuguccuggucuagcgucgagcauagaggaaauaaaauccucguguccggccgcagcgaaucuauuaugaagcuggaggaaagaacagggaucuccugggaccucggcguugaggaugcgagcgaauccaagcugcuuacggugucuaucauggaccugagccagauguauucccccgucuucgaguaccucucuggagaucgccagguggaggaauggccuaaagcuaccugcacaggcgacuguccggagcggugcgggugcaccagcuccacaugucugcacaaggaauggccccauagcagaaacuggcggugcaauccuaccugguguuggggagugggcacggggugcacauguugcggacuggacgucaaagaucuuuuuaccgaccacauguucguuaaguggaaaguggaguauauuaagaccgaagccaucgugugugucgagcugacaucucaagagcgccagugcucccucauugaagccggcaccagauuuaaccugggccccgugacaaucacgcucagcgagccucggaauauucagcagaagcugcccccugaaaucguuacccuucauccgcgcaucgaggaaggguucuuugaucugaugcacgugaaaaagguccugucugcuuccacaguguguaaacuccaaagcugcacccacggaguucccggcgaccuucagguguaccauauugggaaccugcugaagggagauaaagucaauggccaccucauccauaagauugagccucacuucaacacaucuuggaugagcugggacgggugugaucuggacuacuauugcaacaugggagauuggcccuccugcucuuacaccggcgugacgcagcauaaucacgccgccuuugucaacaugcucaauaucgagaccgacuauacaaaaauuuuccacuuccauagcaagagagugaccgcucacggcgauacaccucagcuggaccuuaaggcgcggcccaccuacggggccggagaaaucacaguucugguggaggucgcugauauggaacugcauacgaaaaagauugagaucuccggccucaaauuugccagccugaccuguacagggugcuaugccuguuccucuggaaucagcugcaaggugcgcauucacguugacgagccggacgaacuuaccgugcacgucaaauccgaggauccugacaucguggcugccucuagcucccugauggcgagaaagcucgaguucggcaccgauucuacauuuaaggcuuucagcgccaugcccaaaacgucccuguguuuuuacauuguggaacgggaauauugcaagagcuguucuaaagaggacacccaaaagugcguuaacacaaaacucgagcagccccaguccauccugauugaacauaaggggaccaucaucggaaagcaaaaugauacauguaccagcaaagccggcugcuggcuugagucugucaaguccuucuuuuacggccugaaaaacaugcugagcgggauuuucggaaauguguuuaucggcauuuuccucuuucuggcuccuuucauccuucugauucucuucuuuauguucggguggagaauccuguuuuguuucaagugcugccgccggacgagaggacucuuuaaauaccgccaccugaaggacgaugaagagacaggcuaucggaagaucauugaaagacuuaacaauaaaaaggggaaaaacaagcugcuggacggagagcgccucgccgaucggaaaaucgcggagcuguucucuaccaagacccauauuggcuga

SEQ ID NO: 13579 - RNA, 5070 nt, Artificial Sequence
  derived and/or modified CDS sequence (opt5) from CCHFV(SPU415/85)__DQ211635.1__GP
augcccgugaacaucauguacaccccucuggucugcgccguuauuugucuccagcuguggaaucuuggcgggacacugguguucaucaacagaacgcaacacaaugagaccggaacaguggcuaccccggaaggcacacuccggccccgccugccugucagcaccgcccuucccacaaaguccgacagaccuucuguggggcccgcggcuagcuccucuggacuggagggcagcggggaaccuaacaccuccccgucuauuacgaccaaaggacucacacccccugagaccacacccgcccugccuaccgccacggauacagacgcuagcuccaccggcguuguggaugucagcacacagaugaccaaggacauccccaugucuaccgccuauacaaauccgccuuccacgcccagcgcuccuucuacgccccagggcacacaucacaccgcccgggggcugcucuccguggcgagcacaaaaucugaagagguuuccaugagcaccucccccgccaagacgucuacagagaccagcuccccuccgcccgcuaccagcgaaacaccuacccccucuccuacaacccaggugcccaccggaaacaauaacccgaauacaucccgccaaccuacccccagcgcccagccugcuaugucuaaccccgccacaagcccugcgcagcccaaucugucccagucugccccgccuaccgcugaucaaggcguccaucccagccccacgaacagauccaaacggaaucuugagauugaaaucauccugacccucagccaggggcugcgcaaguacuauggaaagauucuuaaacugcucgaccugacacuggaggaggauaccgaaggccuccuggaguggugcaagagaaaccuugggcugacaugugacgauaacuuuuuccagaaacggaucgaagaguuuuuccucaccggagaaggcuacuuuaaugaggugcugcaguucaaggugccuucuacgcuuuccagcacagagccgacccacacaagacccccuaccgucgaacccuuuaaaucuuauuucgccaagggcuuucuguccaugaacagcggguacuucuccgcuaagugcuauccucgcaccucuaauagcggacuccaacugauuaacguuacaaaacauuccgccaagaucgccgacacgcccggcccuaaaauuaccaaucugaagacaaucaacuguauuaaucuccgggcuucuguguuuaaagagcaccgcgaaguggagaucaacguccugcuuccccagguggcgguuaaucugagcaacugccacgcccagaucaagucccaugugugugauuacagccucgcuaccgacgggauggucagacugccgcacauucaucacgaaggaacauucaucccuggcaccuacaaaauugugaucgauaagaagaauaaacaaaacgaccggugcacgcuuguuacaaauugugugauuaaggggcgcgaggucagaaaaggacagucugcccugcggcaguauaagaccgagaucagaaucggcaaagccuccagcggcucucgccggcuccuguccgaagagagcgacggggauugcauuucuagaacccagcugcuccgcacagaaaccacagagauccacagcgacaacuacggaggccccggggauaagauuacgaucuguaauggauccaccauuguggaccaacggcugggcagcgaacuugggugcuauacaaucaacagagucaagucuuuuaaacugugcgaaaauuccgcuaccggcaagagcugugagaucgauuccacaccugugaaaugccgccagggauucugucucaagauuacccaggaaggccgggggcauguuaaacugucuagaggaagcgagaucgugcuggacgccugcgauuccaacugugaaauuaugauccccaagggcacgggggacauucuugucgauugcucuggaggccagcaacacuuccucaaggacaaccugaucgaucugggguguccgaauauuccucuccugggcaaaauggcgaucuacaucugccgcaugagcaaccaucccaagaccacaauggcuuuucuuuucugguuuuccuucggauaugugauuaccuguauccugugcaaaguuaucuuuuaccuccugauuguggccggcacagucgggaagaaauucaagcaguaucgggagcugagaccucagaccuguacaauuugcgagaccauccccgugaaugccaucgacgcugaaaugcacgaccuuaacugcucuuacaauauuugucccuacugcgccagccgccucacguccgauggacuggcucggcaugugaugcaguguccuaagagaaaagagaagguugaagagacagaacuguaucucaaccuggagcggaucccgugggucgugcgcaaacuucugcaagugagcgagucuaccggcgucgcccucaagagauccagcuggcugaccgugcugcuuguucuccugauugugucucugucccccguccagagcgcgccuaucgggcacggaaaaacaauugaaaccuaccaggcccgggagggcuauacgucuuuuugccucuucauccugggguccauccuuuuugugguuagcugucuggugaagggccucauugacuccgucggaaauagcuucuuucccggccugucuaucugcaaaacauguagcauuggguccaucaacggauucgaaauugagucucacaagugcuacuguagccuguuuugcuguccuuauugcagacauugcuccgcugaucgcgaaauccacaagcugcaucucucuaucuguaaaaagcggaaaaccggcagcaaugugaugcuggccguuugcaagagaauguguuuccgcgcuacaauugagguguccaacagagcccugcucauccggaauauuaucaacaccacauucgucgugugcauucugacccuugcggugugugucguuucuacgagcgccguggagauggaaucccugcccgcugggaccugggagaaagaagaggaccucacaaauuuuugccaccaggaaugucaagugaccgagacagagugccuguguccuuacgaagcccugguccuucgcaagccgcuguuccucgauagcaucgugaagggaaugaaaaaccugcucaauucuaccucccuggagacgagccuuucuauugaagcucccuggggcgccaucaacguucaguccacauuuaagccuaccgugagcgccgcuaacaucgcgcuguccuggucuagcgucgagcacagagggaauaaaauucucguguccggccggagcgagucuaucaugaagcuggaggagcgcacaggaauuuccugggaccugggcguugaagaugccagcgagucuaaacuucugaccgugagcgucauggaccucucccagauguauucucccguguucgaauaccugagcggggauagacaaguugaggaguggccuaaggcuaccugcacaggagacugucccgaacggugcggcugcacguccucuaccugucuccauaaggaguggccgcacagccgcaacuggagaugcaauccuacaugguguuggggaguggggaccggcugcacauguugcggccuggaugucaaagaccuuuuuaccgauuacauguucgugaaguggaaaguggaauauaucaagacggaggccauugucuguguugaacugacaucccaggagcggcagugcagccucaucgaggccgggacccgcuuuaaccugggacccgugaccaucacacugucugaacccagaaauauucagcaaaaacuuccucccgagaucauuacccugcauccucggaucgaagagggcuucuuugaccucaugcacgugcagagaguccuguccgcuagcacaguguguaagcuccaguccugcacgcaugggguuccgggagaccuucagguguaccacauuggcaaccuucugaagggggauaaagucaauggacaccugauccauaagaucgaaccccacuucaacaccucuuggaugagcugggacggcugugaucucgacuauuacugcaauaugggcgauuggccuuccugcacauauaccggggugacacaacauaaccacgccgcguuuguuaaucugcuuaacauugagaccgacuacacgaaaaauuuccauuuucacucuaagcgcgugaccgcucacggagauacaccccagcuggaccucaaagcccggccuaccuauggcgccggggaggucacagugcuggucgaaguggcugauauggagcuccauaccaagaaaaucgaaauuagcggacugaaguucgccucccuuacauguacgggcugcuacgcguguagcucugggaucuccugcaagguuaaaauucacguggacgagcccgaugagcugaccguccauguuaagagcgaagacccggauaucguggcugccggaucuucccugauggccagaaaacucgaguucggcgcugacagcacauuuaaggccuucucugcuaugccuaaaaccagccuguguuuuuacauuguggaacgcgaguauugcaaguccuguucucgggaagacaccagaaagugcgucaacacaaaacuugaucgcccccagagcauccugaucgagcacaagggcacgauuaucgggaaacagaauaacaccuguacagccaaggcguccugcuggcucgagagcgugaaauccuucuuuuacggacugaagaacaugcucucuggcauuuucgggaauguguuuaucggaauuuuccuguuuaucgccccuuucguucuucugauccuguuuuucauguucggcuggcggauucucuuuuguuucaagugcugcagacgcacccgggggcuguuuaaauauagacaccuuaaggacgaugaagagacaggauaccggaaaaucauugaacgccugaacaauaagaaaggcaagaacaagcuccuggacggcgagagacucgcugaucggaaaaucgccgaacuguucagcaccaagucccauauuggguga

SEQ ID NO: 13580 - RNA, 5070 nt, Artificial Sequence
  derived and/or modified CDS sequence (opt5) from CCHFV(SPU97/85)__DQ211633.1__GP
augaccgugaacacagucugcacgccccugguuugugccguguucugccuccagcuguggaaucuuggcgggacccuggugccuacaaacagaacccaacacaauaagacaggaaccauggcuacaccggagggcacccucgggccccggcugccugucagcacggcccuucccaccaaauccgaccgcccuucugugggacccgcggcuccuagcuccggccuggaagggucuggagagccgaacacaagccccuccaucaccacaaagggccucgcccugccugaaaccacgcccgccccucccacagcuaccgauacagacgccucuagcaccggcguugugaaugucuccacccagaugacaaaagauauuccgaugagcacggcuuacaccaacccucccucuacaccuuccgcccccagcacgccccaggggacacaucacaccgcgagaggacugcucucuguggccuccaccaagagcgaggaaguuucuauguccacaagcccuggcaaaaccuccaccgagacaucuagcccgcccccugcuaccuccgagacacccgccccuagccccacgacccaggcuccgacagggaauaacaauccuaacaccucucggcaacccacaccuuccgcccagcccgcgaugagcaauccuaccacgucucccgcccagccgaaccugcuucagaaugcuccucccaccgccgaccaaggagugcaucccggcccuacaaaccgcagcaagagaaaucuggaaauggagaucauucucacccugucccaggggcuucggaaguauuacggaaaaauccugaaguuucucgaucugacacuggaagaggacaccgagggccuccuggaaugguguaaacgcaaccuuggccugacgugcgaugacaacuucuuucagaagagaauugaggaguucuuucucacaggggaaggauauuucaaugaaguccugcaguuuaaagugccgucuacccuuagcuccacagagcccacccacaccggcagcccuacaguggagcccuucaagucuuacuuugcuaagggguuccuguccaugaacagcggauauuuuucugccaaauguuacccucggacguccaauagcggccuccaacugaucaacgucaccaagcauuccgccaaaaucgcugauacacccgggccuaagauuaccaaucugaaaacaaucaacugcauuaaucuccgcgcgucuguuuucaaggaacacagagagguggaaaucaacgugcugcuuccccaggucgccgugaaucugagcaacugucacgcucagauuaaaucccauguuugcgacuauucucucgccaccgauggaauggugcggcugccgcgcauccaccaugagggcacguuuauuccuggcacauacaagaucgucaucgacaagaaaaauaagcaaaacgauagauguacccuugugaccaauugcguuauuaaagggcgggaagugcgcaagggacagagcgcccugagacaguacaaaacagagauccggauuggcaaggcuuccagcgggucuagacgccuccuguccgaggaaagcgacggagacuguaucucucggacccagcugcucagaacagagacggccgaaauucacuccgauaacuauggcgggcccggcgacaagaucaccaucugcaauggaagcacaauugucgaucaacgccugggcucugagcuugggugcuacaccaucaaccgggugaaauccuucaagcugugugaaaacagcgcgacaggaaaaagcugcgagauugacucuaccccugucaaguguagacagggcuucugccucaaaaucacgcaggaggggcgcggacacgugaagcugucccggggcagcgaaauuguucuggaugcuugugacuccucuugcgagaucaugauccccaaggggaccggcgauauucuuguggacuguagcggaggccagcaacauuuucucaaagauaaucugaucgaccuggggugcccgaacauuccucuccugggaagaauggccaucuauauuugucgcauguccaaucaccccaagacaaccauggccuuccuguuuugguucucuuuuggcuacgucaucacaugcauucuuuguaaagugaucuucuaucuccugaucguugcugggaccgugggaaagaaauuuaagcaguaccgggaacugagaccucagacaugcaccauuugcgagacgacacccgucaacgccaucgaugcugagaugcaugaccuuaauuguagcuauaacauuugccccuacugugccucccgccucaccucugacggccuggcgcggcacgugaugcagugcccuaagagaaaagaaaagaucgaggaaaccgagcuguaccucaaucuggaacggauuccgugggugguucgcaaacuucugcaagucagcgaguccacagggguggcccucaagagaagcucuuggcugaccgugcugcuuguccuccugaucgugucccugagccccguucagucugcuccuaucggccauggaaaaacgauugagacauaucaggcccgggaaggcuacaccuccuucugucucuuuauccuggggagcauucuuuucaucgugucuugccuggucaagggacucauugauuccgugggcaacagcuuuuuccccgggcuguccaucuguaaaacaugcagcaucggaucuguuaauggcuuugagauugaaagccacaaguguuauugcucccuguucuguugcccuuacugcagacacuguucugcugaccgcgagauccauaaacuucaccucagcauuugcaagaagcggaaaaccggguccaacgugaugcuggccgucuguaagagaaugugcuuccgcgcgacaaucgaagugucuaauagagcccugcucauucggagcaucaucaacaccacguuugcuguuuguauucugacccuugccgugugcgucguguccacaucugcuguggagauggagagccugcccgccggcaccugggaacgcgaggaagaucucacaaauuucugucaucaggagugccaagucaccgaaacggagugucugugcccuuaugaggcccugguucuuagaaaaccgcuguuucucgacuccaucgugaagggaaagaaaaaccugcucaauagcacaucucuggaaaccucccuuagcauugaggcucccuggggcgcgaucaacgugcagucuacauucaagccuaccgucuccgccgcuaacauugcccugagcugguccucuguggaacaccgggggaauaaaauccucguuagcggacgcuccgagagcauuaugaagcuggaggaaagaaccggcaucucuugggaucuggggguggaggacgccuccgaaagcaaacuucugacagucucugugauggaucucagccagauguacucccccguuuuugaguaucugucuggagaccggcaaguggaagaguggccuaaggcuacguguaccggcgauugccccgagcgcugcggcuguacaagcuccacaugccuccacaaggaauggccgcauucuagaaacuggcgguguaauccuaccuggugcuggggagucgggaccggcuguacgugcugugggcuggacgugaaagaucuuuucacagacuacauguuuguuaaguggaaaguggaguacaucaagaccgaagccauugucugcguggagcugaccagccaggaacgccaguguucccucaucgaggcgggaacaagauucaaccugggccccgugaccauuacacugagcgagccccggaauauccagcaaaaacuuccucccgaaauuaucacgcugcacccuagaaucgaggaaggguuuuucgaucucaugcauguccagaagguucugucugcuuccaccgugugcaagcuccagagcuguacacacggagugccgggcgaccugcaggucuaucauauuggcaaccuucugaaaggggacaaggugaauggacaccugauccacaaaauugagccccauuuuaacaccuccuggaugucuugggauggcugcgaccucgauuacuauugcaauaugggggacuggccuagcuguacauacaccggaguuacgcaacacaaccaugccgccuucgugaaucugcuuaacaucgaaaccgauuauacaaagaauuuucacuuccauuccaaacgcgucaccgcucacggcgacacaccccagcuggaucucaaggcccggccuaccuacggggcgggagaggugacaguucugguggaggucgcugacauggaacuccacacgaaaaagauugagaucucuggccugaaguucgccagccuuuccugcaccggcuguuaugccugcagcucugggaucuccuguaaagugcgcauucaugucgaugaacccgacgagcugacagugcacguuaagagcgaggauccggacaucguggcugccggaucuucccugauggcuagaaaacucgaauuuggcgccgauagcaccuucaaggcguuuucugccaugccuaaaaccagccugugcuucuacauugucgagcgggaauacuguaaguccugcucuagagaggacacacagaagugugugaacacgaaacuugaacgcccccagagcauccugauugagcauaaggggaccaucauuggaaaacaaaaugacacaugcaccgcuaaggccuccuguuggcucgagagcguuaaauccuuuuucuauggccugaagucuaugcucagcgggaucuuuggaaacguguucaucggcauuuuucuguucaucgcuccuuuuguccuucugauucuguucuucauguuuggcuggcggauccucuucugcuuuaagugcuguagacgcacacgggggcuguucaaauacagacaccuuaaggaugacgaagagaccggauaucggaaaauuaucgaacgccugaacaauaagaaaggcaagaacaagcuccuggauggggagagacucgccgaccggaaaaucgccgaacuguuuuccacgaagucucacauuggauga

SEQ ID NO: 13581 - RNA, 5070 nt, Artificial Sequence
  derived and/or modified CDS sequence (opt5) from CCHFV(C-68031)__DQ211629.1__GP
augagcuucuccaucauguacaccccgcugcucugcgccgugcugugucuucagcuguggucucucgagggcagccacgggcuguccaacaagacacaacauucuaauacgagcaccacaaaagcuccugaagucucccaggaguuuggacuuccgguuucuaccgugagcacaauuaccuccgaucccccuagcaucacaucugccguguccgucagcggcucugaaggguccggagacaccaacacgagccccucugugaccacacagggccugacccucccugagacaacccuggaacugcucacgacaaccgacacagaugcguccagcaccguuguggucgacguguccacccagacaguuaaggauacgcccauuucuaccacacacaccagccugccuuccacaccgagcgcucccaccacgccucaagggacacaucacaccgccagaggacuucugucugugaccuccacaaaacccgagggcgccagcacccaggcuaauccugagaagaucucuauggaaacaaacagcccccggcucgccauuuccgagacgccgucuuucagcccuaccacacaggcucccaccgaaaauuccaacccuaucacaagcaaacagcugauccuuucugcccaacccgucacccccaauccugugacgccgcccgugcagccugcgcugucccagagcgacaccucuacagccauucaggauauccaucccuccccuaccagccgcuccaagagaaaccucgagauggagauuauccugacacugucucaaggccucaagaaauauuacgggaagauucugaaacuucuggaccucacccuggaagaggauacggaaggacuucuggaguggugcaagcggaaucucggccuggucugugacgaugacuuuuuccagaaacgcaucgaagaguuuuuccugacaggggagggacacuuuaacgaaguucuccaguucaagacccccagcacacuguccccgaccggcccugcuagaaccgggucucccacaguggagccuuuuaagagcuauuucgccaaaggauuucuuuccauggauagcggcuacuucucugcuaagugcuauccccgggccuccaauagcggccugcaacucauuaacgugacgcagcacucuacccgcaucacagacaccccugggcccaaagucacaaaucugaagaccaucaacuguauuaaucuuaaagcguccguguuuaaggaacauagagagaucgaaauuaacguucugcucccccagguggccgucaaccugagcucuugccacgugcugaucaaaagccauguuugugacuacucccucgauauugacggaccugugcggcugccccgcauccaccacgagggcacguucauccccgggacauauaaacuugucauugauaagaagaauaagcagaacgacagaugcacccugaucaccaauugugugauuaaaggacgggagauccgcaagggccaaagcguccucagacaguaccggacagaaauuaaaaucgggaaggcuucuuccggaagccgcagacugcuguccgaggaaucuggcgaugacugcaucagccggacccagcuuuccagaacagagacggccgaaauucauucugauaacuacggcgggccuggagacaagaucaccauuuguaauggcagcacaaucguggaucagcgccucggguccgagcugggaugcuauaccauuaaccggguuaaaucuuucaagcugugcgagaauagcgcuacaggcaaauccugugaaaucgacagcaccccgauuaagugcagacaaggguuuugucucaaaaucacgcaggagggccgcggacacgugaagcugucucggggcuccgaagucgugcuugaugccugcgacagcucuugugagaucaugauucccaaggggaccggagacauccugguugauugcuccggcgggcagcagcauuuccucaaagacaaccugauugaucugggauguccuaauaucccccuucucggcaagauggccauuuacaucugcagaaugagcaaccacccuaaaacaaccauggcuuuucuguucugguuuucuuucggguaugugaucacauguauucugugcaaggucaucuuuuaccuccugauuguggugggcacccuugggaaaaaguucaagcaauaucgcgagcugaaaccccagacauguaccaucugcgaaacgacaccuguuaaugcgauugacgccgagaugcaugaucucaacugcuccuacaauaucugucccuauugcgcuagccggcugaccuccgacggccuggccagacacgucaugcaguguccgaagcgcaaagaaaagguggaggaaaccgagcuuuaccucaaccuggagcggaucccuuggguggucagaaaacugcuccaggugagcgaaucuacagggguugcccugaagcgcagcuccuggcuugugguccugcucgugcugcugaccguuucucuuagccccgugcaauccgcuccuauuggacacggcaaaacggucgagacauaccagacccgggaaggguauacaucuaucugccucuuugugcugggaagcauucuguucaucguuuccugucucaugaagggccugguggauucugucgggaauagcuuuuuccccggccuuuccauuugcaagaccuguagcaucggaucuaucaacggcuuugagacagaaucccauaaaugcuacuguagccuguucugcuguccguauugcagacacugcucugccgaccgggagauucauaagcuccaccuguccaucuguaaaaagcgcaaaaccgggagcaacgugaugcuggcggugugcaagagaauguguuuccgggcuacggucgagguuuccaauaaggcccuucugauuagaaacaucauuaauaccacauuuguggugugcauccucauucuggccgucugugugguuucuaccagcgcuguggaaauggagucccucccugccggaacaugggaacgcgaggaagaucugaccaacuucugccaccaggagugucaagucacggagacagaaugccuuugucccuacgaggcucuggugcuccggaaaccucuguuuagcgacucuaucguuaagggcaugaaaaaucugcuuaacuccaccagccuggaaacaucucucagcaucgaggcccccuggggagcgauuaaugugcaguccaccuucaagcccaccgucucugccgcuaacaucgcccugagcugguccucuguggagcauagaggaaauaaaauucucguuagcggccgcuccgaaagcaucaugaagcuggaggaaagaacagggauuucuugggaucuuggcguggaggacgcuuccgaaagcaagcugcucacggucuccaucauggaucugucucagauguauagcccuguguuugaguaccuguccggagacagacagguggaggaauggccgaaagcgaccugcacaggcgacugucccgagcgcugcgggugcaccucuagcacaugucuucacaaggaauggccucauuccagaaacuggcggugcaaucccaccugguguuggggagucggcacggggugcacauguugcggacuggauguuaaagaccucuucaccgauuauauguuugugaaguggaaaguggaguacaucaagaccgaagccauugucuguguggagcugacaagccaagagcgccagugcucucucaucgaagccggcaccagauucaaccugggcccuguuacaauuacgcuuuccgagccccggaauauccagcagaagcugccuccggaaauugugacccugcacccccgcaucgaggaaggguuuuucgaccucaugcaugucaaaaaggugcugagcgcuucuacaguuuguaaacuucaauccugcacccacggagugccuggcgaucugcaggucuaccacaucgggaaccuccugaagggagacaaagugaauggccaucucauucacaagaucgagccccauuuuaacacaagcuggaugucuugggaugggugugaccuggauuauuacugcaacaugggagacuggccuagcugcuccuauaccggcgucacgcagcacaaucaugccgcuuucgugaacaugcuuaauauugagaccgauuacacaaaaaucuuucacuuccacucuaagagaguuaccgcccauggcgacacaccccagcuggaucugaaggcccggccgaccuauggggcuggagaaauuacagugcucgucgagguggcggacauggaacugcacacgaaaaagaucgagauuagcggccuuaaauucgccucccugaccuguacagggugcuacgcuuguagcuccggaaucucuugcaagguucgcauccauguggacgagccugaugaacucaccguccacgugaaaagcgaggaccccgauauuguggccgccuccucuagccugauggcuagaaagcucgaauuuggcaccgacuccacauucaaggccuuuucugcgaugcccaaaacgagccuguguuucuauaucguugagcgggaauacugcaaguccuguagcaaagaggauacccaaaagugcgucaacacaaaacuugagcagccucagucuauucugaucgaacacaaggggaccauuaucggaaagcaaaaugacacauguaccuccaaagcuggcugcuggcuggagagcgugaaguccuuuuucuacggccucaaaaacaugcugucugggaucuuuggaaauguguucauuggcaucuuucuuuuccuggcccccuuuauucuccugauccucuucuucauguuuggguggcggauucuguucuguuuuaagugcugccgccggacgagaggacuuuucaaauaucgccaucugaaggaugacgaagagacaggcuaccggaagaucaucgaaagacugaacaauaaaaaggggaaaaacaagcuccuggauggagagcgccuugccgaccggaaaauugcugagcuguuuagcaccaagacccacaucggcuga

SEQ ID NO: 13582 - RNA, 5070 nt, Artificial Sequence
  derived and/or modified CDS sequence (opt5) from CCHFV(Baghdad 12)__AJ538197.2__GP
augcccgugagcaucaugcacauuucccugaucuacgccguccucugccugcagcuuuauggccugggggagacccauggaucuagcuccggcacagaacacaacagaacgaauguuguggcuaccccugggggaucucaaagcccggagccccucguguccacaacccugccugucacacuugacucuagcaccgugacacccgccacccaggcguccggcccugaagggagcggagagguuuacacgucucccccuaccacaaccgaaggccuguccccgagcgaugcuacaucugagcuccccaccacgacaggcauugggaucuccagcuccuccgacgugaacagcuccacccaggccgccggagauacaucuaccccuaccgcucggacaagccugcccgacuccccuagcacgcccccgaccucucaggauacacaucacccuaugcgcaaucugcucuccgucaccagccugaagcccgaggaaacgccugcccccucuaaaagcggcaaggagucccccgcugccucuagcccucauccgguggcguccagacccccuacccccagcacgacagcccaagggccuaccgaaaacaauucucggaacaccacaguucagcuuaaauccgugacccagagcgcuacacugggacccauggccucuccgacgcagaccguccuccugcaauccgugacaagcauugcuauccaggacacccacccuucccccacaaaucgcucuagacggaaccuugagauggagaucauucugacccucccucagggccugaagaaauauuacgggaaggugcugcgccuccugcagcuuacgcuggaagaggauaccgaaggacuccuggagugguguaagagaaaucuuggccuggacugcgaugacacauucuuucaaaaacggaucgaagaguucuuuauuaccggcgaggggcacuucaacgaaguccuccaguuucgcacacccggaacccugagcacgacagaguccacccaugccggcucuccuacaguugaacccuucaagagcuauuuugcgaaaggguuccugcucaucgauuccggauacuuuagcgccaaguguuauucuagaaccuccaauagcggccugcagcuuauuaacgugacccggcacucuacaaaaaucgcugacacgccggggccuaagauuaccaaucugaagacaaucuccugcaucaaccucaaagccagcauuuucaaggagcaucgcgaaaucgagauuaaugugcugcuuccccaagucgcugugaaccugucuaacugucacguuaccaucaaaagccacgugugcgauuacucccucaauauugacggaacagucaagcugccccauauccaccaugagggcaucuuuauuccuggcaccuacaaaaucgugauugacaagaaaaacaagcugaaugauagauguacacucuucacaaacugcguuaucaaggggcgggaagugcgcaaaggacagagcguccugagacaguauaagaccgagauucggaucggcaaagccucuaccggguccagacgccuucugagcgaagaguccggagacgauuguaucucucggacaagacuccugcgcaccgaaacagccgagauucacggcgacagcuacgggggcccgggagauaagaucacgauuugcaauggcuccaccaucguggaccagcggcuggggucugagaugggauguuauacaauuaacagagucaagagcuuuaaacuuugcgaaaauuccgcuaccggcaagucuugcaaaaucgauagcauucccgugaagugucgccaaggguacugccucaaaaucacacaggagggacggggccauguuaagcuguccagagggagcgaagugguccuggacgcgugugauucuuccugcgaggugaugaucccuaaaggcaccggagacauucucguugauuguagcggcgggcagcagcacuuccugaaggacaaccuuaucgaccugggaugccccaauauuccucuccugggcaagauggccaucuauauuugucgcaugucuaaccaccccaaaacgaccauggcuuuccuguuuugguucuccuuuggguacgugaucacaugcauccuuuguaaggccauuuucuaucuccugaucauugucggaacccugggcaaacgguuuaagcaauacagagagcucaaaccucagacaugcaccaucugugaaacaacccccgugaaugccauugaugcugagaugcaugaccugaacugcagcuacaauaucugcccguauugugccucucgccuuacguccgaugggcuggcgcggcacgugacacagugcccuaagagaaaggaaaaaguugaggaaaccgagcucuaccugaaccuggagcggauccccugggucgugcgcaaacuucuccaggugagcgaauccaccggcgucgcucugaaaagaagcucuuggcugauugugcuccugguucuucuggccgugagcuccucuccuguccaaagcgcccccaucggauauggcaagacaauugagaccuaccaggcucgggaaggguauacguccaucugucucuucgugcugggaucuauucuguuuaucguuagcugccuuacaaaaggccucguggacuccaucgggaauauuuucuuuccgggacugucuaucuguaagaccugcagcauuggcuccaucaacggguucgaggucgaaagccauaaauguuacugcucucugcucuguugcccuuauuguagacacugcuccgccgaucgcgagauucaccagcugcaucuuagcaucugcaagaagcggaaaacagggucuuccgugaugcuggcuguuuguaagagaaugugcuuucgcgccaccauggaggugagcaacaaagcgcuccugauuagauccaucaucaauacaaccuucgucguguguauucugacgcuugccgugugcgucguuucuaccagcgcuguggaaauggagucccugcccgccggaacaugggaacgggaggaagaccucaccaacuuuugucaccaggagugccaagugacagagaccgaaugucugugcccuuacgaggcucucguccugcgcaagccccuuuuccuggauagcaucgugaaaggcacgaagaaucuccugaacucuacaucccuggaaaccagccuuucuauugaggcccccuggggcgcgaucaauguucagagcacauacaagccuaccguguccaccgccaacauugcucugucuuggagcuccgucgagcauagaggaaauaaaauccucgugucuggccggagcgaauccaucaugaagcuggaggaacgcacagggauuagcugggaccucggaguugaggaugccucugaauccaaacugcuuacggugagcgucauggaccugucccagauguauucuccgguguucgaguaccucagcggcgauagacaaguugaggaauggcccaaggcuaccuguacaggcgacugcccugagcggugugggugcaccacaucuaccugccugcacaaagaauggccccauucucgcaacuggagauguaauccuacguggugcuggggagugggcacaggguguaccugcuguggacuggaugucaaggaccuuuuuaccgacuauauguucgugaaguggaaaguggaguacaucaagacagaugccauugucugcguugaacugaccagccaggagcggcaguguucccucaucgaggccggcacacgcuuuaaccuggggagcgugacgauuacccucucugaacccagaaauauccagcaaaaacugccuccggagaucauuacacuucacccccggaucgaagagggauucuuugaccugaugcacgugcagaagguccuguccgcuagcaccgugugcaaacuccagucuuguacacauggcguuccuggcgaucuucagguguaucacauugggaaccugcugaagggagacaaggucaauggccaucucauccacaaaauugaaccccauuucaacaccuccuggaugagcugggaugggugcgaccuggauuacuauuguaauaugggagacuggccuucuugcacguacaccggcgugacacaacacaaccacgcgagcuuuguuaaccuccugaauaucgagaccgauuacacaaaguccuuccauuuucacucuaaaagagugaccgcccauggggacacaccccagcuugaucugaagguccgcccgacguauggagcuggcgagauuaccgugcuggucgaaguggccgacauggagcuccacacaaagaagaucgaaaucagcggccugaaauucgccucccuuaccugcaccggguguuacgcuugcagcuccggaauuucuuguaagguucggauccacguggaugagccugacgagcugacaguccauguuaagagcgacgaucccgacgugguggccgcguccucuagccucauggcuagaaaacuggaauuuggcacggauuccaccuucaaggccuuuucugccaugcccaaaacaagccucugcuucuauauugucgagcgcgaauacuguaaguccugcagcaaagaggacacccagaagugugugaacacaaagcuggaacagccucaaucuauccuuauugagcacaaagggaccaucaucggaaagcagaauaacacgugcacagcuaaaaccuccuguuggcuggagagcgugaagucuuucuuuuauggccugaaaaauaugcucuccgggauuuucggaaacuuuuucaugggcaucuuucuguuccuugcccccuuuauucugcucauccuguucuuuauguucggcuggcggauucucuuuugcuucaaguguugcagacgcacccgggggcuguucaaguacagacaucuuaaagaugacgaagagacaggauaucgccggaucaucgaaagacugaauaacaagaaaggcaagaauaaacugcucgauggggagcggcuggcggaccgcagaauugcugaacuuuuuagcaccaagacacacaucggauga

SEQ ID NO: 13583 - RNA, 5070 nt, Artificial Sequence
  derived and/or modified CDS sequence (opt5) from CCHFV(Hodzha)__AY223476.1__GP
augcccgugagcaucaugcacauucugcucaugugcgccguccugugucuucagcaauacggccugggggagacccauagaccuaacaauggaacagaacacaacaagacgaauguucucaccacaccgggcgacaaacugucccccgagcuuccugugucuaccgcucugagcgugacacccgauuccucuaccgucacaccuaccacgcccgugagcgggcucgaaggauccggcgacguuuauaccucuccuccggugacaaccaaggggcugagccccuccaaagccacaagcgagcugccugcgucuuccggaaucgauaccagcucugcuuccgacgucgauagcucuacgcaggccgcccgggacacauccacccucacagugcgcaccagcccucccuccucucccagcaccccgccuacaucccaggauacguaccaucugguuagaaaccuucugagcgugaccucucccuggccugaagagacaaccgcucccuccaagagcggcaaagagucucccgucgccaauagcccucacccggugacaucccggcccucuagcccucccauuaccgugcagggcccuacggaaaacuccagccauaauacaaccgggcaacucgagucuauggcucaguccaccacacugguccccauggccagcccgacccagacaguucuuucucaguccgugacgagccuggcggugcaagacgcccacccuucccccaccaaccgcucuaagagaaaucucgaaauggucaucauucugacacugccucagggacucaagaaauauuacggcaaggugcugcggcuucugcagcucacccuggaggaggauacagaagggcuucuggaguggugcaaacgcaaccucggacuggacugugaugacaccuucuuucagaagagaaucgaagaguucuuuaucacgggcgaagggcacuucaaugagguucugcaauuuaaaacccccagcacacucuccaccacagagucuacccaugcugugagcccuacggccgaacccuucaaguccuauuuugcuaagggauuccugagcauugauucuggcuacuuuuccgccaaaugcuauagcaagacaucuaacuccggccuucagcugaucaaugucacccggcacagcacacgcauugcggacaccccggggccuaaaaucaccaaccucaagacaauuucuuguaucaaucugaaagccagcguguucaaggagcauagagaaguugagauuaacgugcuucugccccaggucgcugugaaccucuccaauugccacgucacgaucaaaagccacgugugugacuacucucuggauguugacggaaccgugcggcugccccauauccaccauggcgggacauuuauuccuggaaccuacaagaucgucauugauaagaaaaacaagcucaaugaccgcugcacacuguauaccaacugugugaucaaaggcagagaaguucggaaggggcaauccauucuucgccaguacaaaacggagaucagaaucggaaaggccagcacaggcucccggagacugcucucugaggaaagcggcgaugacugcauuucccgcacccagcugcugcggaccgagacagcugaaauccacggggaugacuauggaggcccgggggauaagauuaccaucuguaauggaucuacaauuguggaccagagacuuggcagcgagcucgggugcuacacgaucaaccgcgucaaauccuucaagcugugcaaaaauucugccaccggcaagagcugugaaaucgauuccacacccgugaaaugccggcaaggauauugucugaagauuacccaggagggcagagggcaugugaagcucagccgcggaucugagguuguccuggacgccugcgacuccagcugugaagugaugaucccuaaaggcacaggggauauucuuguggacugcucuggaggccagcagcacuuucugaaggauaaccucaucgaccugggguguccccggauuccucugcuuggcaaaauggcuaucuacauuugcagaauguccaaucaccccaagaccacgauggcguuccucuucugguuuagcuucggauaugucaucaccuguauccugugcaaagccaucuuuuaccugcucauuauugugggcacacuggggaagcgcuucaagcaauaccgggagcuuaaaccucagaccuguacaaucugcgaaaccacacccgcuaacgccauugaugccgagaugcaugaccugaauugcucuuauaacaucuguccguacugcgcuuccagacucaccagcgauggacuggcccgccacguuacgcaguguccuaagcggaaagagaagguggaagagacagaacuguaucuuaaucucgagagaauccccuggauuguccggaaacugcuccagguguccgaaagcaccggcguugcgcucaagcgcucuagcuggcugaucgugcuucugguccucuuugcugugucccugucuccuguucaaagcgcccccauugggcauggaaaaaccaucgagacauaccaggccagagaggacuauaccuccauuugccuguucgugcuuggcucuauccucuuuaucgucagcugucugaugaaggggcugguggauuccauuggcaacaucuucuuuccgggacucacgauuugcaagacauguucuaucggcagcauuaauggguucgaaaucgagucccacaaaugcuacuguagccugcuuugcuguccuuauugccggcacugcucugcugacagagaaauccaucagcugcaccucuccauuuguaagaaacgcaagaccggaagcaacgugaugcuggccgucugcaaacggauguguuuuagagcuacaauggagguuucuaacaaggcccugcuuauccgcuccauuaucaauaccacauucguggugugcauucugauccucgcggucugugugguuagcaccuccgccguggaaauggagucucugcccgcuggcacgugggagagagaagaggaucucaccaacuuuugccaucaggaaugucaagucacagagaccgaaugccuguguccuuacgaggcccuugugcugcggcgcccccucuuccuggacagcauuguuaaggggacaaagaaucugcuuaacuccaccagccuggagacgucucucuccaucgaagcucccuggggagccaucaaugugcagagcacauacaagccuaccgucucuacagcgaacauugcccugagcugguccucuguggagcacagaggcaauaaaauccucguuagcgggcgguccgaaucuauuaugaagcuggaggagcgcaccggcaucagcugggaucuuggaguggaagacgcuuccgagagcaaacugcucaccgucucugugauggaccugucccagauguauagcccgguguucgaauaccuguccggcgauagacaagucgaggaauggcccaaggccacaugcacgggggacuguccugagcggugcggaugcaccucuagcacaugucuucauaaggaguggccccacucccgcaacuggagaugcaauccuaccugguguuggggcguugggacaggaugcaccuguugcggccuggaugugaaagaccucuuuacggauuauauguucgugaaguggaaagucgacuacauuaagacagaagcuaucguguguguugagcugaccucucaggaacggcagugcagccucguggaggccggcacccgcuuuaaccuggggcccgucacaaucacccuuuccgaaccuagaaauauucagcaaaaacugccgcccgagaucauuacacugcacccucggaucgaggaaggauucuuugaucucaugcaugugcagaagguucugagcgccucuacgguguguaaacuucaguccugcacccacggcguccccggggaccuccagguguaucauauuggaaaccugcugaaaggcgauaaggucaaugggcaccucauccauaaaaucgagccucacuucaacacaagcuggaugucuugggacggaugugaucuggacuacuauugcaauaugggcgauuggcccuccugcaccuacacaggcgugacccaacacaaccaugcuagcuuuguuaaccuucugaauauugaaacggacuacaccaagucuuuccacuuucauagcaaaagagugacagcgcacggggacaccccgcagcuggaucucaaggcccgcccuacauauggagcuggcgagaucaccguccugguggaaguugccgacauggagcuucacacaaagaagauugagaucacggggcugaaguucgccucccucaccuguacaggaugcuacgcuuguucuagcggcauuuccugcaaagugcggauccaugucgaugaacccgacgagcugaccgugcacgugaaaagcgaugaccccgauguugucgccgcguccucuagccucauggcuagaaaacuggaauuugggaccgacuccacauucaaggccuuuucugccaugccuaaaacgagccuuuguuucuauauuguggagcgcgaguacugcaaguccuguucuaaggaagauacccagaaaugcgugaacacaaagcuggagcagccccaaagcauccugaucgaacggaaaggaaccauuaucggcaagcagaauaacacauguaccgcuaaagccuccugcuggcucgagagcgucaagucuuucuuuuauggccugaagaauaugcuuuccgggauuuucggaaacguguuuguuggcaucuuccuguuucucgcgccuuucauucugcucauccuguuuuucauguuuggguggagaauccuuuucuguuuuaaaugcugccgccggacgagaggacuguucaaguacaaacaucugaaggacgaugaagagacaggcuaucgccggauuaucgagagacucaauaacaaaaaggggaagaauaaacugcuugacggagaacggcuggcugaccgcagaauugccgagcuguucagcaccaagacccacaucggcuga

SEQ ID NO: 13584 - RNA, 5067 nt, Artificial Sequence
  derived and/or modified CDS sequence (opt5) from CCHFV(Kosovo/9553/2001)__AY675511.1__GP
augcccaucaacauuaugcacacccugcucgugugcuucauccuguaccuucagcugcucggccugggaggagcccauggccaaagcaaugcuacagagcacaacgggacgaauaccacaaccgccccuggaacaucccagucuccgaagcccccugcgagcaccacacccucccaugcuccugaaucuagcaccauuaaacuuacgacccccacauccgagaccgaaggcucuggggagacaaccccuccgacgagcacaacccagggaucucccccucuggaaacaacccccgagagaagcaccacaacggccaccucuacauccggcaccgacaacaugaauagcacaacccagaugacggauaacacaccuacccucaccgccucuacaucccccagcuccuccccgagcaccccuuccacaucucaaggccugcacuaucccguccggagccugcucuccguuagcucuccuaagacggugaccacacccacccccauguccccuggggagaugagcucugaaacaagcucccagcauucugcuaugagccgcaccccgacgccccacaccgccacacagguguccaccgagaaugcuaacagaagcacaucucggcaguccgaaagcucugcccaaccugcgacccagucccccgucacgagcccugcccaguccauccugcuuaugucugcuacacccaccacaauucagaauauccacccgagcccuaccaaccgcuccaaaagaaaucuggagauggagaucauucucacccugucucaaggacuuaagaaauacuauggcaagauccugaagcuccugcaucugacacucgaagaggacacggaagggcugcuugagugguguaaacggaaccugggaagcaauugcgaugacgacuuuuuccagaagcgcauugaagaguuuuucaucaccggcgagggguacuuuaacgaagugcuccaguucaaaacacuguccacccccagcccuacagagcccucucacgccagacuuccuaccgcugaacccuuuaaguccuauuucgccaaaggauuucugagcauugauucuggcuacuucuccgcgaaguguuauccgcggagcucuacgagcggccuccaacugaucaauguuacacagcauccugcccgcauugcugagacccccgggcccaagaucaccucccugaaaacaaucaacugcauuaaccucagagccagcguguuuaaggaacaccgggaggucgagaucaaugugcugcuuccucagauugcuguuaaccugucuaauugucacguggucaucaacucccaugugugcgauuacagccucgacaccgauggaccggugcgccugcccagaauuuaccacgaaggcacauucaugccugggacguauaaaaucgucaucgaccggaagaauaaacuuaacgaucgcuguacccugguuacaaauugcgugauuaagggaagagaggugcggaaaggccaguccguccucagacaauacaagaccgaaaucaagauugggaaagcccccacaggaucucgcaagcugcugagcgaggaaccuggcgacgauuguaucucccggacccagcuccugagaacggagaccgccgagauucaugacgacaacuauggcgggcccggagauaaaaucacaaucugcaauggcucuaccauuguggaccagcgccuugggagcgaacugggauguuacacaaucaaccggguuaaguccuuuaaacucugcgaaaauucugcuaccggcaagacaugcgagauugauagcaccccugugaaguguagacagggguucugccugaaaaucacgcaagagggccgcggacacgucaagcugucccggggcagcgaggugguucuugacgcgugugauucuuccugcgaagugaugauucccaaagggacaggagacauccucgucgauuguagcggcgggcagcagcauuuccugaaggacaaccugauugaucucggaugcccgcacaucccucugcuuggcaaaauggccaucuauauugcuagaaugucuaaucaccccaagaccaccauggccuuucuguucugguuuucccucggguacgugaucacauguauucugugcaaggcccuguucuauagccuuaucauuaucggcacccucgggaaaaagaucaaacaguaccgcgagcugaagccucaaacguguacaauuugcgaaaccgcucccgucaacgccaucgacgcggagaugcaugaucugaauuguucuuacaacauuugcccguauugcgcuucccggcucacaagcgacggccuggccagacacgugaaacaguguccuaagcgcaaggaaaaaguugaggagaccgaacuuuaccugaaccucgagcggauccccuggguggucagaaagcugcuucagguguccgaaagcacagggguugcccuuaaacggucuagcuggcucauugugcugcugguccuccugaccgugucccuuucuccugugcagagcgcucccguuggacauggcaagacgaucgagaccuaucaaacacgcgaaggguuuaccuccaucugccuguucaugcucggaucuauucuguuuaucgucagcugucuggugaaaggccuuguggacuccgucucugauagcuucuuucccgggcucuccgugugcaagacauguagcauuggcucuaucaauggauucgagauugagucccacaaaugcuacuguagccuguuuugcuguccuuauugcagacacuguucugccgaccgggaaauccaucagcugcaccucuccaucugcaagaagagaaaaaccggcagcaacguuaugcuggcugugugcaagcgcauguguuuccgggccacgauugaggcguccagacgcgcccuucugaucagaucuauuaucaauacaaccuuugucauuugcauccucacacugaccauuuguguggcuagcaccuccgccguugaaauggagacacugccggcugccacgugggaacgggaggaggaucuuaccaacuucugccaucaggaaugucaagugcccgagacagaaugccuguguccuuacgaggcgcucguccugcgcaaaccccucuuccuggacagcaucgugaaggggaugaaaaaucuucugaacucuaccucccucgagacaagccugucuaucgaagccccuuggggagcuauuaauguucagagcaccuuuaagcccacgguguccacagccaacaucgcucugucuuggagcuccgucgagcacagaggcaauaagauucuugugaccgggcggucugaaagcaucaugaaacuggaggaacgcaccggaguguccugggaucucggcgucgaggacgccagcgagucuaagcugcucacaguuuccauuauggaucugagccagauguauuccccuguguucgaauaccuuucuggggacagacagguggaggaauggccgaaagcuaccugcacaggcgauugucccgagcggugcggauguacgagcucuaccugccugcauaaggaauggccucacucccgcaacuggagaugcaaucccacaugguguuggggcgucgggaccggaugcacauguugcggcguggacguuaaagaucucuuuaccgaccacauguucgugaaguggaaggucgaguacaucaaaacggaggcuaucguguguguugaacugaccagccaagagcggcagugcucccugauugaagcggggacacgcuuuaaccuuggaccugugaccaucacacugagcgagcccagaaauauucagcagaagcucccgccugaaaucauuacccugcaucccaaaaucgaggagggcuucuuugaucucaugcacguccaaaaggugcugucugccuccacaguuuguaaacuucagagcugcacgcauggcauccccggggaccuccagguguaucacauuggaaaccugcugaagggcgaccgggucaaugggcaucugauccacaagauugaaccucacuucaacaccucuuggauguccugggauggaugugaccuugauuacuauugcaacaugggcgacuggcccagcuguacauacaccggggugacccagcauaaucacgcugccuuugugaaccugcucaauaucgagacagauuauacgaaaaccuuccauuuucacucuaagagagucacagcccacggagacaccccucaacuggaucucaaagcucgcccgacauacggcgccggcgaaauuaccguucugguggagguggcggacauggagcuucauacgaagaaagucgaaaucagcgggcugaaguucgcuucccuggccugcacaggaugcuaugccuguucuagcggcauuuccugcaaagugcggauccacguugaugagcccgacgaacucaccgugcaugucaagagcuccgauccugacgugguugcugccucuaccagccugauggcgagaaagcuggaguuugggacagauuccaccuucaaagccuucucugccaugcccaagacaagccuguguuuuuacaucguggaaaaagaguacugcaaguccuguucugaggacgacaccaaaaagugcgucgauacgaagcucgaacagccucagagcauucugaucgagcaccgcggaacaauuaucggcaaacccaacgacaccuguccggccaagacauccugcuggcucgaaagcgugaaaucuuucuuuuaugggcugaagaauaugcuuggauccgucuucggcaacuuuuucauuggcauccugcuguuucucgcuccuuucuuucuguggaugcuuagcuucauguuuggguggaaaauccuguucuguuucaagugcugucggagaacccgcggacucuuuaaguaccggcaucugaaagaugacgaggaaacgggcuauagacgcauuaucgagcggcucaauaacaagaaagggaagaauagacugcuugauggagagcggcuggccgaccgcaaaauugcugaacuguucucuaccaagacacacaucggcuga

SEQ ID NO: 13585 - RNA, 5067 nt, Artificial Sequence
  derived and/or modified CDS sequence (opt5) from CCHFV(200406546-Turkey)__KR864902.1__GP
augcccaccaacaucacacacacgcugcucgugugcuucauucuguaccuucagcugcucggcagagggggagcccauggccaaagcaaugcuaccgagcacaacgggacaaauaccacaaccgccccuggaacaucccagucucauaagccgcuggugagcaccacgcccccucacacccuugaauccucuacaaucaaacauaccacacccaccagcgagacggaaggcuccggggagacaaccccucccccuaacacaacccagggaccgucucccccugaagcgacccccgagcggccugcuacaacggccaccagcacacccuccaccgacaauacaaacagcaccacgcagaugaaugauaacaauccgacaucuaccauuuccaccagcccuucuuccagccccucuacaccucccacaccccaaggcauccaccacccugcccgcucccugcucagcguuuccucucugaagaccgcuacgaccccgacacccaccagcccuggcgagauuuccagcgaaacaucuucccagcauagcgccaugucuagaacccccacgcugcacaccacaacccaggugagcacagaguccaccaaccauucuacgccucggcagagcgaauccagcgcucaacccacaaccccgucuccuaugacaucccccgcccagagcauccucccuaugucugcggcccccaccgcuauccagaauauucacccuucccccaccaaccgcagcaaaagaaaucuggagguggagaucauucuuacacugucccaggggcucaagaaauauuacggaaagauccugaagcugcugcaccucacgcuggaagaggacaccgaaggccugcucgagugguguaaacggaaccuggggucuagcugcgaugacgacuuuuuccaaaagcgcauugaagaguuuuucgucacaggagagggcuauuuuaaugaagugcuucaguucaaaacccuguccacacucucuccgaccgagccuagccaugccaagcugcccacgguugaacccuuuaaauccuacuucgcuaagggguuucuuagcaucgacucuggauauuucuccgccaaguguuacccuagaagcucuacauccggccugcagcucauuaacgugacccaacacccggcgcggaucgccgagacccccggcccuaaaacaaccagccugaagacaaucaacugcauuaaucugcgcgcuucugucuuuaaagaacauagagagaucgagauuaacgugcuccugccccagaucgccguuaaucuuagcaacugucacgcugugauuaagucccaugucugcgauuauagccuggacacggaugggccugugcggcucccccacaucuaccacgaaggaaccuucaucccuggcacauacaaaauugugaucgacaagaaaaauaagcugaacgaucgcuguauucuugucaccaauugcguuaucaaggggagagaggugcggaaaggacagucugugcugcgccaguauaagacagaaauuaaaaucggcaaggccuccaccgggagcagaaaacuccuguccgaggaacccggagacgauuguaucucucggacgcaacugcucagaaccgagacagccgagauucaugacgacaacuacggcggcccgggggauaagaucaccauuugcaauggaagcacaaucgucgaccagcgccugggcuccgaacuuggguguuauaccauuaaccgggugaagucuuuuaaacugugcgagaauagcgcuacaggaaagaccugcgaaaucgauuccacgccuguuaaauguagacagggcuucugccucaagauuacacaggaggggcgcggccacgugaaacugucucggggaagcgaggucgugcuggacguuugugauuccagcugcgaagugaugauccccaagggcaccggggacauccuugucgauuguucuggaggccaacagcauuuccucaaggacaaccugauugaucuggggugcccucacgugccccuccugggaagaauggcgaucuacauuugucgcauguccaaucacccgcggaccacaauggccuuucuuuucugguuuagcuucggcuaugucauuaccugcaucuuuuguaaagcucuguucuacucucucaucaucauugggacgcugggcaagaaauuuaagcaguauagagagcugaaaccucagacaugcaccaucugugaaacagcccccgugaacgccauugacgcugagaugcaugaucuuaauugcuccuacaacaucugcccuuacugugccagccgccucaccucugacggacuggcgcggcacguuccccaaugccccaagagaaaggaaaaaguggaggagacagaacuguaucucaaccuggagcgcauuccuuggaucguccggaaacuucuucagguguccgaaagcaccggcguugcucucaaaagauccagcuggcugaucgugcugcuuguccuccugacggugucucugagcccggugcaguccgcccccguugggcauggaaagaccauugagacauaccagacccgggaaggcuucacaucuaucugucucuuuaugcuggggagcauucuuuucaucgucuccugccuggugaaaggacucguggacucugucagcgauuccuuuuucccuggccugucuguguguaagaccugcagcauuggguccaucaauggcuuugagaucgagagccacaaauguuauugcucucuguucuguugccccuacugucgccauugcuccgccgacagagaaauucaccaacuucaccucagcaucugcaagaagcggaaaacgggaucuaacguuaugcuggcuguguguaagagaaugugcuuccgcgccacaauugaggcuucccggagagcccugcucauccgcagcauuaucaauaccacauuugucauuuguauccugacccuuaccaucugcgugguuuccacaucugcgguggaaauggagaaccugccugccggcacgugggaaagagaggaggaucucaccaauuucugucaucaggaaugccaggucacagagaccgaaugucugugccccuaugaggcucuggugcuucggaaaccucuguuucucgacagcauuguuaaggggaugaaaaaccugcucaauuccacaagccuggagaccucucuuuccaucgaagccccguggggagcuauuaacgugcaaagcacguucaagcccacagucucuaccgccaauaucgcgcugagcugguccucuauugagcaccgcggcaacaagauccucgugaccgggagaagcgaauccaucaugaaacuggaggaacggacaggagugucuugggaucugggcgucgaggacgccagcgaguccaaacuucugaccguuagcauuauggaucucucucagauguacuccccuguguuugaauaucugagcggggaccgccagguggaggaauggcccaaggcuacauguacgggcgauugcccugagagauguggaugcaccuccucuacaugccuccauaaggaauggccccacagccggaauuggcgcuguaacccgaccuggugcuggggcgucgggacaggauguaccugcuguggcguggacguuaaagaucuguucacggaccauauguuugugaaguggaaggucgaguacaucaaaaccgaggccauugugugcguugaacuuacaucccaggagagacaauguucucugaucgaagcugggacccgguucaaucucggaccugugacaauuacccugagcgagccccgcaacauccagcagaagcugcccccugaaaucauuacacuucaccccaaagucgaggagggcuuuuucgaucugaugcacgugcagaagguucucuccgccagcacggugugcaaacugcaaucuuguacccauggcaucccuggggaccuccaggucuaccacauuggaaaucugcuuaagggcgacagagugaacgggcaucugauccacaagauugaaccgcacuuuaacacauccuggaugagcugggauggaugcgaccuggauuauuacuguaauaugggcgacuggcccucuugcaccuauaccggggugacacagcauaaccacgccgcuuucgucaaucuccugaacaucgagacggauuacaccaaaacauuucauuuccacuccaagcggguuaccgcgcauggagacacaccucagcuugaucugaaagccagacccaccuauggcgcuggcgaaauuacggugcucguggaggucgccgacauggagcugcacacaaagaaaguggaaaucagcgggcucaaguucgccucucuggcuugcaccggauguuacgccugcagcuccggcaucucuuguaaaguucgcauucacguggaugagccugacgaacuuaccguccauguuaagagcuccgaucccgacgugguggcggcuagcacaucccugaccgcccggaagcuggaguuugggacagauucuaccuucaaagccuuuagcgcuaugccgaagacgucccucugcuucuauaucgucgaaaaagaguacuguaagucuugcaaugaggacgacacacaaaaauguguggauaccaagcuggaacagccucagagcauucuuaucgagcacaagggaacaauuaucggcaaacaaaacgauaccugcacggccaaggcguccuguuggcuggaaucugucaagagcuuuuucuacgggcucaagaauaugcugggauccguguuuggcaacuucuuuaucggcauucuccuguuccuugcucccuuuguucugcugguccucuucuucauguuuggguggaaaauccuguucugcuuuaaguguugcagacgcacccggggacuuuucaaguauagacaucugaaagaugacgaggaaacaggcuacaagcgcauuaucgagcggcucaauaacaaaaaggggaaaaauagacugcucgauggagagcgccuggccgaccggaagauugccgaacuuuuuagcaccaagacacacaucggcuga

SEQ ID NO: 13586 - RNA, 5067 nt, Artificial Sequence
  derived and/or modified CDS sequence (opt5) from CCHFV(Haskovo-V46/13)__KR092379.1__GP
augcccaccaacauuaugcacacccugcuggugugcuucauucuguaccuucagcugcucggacucggaggggcccaugggcaaagcaauacgaccgagcacaacgggaccaauaacaccacagcuccuggaaccucccagucuccgaagccccauaugagcacaaccccuccccacgccccugaauccucuacgaucaaacccaccacaccuaccagcgagacagaaggcuccggggagaccacgccgcccucuaauacaacccagggaccuuccccucccgaaacaaccuccgagagacccgcgaccacagcuauuagcacgucuuccaccgauaacaugaauccgacaagccagaugaccgauaacacaccuaccucuacgguguccaucagccccucuuccagcccuuccacacccucuacaccccaaggcaugcaucacccugcccggagccuucuguccguuagcucuccgaagaccgccacaacccccacaccuacgucccccguggaggugggcagcgaaaccucuagccagcacuccgcuaugucuagcacaccuacaccccauacagccacccaggucuccacggagaauaccaaccacagcacaccgcgccagucugaaccuuccgcucaacagaccacacccagcccuaugcccucuccugcccaguccacccuccugaugagcgcggcccccacggcugugcagaauacacauccguccccuaccaacagaucuaaacggaaucuggagauggagauuauccucacacugagccaagggcuuaagaaauauuacggaaagauccugaagcuccugcaccuuacccuggaagaggacaccgaaggccuccuggagugguguaaacgcaaccugggguccaauugcgaugacgacuuuuuccagaagagaauugaagaguuuuucaugacaggagagggcuauuuuaacgaaguucuccaguucaaaacgcugucuacccuuagccccauggagcccucccacgccgaacugccuacagcugagccguuuaagagcuacuucgccaaaggguuucucucuaucgacuccggauauuucagcgcgaaguguuacccccggucuuccaccagcggccugcaacuuauuaacgugacacagcauccugcccgcaucgcugaaacccccggcccuaagacgacaucucugaaagccauuaauugcaucaaccucagagcuagcgucuuuaaggagcaccgggagauugaaaucaaugugcugcugccccagaucgccguuaaccucuccaauugucauguggucauuaacagccacgugugcgauuauucucuggacaccgaugggccugugcgccuuccccauaucuaccacgagggaaccuucauuccgggcacauacaaaaucgucauugacaagaaaaauaagcugaacgauagauguacccucguuacaaauugcgugaucaaagggcgggaagugcgcaagggacaguccguccugagacaauauaagacggagaucaaaauuggcaaggccagcaccgggucccggaaacuucugucugaagaacugggagacgauuguaucagccgcacacagcugcugagaaccgagacagcugaaauucacgacgacaacuacggcggcccuggggauaagaucaccauuugcaauggauccacgaucguggaccagcggcucggcucugagcugggguguuauaccaucaacagaggaaagagcuuuaaacuuugcgaaaauuccgcgacaggcaagaccugcgagauugauucuacacccguuaaaugucgccagggguucugccugaagaucacccaagagggccggggacaugugaaacucagcagaggcuccgaagucgugcuggacgccugugauagcucuugcgagguuaugauuccuaaggggacaggagacauccugguggauuguuccggcgggcagcagcacuuccuuaaagacaaccucauugaucugggaugcccccauaucccgcugcucggcaagauggcuauuuacaucugucgcaugagcaaucacccucggaccacgauggccuuucuguucugguuuucuuucggguaugucaucacaugcaucuuuuguaaggcccuuuucuacucccugaucauuaucggcacccucggcaaaaagauuaaacaguauagagaacugaagccccaaaccugcacaaucugugagaccacgccugugaacgcuaucgacgccgaaaugcacgaucugaacugcagcuacaauauuugccccuacugugcgucucgccuuacauccgacggccucgcucggcaugucacccagugccccaaaagaaaggagaagguggaggaaacagagcuguaucugaaccucgaacgcaucccuuggauuguucggaaacugcuucaggugagcgaguccaccggggucgcccugaagagaagcucuuggcucaucgugcugcugguucuucucccggugagccugucccccguccagucugccccugugggacacggcaaaacaauugaaaccuaccaaacgcgcgagggguuuaccagcaucugucuguucaugcucggauccauccuguuuauugugucuugccuuguuaagggccuggucgacagcgugggggauuccuucuuucccggccucucuguguguaaaacaugcagcaucggauccauuaauggcuucgagaucgaaagccauaaguguuauugcucucuguuuuguugcccuuacugucggcacugcuccgcugacagagagauucaucagcugcaccuuagcaucugcaaaaagcggaagaccgggucuaacgucaugcucgccguguguaaacgcaugugcuucagagcuacaaucgaagccucccggagagcgcugcugauucgcagcaucauuaauaccacguucgccauguguauccucacacugaccauuugcguuguguccacaucugcugucgagauggaaaaccuucccgccggaaccugggagcgggaggaagaucugaccaauuuuugucaccaggagugccaagugacagaaacggagugucucugcccuuaugaggcucugguucugagaaagccgcuuuuccuggacagcaucgugaaaggcaugaagaaccuccugaauagcaccagccucgaaacaucucuguccauugaggcccccuggggagcgaucaacguccagagcaccuuuaaaccuacagugucuaccgccaauaucgcucuuagcugguccucuguugaacaucgcggaaacaagauucuggugacgggcagaagcgaguccaucaugaagcucgaggaacggacaggggucucuugggaucugggcguggaggacgccagcgaauccaaacugcuuaccgugagcauuauggaucugucucagauguacucccccgucuucgaguaucucagcggagaccgccagguugaagaguggccuaaggcuaccuguacaggcgauugccccgaaagaugugggugcaccuccucuacaugccugcacaaagaguggccgcauagccggaauuggcgcuguaacccuacguggugcuggggagugggcaccggguguacaugcuguggaguggacgucaaggaucucuuuaccgaccacauguucgugaaauggaagguugaguacaucaagacagaagccauugugugcgucgagcugaccucccaagaaagacaguguucucuuaucgaggccggcacgcgguuuaaucugggccccgugaccaucacacucagcgaaccccgcaacauucagcagaaacugccucccgagaucauuacccugcauccuaagaucgaggaaggguucuuugaucuuaugcacguucaaaaagugcuguccgcuagcacagucugcaagcuccagucuuguacccacggcauuccgggcgaccuccagguguaccauaucgggaaccuccugaaaggagacagaguuaauggccaccuuauccauaagauugagccccacuucaacacauccuggaugagcugggaugggugcgaccuggauuauuacuguaauaugggagacuggccuucuugcacguauaccggcgugacacagcacaaccaugcggccuuugucaaucugcucaacaucgaaaccgauuacaccaagacauuccacuuucauuccaaacgggugacggcucacggcgacacaccccaacuggaucuuaaggcccgcccuacauauggggccggagagauuaccgugcuggucgagguugcugacauggaacuccauaccaaaaagguggagaucagcggccugaaauucgccucucuuaccugcacgggguguuacgcgugcagcuccggaauuucuuguaaggugagaauccacgucgaugaacccgacgagcugacagugcacguuaaaagcuccgauccggacguggucgcugccggcaccagccuuauggcccggaagcuggaguucgggaccgauuccacauuuaaggcuuucucugccaugccuaaaaccagccugugcuuuuauauuguggagagagaguacuguaaguccugcucugaagacgacacacagaaauguguugauaccaagcucgagcagccccaaagcauccugaucgaacauaaaggaacgauuaucggcaagcagaaugacacaugcaccgcgcgcgcuuccuguuggcuugagucugucaagagcuucuuuuacggccugaaaaacaugcucggguccgucuucggaaauuuucugauuggcauccuccuguuccuugccccuuuugugcugcugguccucuucuuuauguucggguggaagauucuguucugcuuuaaauguugccggagaacacgcggacuuuucaaguaucggcaccugaaagaugacgaagagaccggcuacagacgcaucaucgagcggcucaacagcaagaaggggaaaaauagacugcucgauggagaacgccuggccgaccggaagauugcugagcucuuuucuacgaaaacccauaucggcuga

SEQ ID NO: 13587 - RNA, 5067 nt, Artificial Sequence
  derived and/or modified CDS sequence (opt5) from CCHFV(VLG/TI29414)__AY179961.1__GP
augcccaccaacaucaugcacacacugcucgugugcuucauucuguaccuucagcugcucggccuugggggagcccauauccaaagcaaugcuacggagcacaacggcaccaauacaaccacagccccuuccaccucucagagcccgaagccccuugucuccacagcgccuccccaugcucuggaaucuagcaccauuaaaccuacgacccccguuuccgagacagaagggucuggaggcaccacaccuccgcccaacaccacgcaggggccuagcccucccgaggccacacccgaaagaccggccaccacagcuaccuccaccccuagcacagacaauacgaacucuaccacacacgugaccgauaauaaccccacauccaccaucagcacgucuccuuccagcucucccuccacacccagcaccccucaggggauucaucacccggcccggaaucuccuguccgugucuagccccaagaccgcuacaaccccuacacccacguccccuggcgacaucagcucugagaccuccagccugcacucugccaugagccgcacauccacccucuauacagcgacccaagucucuacggagaacgccaaucauagcgcucccagacaguccgaaagcucugcccagcagaccacaaccuccccgaugacaagcccugcucaacccauccuggugaugucugccgcgccuaccgccauucagaacauccaccccuccccuacgaaucggagcaaacgcaaccuugagauggaaauuauccugacacucucccagggccugaagaaauacuaugggaagauucuuaagcugcuccaucugacccuggaggaggauacagaaggacuccuggagugguguaaaagaucucuuggcagcaauugcgacgaugacuuuuuccagaagcggaucgaagaguuuuucaugaccggggaaggauacuuuaacgagguucugcaauucaaaacccucuccacacugucucccacggagccgagccacgcucgcccucccaccguggaacccuuuaaguccuauuucgccaaaggcuuucuuagcauugauucuggguacuucuccgcuaaguguuauccuagacugagcacaucuggacuccagcugaucaacgucacccagcacccggcccggaucgccgagacacccggcccuaagaccacgucccugaaaacaauuaauugcaucaaccuccgcgcuagcguguuuaaggaacauagagagauugaaaucaauguucugcuuccccaaauugcggugaaccugucuaauugucacgucgugaucaacagccaugugugcgacuacucccucgauaccgacggcccuguccggcugccccacaucuaccaugaggggaccuucauuccuggaacauauaaaaucguuauugauaagaaaaauaaacuuaacgaccgcuguacccuggugacaaauugcgugaucaagggcagagagguccggaaggggcagagcgugcuccgccaguacaagacggaaauuaaaaucggaaaggccucuaccggcuccagaaaacugcugagcgaggaacccggggaugacuguaucucccggacacagcuccugagagcugagccggccgaaauucacgacgauaacuauggaggcccuggcgacaagaucaccauuugcaaugggucuacaaucguugaucaacgccuuggaagcgagcugggcuguuacaccauuaaccgggugaaauccuuuaagcucugcgaaaauucugccacggggaagaccugcgaaaucgacagcacacccgucaaauguagacagggauucugccugaagauuacccaggagggccgcgggcacgugaaacugucccggggcucugaaguugugcuugaugcuugugacagcuccugcgaggucaugaucccuaagggaacaggcgauauccucguggacuguagcgggggacagcaacauuuccugaaagauaaccugauugaccucggcugcccccacaucccgcugcuugggaagauggccauuuauaucuguagaaugucuaaucauccucgcaccacaauggcguuucuguucugguuuuccuucggauacgucauuaccugcaucuuuuguaaggcucucuucuauagccugaucauuaucggcacgcuggggaaaaagauuaaacaguaccgggagcuuaagccccagacaugcaccaucugugaaaccgccccugugaacgccauugaugcugagaugcacgaccucaacugcucuuacaauaucugccccuauugugccuccagacugacaagcgacggccuggcucgccacguuccccagugcccuaaacggaaggaaaagguggaggaaaccgagcucuaccugaaccuugagagaaucccguggaauguccgcaaacugcuccaagugucugaauccacgggaguugcccugaagcggagcuccuggcugauugugcuucucguccugcugacagugagccucucucccgugcagagcgcgccuguuggccaugggaaaaccaucgagacauaucagaccagagaaggauuuacauccauuugucuguucaugcuuggcucuauccuguuucucgucagcugccuggugaaggggcugguggauuccgucucugacagcuucuuucccggacuuuccguguguaaaaccugcucuauuggcagcaucaacggguucgagaucgaaucccacaaguguuacugcagccucuuuuguugcccuuauugucggcauugcucugccgaucgcgagauucaccagcugcaucuguccaucugcaaaaagagaaagaugggcagcaauguuaugcucgcuguguguaaacggaugugcuucagagccacgauugaggcuucucgccgggcccugcuuaucagauccauuaucaacaccacauucgucauuuguauccugacccucacaaucugcgugguuagcaccuccgcgguggaaauggagaaucugcccucuggaacgugggaacgcgaggaagaccugacaaacuuuugucaccaagagugccaggucaccgagacagaaugucuuugcccuuacgaggcccuggugcucagaaagccgcuguuccucgauagcauuguuaaaggcaugaagaaucugcuuaacuccaccaaucuggaaaccagccucucuaucgaggcucccuggggagccauuaacgugcaguccacauuuaaaccuacggucagcaccgcuaauaucgcccugucuuggagcuccguggagcaccggggaaacaagauucuggugacaggccgcucugaaagcaucaugaaacuugaggaaagaaccggggucuccugggaccugggaguugaggaugccucugaaagcaagcuccugacaguguccaucauggaccucagccaaauguauucucccguguucgaguaccuguccggcgaucggcaggucgaggaauggccuaaggcuaccuguacgggggacugccccgagcgcuguggcugcacaagcucuaccugccuucauaaagaauggccgcacuccagaaauuggcgguguaacccuaccuggugcugggaggugggaacaggcuguaccugcuguggguggaacguuaaggaucuguuuacagaccauauguucgugaaauggaaggucgaauacauuaagacggaggcgaucgugugcguugagcucaccagccaggaacgccaguguucccugauugaggccggaacaagauuuaaucugggccccgugaccaucacacuuucugaaccccggaacauucaacagaaacugccucccgagaucaucacccuccacccuaaggucgaagagggguucuuugaucugaugcaugugcagaaaguucucagcgcuuccacggugugcaagcugcagagcuguacccacggcauuccgggagaccuucaagucuaucacaucggcaaucugcugaaaggggaccgcgugaacggacaucucauucacaagaucgagccccauuucaauacaucuuggauguccugggauggcugcgaccuggauuacuauuguaacaugggggacuggccuagcugcaccuacacaggaaugacccagcacaaucacgccgccuuugugaaccuucugaauauugaaacagauuauacgaagaccuuccauuuucacucuaaaagagucacagcucauggcgacacaccccagcucgaucugaaggcccggccuaccuacggggcgggagagaucaccguucucguggaaguggcugacauggagcugcacacgaaaaaggucgagauuuccggccuuaaauucgccagccuggccugcaccggcuguuaugcuugcucuagcgggaucuccuguaaggugagaauccauguugaugaacccgacgagcugacagugcacgucaaaucuaacgauccggacgugauugccgcgagcaccucccucauggcucgcaagcuggaguucggaacagauagcaccuuuaaggccuucuccgccaugccuaaaacgucucuuugcuuuuacaucgcugagcgggaauacuguaagagcugcuccgaggaggacacacagaaauguguugacaccaagcuggaacaaccccagucuauucucaucgagcacaaaggcaccauuaucgggaagcagaaugauacaugcaccgccaaggcuagcuguuggcuggaauccgugaaaucuuucuuuuauggacucaagaacaugcugggcagcgucuucgggaacuuuuucaucggcauucuucuguuucuggccccuuucgugcuccugguccuguuuuucauguucggauggaaaauccuguuuugcuucaaguguugcagacgcacacggggccuccugaaauacagacuccugaaggacgaugaggaaaccggguaucgccggauuaucgagagacuuaauaauaagaaaggaaagaaccgccugcuggacggcgagcggcucgcggauagaaaaauugccgaacuguuuuccacgaagacacauaucggguga

SEQ ID NO: 13588 - RNA, 5067 nt, Artificial Sequence
  derived and/or modified CDS sequence (opt5) from CCHFV(UCCR4405)__KY484029.1__GP
augcccaucaacauuaugcacgcccugcucgugugcuucauccuguaccuucagcugagcggccucgggggagcucauagacaauccaaugccaccgagcacaacggcacaaauacgaccacagcgccugggaccucucagagcccgaagcccccugucuccacaacccugccccauacaccugaagccucuaccauuaaacuuacgacccccacaagcgagaccgaaggauccggcgagacaaccccuccgcccaacacgacacaggggcugccucuccccggaaccacaccugaacggucugccaccaccgccacaagcacguccagcaccgacgauaugaacucuacaacccagaugacagacaauacccccacguccacaguuagcaucggccugucuuccagcccgucuaugccuuccaccagccaaggcauucacuaucccgugcgcucccugcucucugugagcuccccuaagaccgcuacaacccccacacccaugagcccuggggaggucucuccggagacguccagccagcauucugccaugagcagaauccccacccuguacacagcuacccagguguccacagaaaauaccaaccggucuaucccucgccagagcgaguccagcguucaacccgccacgcagucuccuauuaccucccccgcgcagacaauccuucugaugagcgccgcuccgaccgccauucaggauaugcacccuucucccaaaaauagauccaagcggaaccucgaaguggagaucauucugacacuuagccaaggacugaaaaaguauuacggcaagauccucaaacugcugcaccucacccuggaggaagacacggaggggcuucuggaaugguguaagcgcaaucucggauccaacugcgaugacgacuuuuuccagaaaagaauugaggaauuuuucaucacaggcgagggguauuuuaaugagguccugcaguucaagaccccuucuacacuuagccccaccgaaccuucccaugugcggcugcccaccgcugagccguuuaaaucuuacuucgccaagggauuucucagcaucgauuccggcuauuucagcgcgaaguguuacccuagaucuuccacaagcggccugcaacugauuaacguuacgcagcaccccgcccgcaucgcugaaacccccgggccuaaaacaaccucucucaagacaauuaauugcaucaaccugcgggccuccguguuuaaagagcaucgcgaagucgagauuaacgugcuucugccgcagaucgcugugaaucucagcaacugucacgucguuaucaauucucacgugugcgauuacagccuggacaccgauggacccgugagacuuccucggauucaucacgagggcgccuucauccccgggacguauaagauugucaucgacaaaaagaacaaacugaaugaucgcuguucccucgugacaaacugcguuauuaagggaagagaagugcggaagggccagagcguccugagacaauacaaaaccgagaucaagaucgggaaagccucuaccggaucccgcaagcugcucagcgaggaaccuggcgacgacuguauuucccggacacagcugcuuaaaaccgaaacagcugagauccaugaugacaauuauggcgggcccggagauaagauuacgaucugcaacggcucuaccauuguggaccagagacuggggagcgagcucggauguuacacaaucaaucgcguuaaguccuuuaaacugugcgaaaacucugcgaccggcaagacaugcgagauugauagcaccccugugaaaugucggcagggguucugccugaagaucacgcaagaaggcagaggacacgucaaacuuucccgcggcucugaggugguccucgacgccugugauagcuccugcgaggugaugauccccaaggggaccggagacauucugguugauuguagcggcgggcagcagcauuuccugaaggacaaucucaucgaucugggaugcccgcacauuccucuucugggcaaaauggcuaucuauauuugucggaugucuaaccaccccagaacaaccauggccuuucucuucugguuuuccuucggguacgugaucacaugcaucuuuuguaaggcccuguucuauagccugauuaucauuggcacccuugggaaaaagaucaaacaguaccgcgaacucaagccucaaacaugcaccauuugugagacggcucccgucaaugccaucgacgcggaaaugcaugaccugaagugcucuuacaacaucugcccguauugugcuucccggcugacaagcgauggccucgccagacacgugacccagugcccuaaacgcaaggagaaaguugaagagaccgagcuguaccuuaaucuggaacggauucccuggaucgugagaaagcuccugcaggucucugaguccacagggguggcccugaaacggagcuccuggcuuauugugcuccugguucugcucaccgucagccugucuccugugcagagcgcucccgugggacauggcaagacgaucgaaacauaucaaacccgcgagggguuuacauccauuugucuuuucaugcugggaucuauccucuuuaucgucagcugccuggugaaaggccugguugacuccgugucugauagcuucuuucccgggcuuuccgucuguaagaccugcucuauuggcagcaucaacggauucgaaauugagucccacaaguguuacugcagccucuuuuguugcccuuauuguagacacuacucugccgaccgggagauccaucagcugcaccuguccauuugcaaaaagagaaaaacaggcagcaacgugaugcucgcuguuugcaagcgcauguguuucaaagccaccaucgaagcgucucggagagcccugcuuauucgcuccaucaucaauacgaccuucgugauuugcauccugauucucgcuaucugugucgugagcacauccgccguugagauggaaaaccugccggcugggaccugggagagagaagaggaucugacaaauuuuugccaucaggagugucaagugaccgaaacggagugccuuugucccuaugaagcccugguccuccggaagccucuguuccucgacucuacagugaagggaaugaaaaaccugcuuaauagcaccucccuggagacaagccucucuauugaggcgcccuggggcgccaucaacgugcaguccaccuuuaagccuaccgucagcacagcuaauaucgcccugucuuggagcuccguugaacaccgcgggaacaaaauucuggugacgggaagaucugagagcaucaugaaacuugaggaacggaccggcguguccugggaucugggggucgaagacgcuucugagagcaagcuccugacaguguccauuauggaucucagccagauguacucucccguuuucgaguaccuguccggcgaccgccagguggaagaguggccuaaggcuaccugcacaggagauuguccggaaagaugcggcuguaccagcuccacgugccuucauaaggaguggccccacucucggaauuggcgcugcaacccuacaugguguuggggagucggaaccggcugcaccuguugcgggguggacguuaaagaucuguuuacagaccacauguucgugaaguggaaagucgaauauaucaagaccgaggccauuguguguguugagcucacaagccaagaaagacagugcucccugaucgaggcuggaacgcgguuuaaucugggccccgugaccaucacacuuucugaaccucgcaacauucagcagaaacugcccccggagaucauuacccuccauccuaagaucgaagagggcuucuuugaccugaugcacguccaaaaggugcucagcgcguccacaguguguaaacugcagagcugcacccaugggauucccggagaucuucagaucuaccacauuggcaaucugcugaagggggacagagucaacggacaucucauccacaaaaucgagccccacuucaauacgucuuggauguccugggauggcugugaccuggauuauuacugcaacauggggaacuggccuagcuguaccuauacaggaguuacccagcauaaucacgccgcuuuugugaaccuucugaauauugaaacagacuacaccaagacauuccauuuucacucuaaacgggugacggcccacggcgauacaccccaacucgaccugaaggccagaccuaccuauggcgcuggggagaucaccguccucguggaaguugccgauauggagcugcauaccaaaaagguggagauuuccggacuuaaguucgcgagccuggucugcacaggcugcuacgcuuguucuagcgggaucuccugcaaagugcgcauucacguugacgaaccggaugagcugacggugcaugucaagucuagcgaccccgauguggucgccgccuccaccagccucauggcucggaaacuggaauuuggaacagacuccaucuuuaaggccuucucugcgaugccuaaaaccagccuuuguuuuuacaucguggagagagaauauugcaaguccuguucugaggacgauacaaagaaaugcguugacaccaagcuggagcagccccagagcauucucaucgaacacaaaggcacgauuaucgggaagcaaaacgauacauguaccgcuaaagccuccugcuggcuggagucugucaagagcuucuuuuacggacucaagaauaugcugggcuccguguucggcaacuuuuucguggggauucuucuguuucuggccccuuucguucuccuggugcuuuucuucauguucggauggaaaauccuguuuuguuucaagugcugucgccggaccagaggccucuuuaaauaucgccaucugaaggacgaugaagagacaggguaccggagaaucauugaacgccucaauagcaaaaagggaaagaaccggcugcuugacggcgagagacuggcugaucggaaaaucgccgagcuguucucuaccaagacacacauuggguga

SEQ ID NO: 13589 - RNA, 5067 nt, Artificial Sequence
  derived and/or modified CDS sequence (opt5) from CCHFV(Ast133)__KX056060.1__GP
augcccaucaacauuaagcacacccugcucgugugcuucauccuguaccuucagcugagcggccucgggggagcccauggccaauccaaugcuacagagcacaacgggacgaauaccacaaccgucccuggaacaucucagagcccgaaacccccugccuccaccacacccccucauacccccgaaucuagcacgguuaagcugaccacaccuaccuccgagacagaaggcucuggggagaccacgccgcccccuaacacaacccagggacuuccccugccuggcacaacccccgaaagaagcgcgaccacagcuacguccaccagcucuacagacaauaugaacuccaccacacaggugaccgauaauacgccgacaagcaccgugucuauuuccccuuccucuucccccagcaugccuuccaccucucaaggcauccaccaucccguccggagccuccuguccgugagcucucccaaaacaguuaccacaccuacgccgaugucccccggggagaugagcccugagaccucuagccagcacuuugccaugucccgcauucccacacuguauaccgccacacaggugucuaccgaaaacacggacagaagcaccccucggcaguccgagagcucuguccaacccgcuacacaguccccgaucaccagcccugcccagacaauccuccugaugucugcugcccccaaggcgauucaggauaugcacccuucccccaccaaucgcagcaaaagaaaccuugaaguggagaucauucugacgcucucccaaggacugaagaaguacuauggcaaaauccuuaagcugcuccaucugacacuggaggaagacaccgaggggcuccuggaaugguguaaacggaaucuuggaucuaacugcgaugacgauuucuuucagaagcgcauugaggaguucuuuaucacaggcgaaggguacuucaaugagguucugcaguuuaaaacccucagcacccuguccccuacagaacccucucacgugagacuuccgacggccgagccuuucaagagcuauuuugcuaagggauuccuguccauugacagcggcuacuuuucugccaaauguuauccccgguccagcaccucuggccuccaacugaucaacgucacacagcaucccgcucgcaucgccgaaaccccugggccgaagacaaccucccugaaaacgauuaauugcaucaaccucagagcgagcguguucaaggagcaccgggaaguggagauuaacguccugcuuccccagaucgccguuaaucugucuaacugucacguggugauuaauagccaugucugcgauuacucccucgacacagauggaccugugcgccugcccagaauccaccaugagggcaccuuuaucccugggaccuacaaaauuguuaucgaccggaagaacaaacuuaaugaucgcuguagccuggugacaaacugcgucauuaagggaagagaagugcggaagggccagucuguucucagacaauauaaaaccgagaucaagauugggaaagcuagcacaggaagccgcaagcugcuguccgaggaacccgacgacgauuguaucucucggacgcagcuccugaaaaccgaaacagccgagauccacgacgauaauuacggcggcccuggggacaagauuaccaucugcaacggaagcacaauuguggaucagagacuuggcuccgagcugggguguuauaccaucaaucgcgucaagucuuucaaacucugcgaaaacagcgcuacgggaaagaccugcgagauugacuccacacccgugaaaugucggcagggcuucugccugaagaucacccaagaagggagaggccaugucaaacugucucgcggaagcgaggugguucuugaugccugugacuccagcugcgagauuaugaucccgaagggcacaggggauauccucguggacuguucuggaggccagcagcacuuucugaaggauaaucugauugaccucgggugcccucacaucccccugcuuggaaaaauggccauuuacaucugucggauguccaaccauccuagaaccacaauggcuuuccuguuuugguucagcuuuggcuaugucauuaccugcaucuucuguaaggcgcucuuuuaccugcugaucauuaucgggacgcuuggcaaaaagauuaaacaguaucgcgaacucaagccccaaacaugcaccaucugugagaccgccccggugaaugcuauugacgccgaaaugcacgaucugaacugcucuuacaauaucugcccuuacugugccucccggcugacaagcgacggacucgcuagacauguuacccagugccccaagcgcaaagagaagguggaagagacggagcuguaucuuaaccuggaacggaucccuuggauugucagaaaacuccuucaggugucugaguccacaggcguggcccugaagcggagcuccuggcugaucguucuccugguccugcucaccgugagccugucucccgugcagagcgcgcccgucgggcacggaaaaacaauugaaaccuaccaaacacgcgagggcuucaccuccaucugucuuuuuaugcuggggucuauucucuucaucgugagcugccugguuaagggacugguggauuccgucucugacagcuuuuucccuggccuuuccguguguaaaacgugcucuaucgggagcauuaacggcuuugaaaucgagucccacaaguguuauugcagccucuucuguugcccguacuguagacauugcucugcugaucgggagauucaccagcugcaucuguccaucugcaagaaaagaaagaccggaagcaauguuaugcucgccguguguaaacgcaugugcuucaaggccacaauugaggcuucucggagagcccugcuuauccgcuccauuaucaacaccacauuugucauguguauccugacccucgcuauuugcgugguuagcacguccgccguggaaauggaagaccugcccgcgggcacaugggagagagaagaggaucugaccaauuucugucaccaggagugccaagucacagaaaccgagugucuuugcccuuaugaagcccuggugcuccggaaaccccuguuuucugacagcaucgugaaggggaugaagaaccuccuuaauuccaccagccuggagacaucucuguccauugaggcuccuuggggagccaucaacguccagagcacguucaaacccaccguuucuacagcuaauauugcccucagcugguccucuguggaacaucgcggcaacaagauccuggugaccgggagaagcgaguccaucaugaaacuggaggaacggacaggagucucuugggaucuuggcguggaagacgcgagcgaguccaagcugcucaccguuagcauuauggaucugucucagauguacuccccuguguuugaguaucucagcggggaccgccaggucgaagaguggccgaaagccacguguacaggcgauugccccgaaagauguggaugcaccuccucuaccugccugcacaaggaguggccucacagccggaauuggcgcuguaaccccacauggugcuggggcguggggaccggauguacaugcuguggcguugacgugaaggaccuuuucacggaucauauguuuaucaaauggaaggucgaauacauuaaaaccgaggcuaucgugugcguugagcugacaucccaagaaagacaguguucucucauugaggccgggacccgguucaaucugggaccugugacaaucacccugagcgaaccccgcaacauccagcagaaacuuccgccugagauuaucacgcugcaccccaaaauugaagagggcuuuuucgaccucaugcauguccaaaaggugcuguccgcuagcaccgugugcaagcuccagucuuguacacacggcauccccggggaucugcagauuuaccauaucggaaaucuucugaaaggcgacagagucaacgggcaccugauucacaagaucgagccucauuuuaauaccuccuggaugagcugggauggaugcgaccucgauuauuacuguaacaugggcgacuggcccucuugcacauauaccgggguuacacagcacaaccaugccgccuucgugaaucugcuuaacaucgaaacggauuacaccaaaacauuucacuuccacuccaagcgggugaccgcucauggagacaccccucaacuggaucucaaagcgagaccgacauauggcgccggcgagauuacgguccugguggaaguugcugacauggagcuccacaccaagaaaguggagaucagcgggcugaaguucgccucucuuacaugcaccggauguuacgccugcagcuccggcauuucuuguaagguccgcauccauguggaugaacccgacgagcugacaguucacgugaaaagcuccgacccugaugucguggcugccagcaccucccugauggcgcggaagcucgaauuugggacggacucuacauucaaggcuuuuagcgccaugcccaagaccucccugugcuucuauauugucgagagagaauacuguaaaucuugcagcgaggaugacaccaagaaguguguggauacaaaacuugagcagccucaguccauccugaucgaacauaagggaaccauuaucggcaaacaaaaugacacaugcaccgccaaggcuucuuguuggcucgagagcguuaaauccuuuuucuacgggcugaagaacaugcucggaagcguguuuggcucuuucuuugucggcauucugcuuuuccuggcccccuuugugcugcucguucuguucuucauguuuggguggaagauccuuuucugcuuuaaauguugccgccggacgagaggacuguucaaguaucgccaccucaaagaugacgaagagacaggcuaccggagaauuaucgaacgccucaauuccaagaaagggaagaaccggcugcuggauggagagagacuugcggaccggaagaucgcugagcuguuuagcucuaaaacccacauuggcuga

SEQ ID NO: 13590 - RNA, 5067 nt, Artificial Sequence
  derived and/or modified CDS sequence (opt5) from CCHFV(Ast137)__KX056057.1__GP
augcccaucaacauuaugcacacccugcucgugugcuucauccuguaccuucagcugagcggccucgggggagcccauggccaauccaaugcuacagagcacaacgggacgaauaccacaaccgucccuggaacaucucagagcccgaagcccccugccuccaccacacugccccauaccccugaaucuagcacgguuaaacuuaccacacccaccuccgagacagaaggcucuggggagaccacgccuccgcccaacacaacccagggacugccucccccuggcacaacccccgaaagaccggcgaccacagcuacgagcaccuccagcacagacaauaugaacucuaccacacaggugaccgauaauacgccuacauccaccgugagcauuucucccuccagcucuccuuccaugcccagcaccucccaaggcauccacuaucccguccggucucuccugagcguguccagcccuaagacaguuaccacaccgacgcccaugucuccuggggagaugucccccgagaccagcucucagcauagcgccaugucccgcauuccuacacuguacaccgccgcucaggugucuacagaaaacaccaauagaagcacgccccggcaguccgagagcucugcccaaccggcuacccaguccccuacaaccuuucccgcccagacaauccuccugaugagcgcggccccuaaagcuauccaggacaugcaccccucuccuaccaaccgcuccaagagaaaucuugaagucgagauuauccugacgcucagccaaggacugaaaaaguauuacggcaagauucuuaaacugcuccaccugacacuggaggaagauaccgaggggcuccuggaaugguguaagcggaaccuuggauccaauugcgacgaugacuucuuucagaaacgcaucgaggaguucuuuauuacaggcgaaggguauuucaacgaggugcugcaguuuaagacccucucuacccugagccccacagaaccgucccauguuagacuuccuacggccgagcccuucaaaucuuacuuugcuaagggauuccugagcaucgauuccggcuauuuuagcgccaaguguuacccccggucuuccaccagcggccuccaacugauuaaugugacacagcacccugcgcgcaucgccgaaaccccggggcccaaaacaaccucucugaagacgaucaacugcauuaaccucagagcuuccgucuucaaagagcaucgggaaguggagaucaaugugcugcuuccucagauugccgucaaccugagcaauugucacguugugaucaacucucacgugugcgacuacagccucgauacagacggacccguccgccugccuagaauccaucacgagggcaccuuuauccccgggaccuauaagaucgugauugauaaaaagaauaaacuuaacgaccgguguucccugguuacaaauugcgugaucaagggacgcgaagucagaaagggccagagcgugcuccggcaauacaaaaccgagauuaagaucgggaaggcuucuacaggauccagaaagcugcugagcgaggaaccuggcgaugacuguauuucccgcacgcagcuccugaaaaccgaaacagccgagauccaugacgauaacuauggcgggcccggagacaagaucaccauuugcaauggcucuacaaucguugaucagcggcuugggagcgagcugggauguuacaccauuaacagagugaaguccuucaaacucugcgaaaauucugccacgggcaagaccugcgagaucgacagcacaccggucaaaugucgccagggguucugccugaagauuacccaagaaggccggggacacgugaaacuguccagaggcucugaggucgugcuugaugcuugugacagcuccugcgagaucaugauuccuaaggggacaggagauauccucguugacuguagcggcgggcagcagcauuuucugaaggauaaccugaucgaccucggaugcccccacauuccucugcuuggcaaaauggcgauccacauuugucgcaugucuaaucauccccggaccacaauggccuuccuguuuugguucuccuuuggguaugugauuaccugcauuuucuguaaggcucucuuuuacagccugaucaucauuggcacgcuggggaaaaagaucaaacaguauagagaacuuaagccgcaaacaugcaccauuugugagaccgccccugucaacgccaucgaugcugaaaugcacgaccucaauugcucuuacaacauuugccccuacugugccucccgccugacaagcgacggccuggcgcggcaugugacccagugcccuaagagaaaagagaagguugaagagacggagcucuaucugaaccuugaacgcauccccuggaucgugcggaaacugcuccaggucucugaguccacagggguggcucugaagagaagcuccuggcugauugugcuucucguucugcugaccgucagccucucucccgugcagagcgccccugugggacacggcaaaacaaucgaaaccuaccaaacacgggagggguucaccaauauuugucuguuuaugcuuggauccauccuguucauugucucuuaucucgugaagggccugguugauagcguguccgacagcuuuuucccggggcugucugucugcaaaacguguuccaucggcucuaucaacggauuugaaauugagagccacaagugcuacuguucccuuuucugcugucccuauugccgccauuguagcgccgauagagagauccaccagcuccaucugggcauuugcaagaaacggaagaccgggucuaaugugaugcuggcuguuugcaaaagaauguguuucaaggccacaaucgaggcuucccgccgggcccuccugauuagaagcaucauuaacaccacauuugugaucugcauccuuacccuggcgauuugugucgugucuacguccgccguugaaauggaaaaucucccugcuggaacaugggagcgcgaagaggaccugaccaacuucugccaccaggagugucaagugacagaaaccgagugccugugucccuacgaagcccuuguccugagaaaaccucucuuucuggauagcaucgugaagggcaccaagaaucuccugaacuccacaucucuugagacgagccuguccauugaggcucccuggggagccaucaaugugcagagcaccuucaaaccuacagucucuaccgcgaacauugcccucuccuggagcucuguugaacaucggggaaauaagauccuggugacaggccgcagcgaguccaucaugaaacuggaagagagaaccggggugucuugggaccuuggcgucgaagaugcuagcgaguccaagcugcucacggugucuauuauggaccugagccagauguauuccccgguuuuugaguaccucagcggagauagacagguggaagaguggcccaaagccacaugcaccggcgacuguccugaacgcugcggguguaccucuuccacaugccugcacaaggaguggccccacagcagaaacuggcggugcaauccuaccugguguuggggagucggcacagggugcacguguugcggaguggauguuaaggaccuuuucaccgaucauauguuuaucaaauggaagguggaauacauuaaaacagaggcuaucgucuguguggagcugaccucccaagaacgccagugcucucucauugaggccggcacaagauucaaccugggccccguuaccaucacgcugagcgaaccgcggaauauccagcagaaacuuccucccgagauuaucacccugcaccccaaaauugaagagggguuuuucgaccucaugcaugugcaaaagguccuguccgccucuacaguguguaagcuccagagcugcacccacggaaucccuggcgaccugcagauuuaucauaucgggaaccuucugaaaggagaucgccugaacggccaccucauucacaagaucgagccccauuuuaauacauccuggaugagcugggacgggugugaucuggacuacuauugcaacaugggagauuggccuucuuguaccuacacaggcgugacgcagcacaaucaugcugcguucgucaaccuucugaauaucgaaaccgacuauacaaaaaccuuucacuuccacuccaagagaguuaccgcccauggcgauacaccgcaacucgaccugaaagcucggcccacguacggggccggagagauuaccgugcucguggaagucgccgauauggagcugcacacaaagaaaguggagguuagcggccuuaaguucgcuucucuggccugcaccgggugcuaugcguguuccagcggaaucucuugcaaggugcggauucaugucgacgaaccugaugagcugacagugcacguuaaaagcuccgaccccgauguggucgcugccucuaccagccucauggcccgcaagcuggaauuuggcacggacuccacauucaaggcuuuuagcgccaugccuaaaaccucccuuuguuucuacaucguggagcgggaauacugcaaaucuuguagcgaggacgauaccaagaagugcgucgacacaaaacuggagcagccccaguccauucucaucgaacauaaggggaccaucauuggaaaacaaaacgauacauguaccgcgaaggcuucuugcuggcuggagagcgugaaauccuuuuucuauggccucaagaauaugcugggcucuguuuuugggaacuucuuugugggaauccuucuguuccuggccccguuuguccuccuggugcuuuucuucauuuuuggcuggaagauccuguucuguuuuaaaugcuguagacgcacgcggggacucuucaaguacagacaccugaaagacgaugaagagacaggguaucgcaagauuaucgaacggcucaauagcaaaaagggcaagaacagacugcuugacggggagcgccuggccgaucggaaaaucgcugagcuguuuuccaccaagacacacauuggauga

SEQ ID NO: 13591 - RNA, 5067 nt, Artificial Sequence
  derived and/or modified CDS sequence (opt5) from CCHFV(Ast149)__KX056054.1__GP
augcccaucaacauuaugcacacccugcucgugugcuucauccuguaccuucagcugagcggccucgggggagcccauggccaauccaaugcuacagagcacaacgggacgaauaccacaaccgccccuggaacaucucagagcccgaagcccccugcguccaccacacccccucauacccccgaaucuagcacggucaaacugaccacaccuaccuccgagacagaaggcucuggggagaccacgccgcccccuaacacaacccagggacuucccccucccggcacaaccccggaaagaccugcuaccacagccacgagcaccuccagcacagacaauaugaacucuaccacacagguuaccgauaauacgcccacauccaccgugagcaccucuccuuccagcucucccuccaugcccagcacaucccaaggcauucacuauccugugcggucucugcucagcgucuccagcccgaagaccgugacaacgcccaccccuaugucucccggggagauguccccugagacaagcucucagcauagcgccaugucccgcauccccacccuguacacagcugcccagguuucuaccgaaaacgcuaauagaagcacgccgcggcaguccgagagcucugcccaaccugcgacccagucccccacaaccuuuccugcccagacaauucugcucaugagcgcugcccccaaagcuauccaggacaugcacccuucucccaccaaccgcuccaagagaaaucuggaaguggagaucauucuuacgcugagccaaggacucaaaaaguauuacggcaagauccugaaacuucugcaccucacacuggaggaagauaccgaggggcugcucgaaugguguaagcggaaccugggauccaauugcgacgaugacuucuuucagaaacgcauugaggaguucuuuaucacaggcgagggguauuucaacgagguccuucaguuuaagacccugucuacccucagcccgacagaaccuucccaugugagacugcccacggccgagcccuucaaaucuuacuuugcgaagggauuccuuagcauugauuccggcuauuuuagcgccaaguguuacccucggucuuccaccagcggccugcaacucaucaauguuacacagcacccggcucgcauugccgaaacccccgggccuaaaacaaccucucugaagacgaucaacugcaucaaccugagagcuuccguguucaaagagcaucgggaagucgagauuaaugugcuccugccccagaucgccgugaaccuuagcaauugucacgucguuauuuacucucacgugugcgacuauagccuggauacagacggaccugugcgccuccccagaauccaucacgagggcaccuuuauuccugggaccuacaagaucgucaucgauaaaaagaacaaacugaaugaccgguguucccuugugacaaacugcguuauuaagggacgcgaagugagaaagggccagagcguccugcggcaauauaaaaccgagaucaagauugggaaagccucuacaggauccagaaagcuccugagcgaagaacccggcgaugacuguaucucccgcacgcagcugcucaaaaccgaaacagcugagauucaugacgauaauuacggcgggccgggagacaagaucaccaucugcaacggcucuacaauuguggaucagcggcuggggagcgagcuuggauguuauaccaucaauagaguuaaguccuucaaacugugcgaaaacucugcgacgggcaagaccugcgagauugacagcacaccugugaaaugucgccagggguucugccucaagaucacccaagaaggccggggacacgucaaacuguccagaggcucugaggugguccuggaugccugugacagcuccugcgagauuaugauccccaaggggacaggagauauucuuguggacuguagcggcgggcagcagcauuuucucaaggauaaucugaucgaccugggaugcccucacaucccccuccugggcaaaauggcuauuuacaucugucgcaugucuaaccacccgcggaccacaauggccuuccuguuuugguucuccuuuggguauguuauuaccugcaucuucuguaaggcccuguuuuacagccucauuaucaucggcacgcuggggaaaaagauuaaacaguacagagaacugaagccucaaacaugcaccaucugugagaccgcucccgugaaugccauugaugcggaaaugcaugaccuuaacugcucuuauaauaucugcccuuacugugcuucccgccucacaagcgacggccuggcccggcacgucacccagugccccaagagaaaagagaagguggaagagacggagcuguaucucaaccuggaacgcauucccuggaucguucggaaacuucuucaggugucugaguccacaggggucgcccucaagagaagcuccuggcugaucgugcugcuugugcuccugaccguuagccugucuccuguccagagcgcuccggugggacauggcaaaacaauugaaaccuaccaaacacgggagggguucaccaacaucugucucuuuaugcugggauccauucuuuucaucgugucuugccuggucaagggccucguggauagcguuuccgacuccuuuuuccccgggcugagcguguguaaaacgugcuccauuggcucuaucaauggauuugaaaucgagagccacaaguguuauugcucccuguucuguugcccuuacugucgccacugcagcgccgauagagagauucaucagcuucaccucggcaucugcaagaaacggaagaccgggucuaacgucaugcuggcuguguguaaaagaaugugcuucaaggccacaauugaagcgucccgccgggcccugcccaucagaagcauuaucaauaccacauuuguuauuuguauccucacccuggcuaucugcguggucucuacguccgccguggagauggaaaaccuuccugcuggaacaugggagcgcgaagaggaccugaccaauuucugucaucaggagugccaaguuacagaaaccgagugucucugccccuaugaagcccuggugcugagaaaaccucuuuuucuggauagcauugucaagggcaugaagaaccuccuuaauuccaccucucucgagacaagccuguccaucgaggcgccguggggagccauuaacgugcagagcacguucaaacccaccgugucuacagcuaauaucgcccuuuccuggagcucugucgaacaccggggaaacaagauucugguuaccggccgcagcgaguccaucaugaaacucgaagagagaacaggggugucuugggaccugggcguggaagaugcuagcgaguccaagcugcuuaccgucucuaucauggaccugagccagauguacuccccuguguuugaguaccucagcggagaucggcagguugaagaguggcccaaagccacguguacaggcgacugcccugaacgcugugggugcaccucuucuaccugccugcauaaggaguggccccacagcagaaauuggcgguguaacccgacauggugcuggggagugggcaccggguguacaugcuguggagucgaugugaaggaccucuucacggaucacauguuuauuaaauggaagguugaauauaucaaaaccgaggccauugugugcgucgagcugacaucccaagaacgccaguguucucuuaucgaggcuggcaccagauucaaucugggcccugugacaauuacccucagcgaaccccggaacauccagcagaagcugcccccugagaucauuacgcugcaucccaaaaucgaagagggguuuuucgaccuuaugcacguucaaaaggugcuguccgcgucuaccgucugcaagcuccagagcuguacacauggcauuccuggagaccugcagaucuaccacauugggaaucuccugaaaggagaucgccuuaacggccaucugauccacaagauugagccgcacuuuaacaccuccuggaugagcugggacgggugcgaucuggacuauuacuguaauaugggagauuggcccucuugcacauauaccggcgugacacagcauaaccacgccgcuuucgugaaucuccugaacaucgaaacggacuacaccaaaacauuucauuuccacuccaagagagucaccgcccacggcgauaccccucaacuugaccugaaagcccggcccacauauggggcuggagagaucacgguucucguggaaguggccgauauggagcugcauaccaagaaagucgaggugagcggccucaaguucgcgucucuggcuugcacaggguguuacgccugcuccagcggaauuucuuguaagguuagaauccacguggacgaaccugaugagcuuaccguccaugugaaaagcuccgaccccgauguuguggccgcuucuacaagccugauggcccgcaagcuggaauuuggcaccgacuccacguucaaagcguuuagcgcuaugccgaagacaucccucugcuucuacauugucgagcgggaauauuguaaaucuugcagcgaggacgauaccaagaaguguguggacaccaaacuggagcagccucaguccauccuuauugaacacaaggggacaaucaucggaaaacaaaaugauaccugcacagccaaggccucuuguuggcuggagagcgucaaauccuuuuucuacggccucaagaacaugcugggcucuguguuugggaauuucuuuguuggcauucuccuguuccuugcucccuuugugcugcuggcccucuucuucaucuuuggauggaagauucuguucugcuuuaaauguugcagacgcacccgggggcuuuucaaguauagacaucugaaagacgaugaagagacgggauaccgcaagaucauugaacggcucaacagcaaaaagggcaagaauagacugcucgacggggagcgccuggcugaucggaaaaucgccgagcuguuuuccacaaagacccacaucggauga

SEQ ID NO: 13592 - RNA, 5067 nt, Artificial Sequence
  derived and/or modified CDS sequence (opt5) from CCHFV(Ast199)__KX056051.1__GP
augcccaucaacauuaugcacacccuucucgugugcuucauccuguaccuucagcugagcggccucgggggagcccauguccaauccaaugcuacagagcacaacggcacgaauaccacaaccguuccugggacaucucagagcccgaagcccccugccuccaccacacugccccauaccccugaaucuagcacggugaaacuuaccacacccaccuccgagacagaaggaucuggcgagaccacgccuccgcccaacacaacccaggggcugccucccccuggaacaacccccgaaagaccggcgaccacagcuacgaccacaagcuccaccgacaauaugaacagcacaacccaggugacggauaauacaccuaccucuaccgucuccauuagccccucuuccaacccuagcaugcccucuacaucccaaggcauccacuaucccgugcggagccuccuguccguuucuagcccuaagaccgugacaacgccgacccccauguccccuggcgagaugagccccgagacaucuucccagcauagcgccaugucucgcauuccuacccuguacacagccgcucaggucagcaccgaaaauacgaacagauccacccccagacagucugagagcuccgcccaaccggcuacacagagcccuaccacauuucccgcccagaccaucccucucaugucugcggcccccaaagcuauccaggacaugcacccuucccccacgaaucgcagcaagagaaaccuggaaguggagauuauccuuacacugucucaagggcucaaaaaguauuacggaaagauucugaaacuucugcaccucacccuggaggaagauacagagggccugcucgaaugguguaagcggaaucugggguccaacugcgacgaugacuucuuucagaaacgcaucgaggaguucuuuauuaccggagaaggcuauuucaaugagguucuucaguuuaagaccccgagcacacuguccccuacggaacccucucaugugagacuccccaccgccgagccuuucaaaagcuacuuugcuaagggguuccuguccaucgauucuggauauuuuagcgccaaguguuacccgcgguccagcacaucuggccuucaacugauuaacgucacccagcaccccgcgcgcaucgccgaaacaccuggccccaaaaccacgucccucaagacaaucaacugcauuaaucugagagcuagcguguucaaagagcaucgggaaguggagaucaacguccugcucccucagauugccguuaaucugucuaacugucacguggugaucaauucccacgucugcgacuacagccuugauaccgacgggcccgugcgccugccucggauucaucacgagggaaccuuuauccccggcacauauaagaucguuauugauaaaaagaacaaacucaaugaccgguguucucuggugaccaacugcgucaucaaggggcgcgaagugagaaagggacagagcguucuucggcaauacaaaacagagauuaagaucggcaaggcuuccacggggagcagaaaacugcucucugaggaaccgggagaugacuguauuucccgcacccagcugcugaaaacagaaaccgccgagauccaugacgauaauuauggcggcccuggggacaagaucacaauuugcaacggaagcaccaucguggaucagcggcucggcuccgagcugggguguuacacgauuaauagagucaagucuuucaaacuuugcgaaaacagcgccaccggaaagacaugcgagaucgacuccacccccgugaaaugucgccagggcuucugccugaagauuacacaagaagggcggggccacgucaaacucucuagaggaagcgaggugguucuggaugcuugugacuccucuugcgagaucaugauuccuaagggcaccggggauauccugguggacuguagcggaggccagcagcauuuucuuaaggauaaucucaucgaccuggggugcccccacauuccgcugcucggaaaaauggcgaucuauauuugucgcauguccaaccacccucggacaaccauggccuuccuguuuugguucagcuuuggcuacgucaucacgugcauuuucuguaaggcucuguuuuauucucugaucaucauugggacacucggcaaaaagaucaaacaguacagagaacugaagccccaaaccugcaccauuugugagacagccccugugaaugccaucgaugcugaaaugcaugaccugaacugcuccuacaacauuugccccuauugugccagccgccuuaccucugacggacucgcgcggcacguuacgcagugccccaagagaaaagagaagguggaagagacagagcuguaccugaaucucgaacgcaucccuuggaucguccggaaacugcuucagguguccgagagcaccggcguggcucugaagagauguucuuggcucauuguucugcugguccuucucacagugucccugagcccggugcaguccgcccccgucgggcauggaaaaaccaucgaaacauaucaaacccgggagggcuucacgaacauuugccuguuuaugcucgggagcauccuguucauugugucuugucuuguuaagggacugguggauagcgucuccgacagcuuuuucccuggccucucugugugcaaaaccuguuccaucgggucuaucaauggcuuugaaauugagagccacaagugcuacuguucccuguucugcugucccuauugccgccacugcucugccgauagagagauccaucagcugcaccuuggaauuuguaagaaacggaagacaggcagcaacguuaugcucgcugugugcaaaagaauguguuucaaggccaccaucgaggcuucccgccgggcccugcugauuagaagcaucauuaauacaaccuuugucaucugcauccucacgcuggcgauuugugugguuucuacauccgccguggaaauggaaaaccuuccugcugggaccugggagcgcgaagaggaccugacaaauuucugccaucaggagugucaagucaccgaaaccgagugccucugucccuacgaagcccuggugcugagaaaaccucuuuuucuggauagcaucgugaagggaaugaagaaccuccuuaauucuacaucccucgagacgagccuguccauugaggcuccguggggcgccaucaacguccagucuaccuucaaacccacaguuagcaccgcgaauauugcccuuuccuggagcucuguggaacaccgggggaacaagauccuggugacaggacgcuccgagagcaucaugaaacucgaagagagaaccggcgucucuugggaccuggggguggaagaugcuagcgaguccaagcugcuuacgguuucuauuauggaccugagccagauguauuccccuguguuugaguaccucucuggcgaucggcaggucgaagaguggcccaaagccacaugcaccggagacuguccugaacgcugcggcugcaccagcuccacaugucugcauaaggaguggccccacagcagaaauuggcggugcaacccgaccugguguuggggaguggggacaggcugcacguguugcgggguugaugugaaggaccucuucaccgaucacauguuuaucaaauggaaggucgaauacauuaaaacagaggcuaucguguguguugagcugaccucucaagaacgccagugcucccuuauugaggccggaacaagauucaaucugggcccugugaccaucacgcucagcgaaccccggaacauccagcagaagcugcccccugagauuaucacccugcaucccaaaauugaagagggcuuuuucgaccuuaugcacguccaaaaggugcuguccgccucuacaguguguaagcuccagagcugcacccaugggaucccuggagaccugcagauuuaucacaucggcaaccuccugaaaggggaucgccuuaauggacaucugauucacaagaucgagccgcacuuuaacacauccuggaugucuugggacggcugugaucuggacuacuauugcaauaugggggauuggcccagcugcaccuacacaggagucacgcagcauaaccacgcugcguucguuaaucuccugaacaucgaaaccgacuauacaaaaaccuuucauuuccacuccaagagagugaccgcccacggcgauacaccucaacuugaccugaaagcucggcccacguacggcgccggggagauuaccgugcucgucgaaguggccgauauggagcugcauacaaagaaaguugaggugagcggacucaaguucgcuucucuggccuguaccggcugcuaugcguguuccagcgggaucucuugcaagguccgcauucacguggacgaaccugaugagcuuacaguucaugugaaauccagcgaccccgaugucguggcugccucuaccagccugauggccagaaagcuggaauuuggaacggacuccacauucaaggcuuuuucugccaugccgaaaaccagccucuguuucuacaucgucgagcgggaauacugcaaauccuguagcgaggacgauaccaagaagugcguggacacaaaacuggagcagccucaguccauucuuaucgaacacaagggcaccaucauugggaaacaaaaugauacauguaccgcgaaggcuucuugcuggcuggagagcguuaaauccuuuuucuauggacucaagaacaugcugggcucuguguuuggcaauuucuuugucgggauccuccuguuccuugcccccuuugugcugcugguucucuucuucauuuuuggauggaagauccuguucuguuuuaaaugcugcagacgcacgcggggccuuuucaaguacagacaucugaaagacgaugaagagacaggguaucgcaagauuaucgaacggcucaacagcaaaaagggaaagaauagacugcucgacggcgagcgccuggccgaucggaaaaucgcugagcuguuuuccaccaagacacacauuggguga

SEQ ID NO: 13593 - RNA, 5067 nt, Artificial Sequence
  derived and/or modified CDS sequence (opt5) from CCHFV(Saf)__KX013487.1__GP
augcccaccaacaucaugcacacacugcucgugugcuucauucuguaccuucagcugcucggccuugggggagcccauggccaaagcaaugcuacggagcacaacgggaccaauacaaccacagccccuuccaccucucagagcccgaagccccuugucuccacagcgccuccccaugcucuggaaucuagcaccaucaaaccuacgacccccgccuccgagacagaaggaucuggcgagaccacaccuccgcccaacaccacgcaggggccuagcccucccgaaacaacccccgagagaccggccacaaccgcuaccuccacaccuagcacggacaauaccaacucuacaacccacguuacagauaauaaccccaccuccacgauuagcacaucuccuuccagcucucccuccacccccagcaccccucagggaauccaucacccggcccggaaucuccuguccgugucuagccccaagacagcuaccacaccuacgcccaccuccccuggcgagauuagcucugaaacauccagccugcacucugccaugagccgcaccuccacacucuauaccgcgacgcaagugucuaccgagaacgccaaucauagcgcucccagacaguccgaaagcucugcccagccgacaaccacauccccuaugaccagccccgcucagucuauccuggucauguccgccgcgccuacggccauccaaaacauucaccccagcccuacaaaucgguccaaacgcaaccuugagauggagaucauucugacccucucucagggccugaagaaauacuaugggaagauccuuaagcugcuccaucugacacuggaagaggacaccgaaggacuccuggagugguguaaaagaaaucuuggcagcaacugcgaugacgauuucuuccagaagcggauugaagaguuuuucaugaccggggagggauacuuuaacgaagugcugcaguucaaaacacucuccacgcugucucccaccgagccgagccacgcucgcccucccacaguugaacccuuuaaguccuauuucgccaaaggcuuucuuagcaucgacucuggguacuucuccgcuaaguguuauccuagaagcucuaccuccggacugcaacucauuaaugugacacagcacccggcccggaucgccgagacccccggcccuaagacgacaagccugaaaaccaucaacugcauuaaucugcgcgcuucugucuuuaaggaacauagagagaucgagauuaacgugcuccugccccagaucgcgguuaaucuuagcaacugucacguggucauuaauucccaugugugcgauuacagccuggacaccgauggcccugugcggcucccccacauccaucacgaagggacauucaucccuggaaccuacaaaauugucaucgacaaggagaacaaacugaaugaucgcuguacacuuguuacgaacugcgugauuaagggcagagaagugcggaaagggcaaucuguccugcgccaguauaagaccgagaucaagauuggaaaagccuccacaggcagcagaaagcuccuguccgaggaacccggggacgauuguaucucucggacccagcugcucagaacagagaccgcugaaauccacgacgacaauuacggaggcccgggcgauaaaauuacgaucugcaacgggagcaccauuguggaccagcgccugggauccgagcuuggcuguuauacaaucaaucggguuaagucuuuuaaacugugcgaaaacagcgccaccgggaagacaugcgagauugauuccaccccugugaaguguagacaaggauucugccucaaaaucacacaggagggccgcgggcaugucaagcugucucggggcagcgaagugguucuggacgccugugauuccagcugcgaggugaugauucccaaaggaaccggcgacauccuugucgauuguucugggggacagcagcacuaccucaaggacaaucugaucgaucugggcugcccucauauuccccuccuggggaaaauggcuaucuauauuuguagaauguccaaccacccgcgcacgacaauggccuuccuguuuugguucagcuuuggauacgugauuaccugcaucuucuguaaggcgcuguuuuauucucucaucaucauuggcacccuggggaagaaaaucaagcaauaccgggaacugaaaccucagacaugcaccauuugugagacggcucccgucaacgccaucgacgccgaaaugcacgaucuuaauugcuccuacaacauuugcccuuauugugcuagcagacucacaucugacggccuggcccgccaugugccccagugccccaagcggaaagagaagguugaggaaaccgagcuguaccucaaucuggaaagaaucccuuggaucgugcgcaaacuucugcaggucuccgagagcacaggaguggcucucaagcgguccagcuggcugauuguucugcuugugcuccugaccgucucucugagcccggugcaauccgcccccgugggccacgggaagacaaucgaaaccuaucagacgagagagggauucaccucuauuugucucuuuaugcugggcagcauccuuuuccugguuuccugccucgucaaagggcugguggacucugugagcgauuccuuuuucccuggacugucugucuguaagacaugcagcauuggcuccaucaacggguuugagaucgaaagccauaaauguuacugcucucuuuucuguugccccuauugucggcacugcuccgcggaccgcgagauucaucagcuccaccugagcaucugcaagaaaagaaagaccggcucuaaugugaugcuggccguuuguaagcggaugugcuuuagagcuacaauugaagccucccgccgggcucuccugaucagaagcauuaucaacaccacguucgugauuuguauccuuacacugaccaucugcgucguguccacaucugccguugagauggaaaaucucccuagcggaaccugggagcgcgaggaagaucugaccaacuucugucaccaggagugccaagugacagaaacggagugucugugccccuacgaggcgcuuguccugagaaaaccucucuuuuccgacagcauugugaagggcaugaaaaaucugcucaacucuaccucccuggaaacaagccuuucuaucgaggccccguggggagcuauuaauguucagagcaccuucaagcccacaguguccaccgccaacaucgcucugucuuggagcuccgucgaacaucgggggaauaaaauucucgugacgggccgcucugagagcaucaugaagcuggaagagagaacagggguguccugggaucugggagucgaggacgccagcgaaucuaaacuucugaccguuuccaucauggaucucagccagauguauuccccuguguuugaguaccugucuggcgaccggcaaguggaagaguggcccaaggccaccuguacaggggauugcccugaacgcuguggcugcaccagcuccacaugccuccacaaggaguggccccauucuagaaacuggcgguguaauccgacguggugcuggggagucggcaccggguguacaugcuguggaguggacguuaaagaucuguucaccgaccacauguuugugaaguggaaagucgaguacauuaagacagaagcuaucgugugcguugagcuuaccagccaggaacgccaguguucccugauugaggcgggcacgagauucaaccucgggccugugaccaucacacugagcgaaccccggaacauucagcaaaagcugcccccugagaucaucacccuucaucccaaagucgaggaaggauuuuucgaucugaugcacgugcagaagguucucucugccuccacagugugcaaacugcagagcuguacccacggcauuccuggcgaccuccaggucuaucauaucgggaaucugcuuaagggagaccgcgugaacggccaccugauucauaaaaucgagccgcacuuuaauacaucuuggauguccugggaugggugcgaccuggauuacuauuguaacaugggagacuggcccagcugcacguacaccggcgugacacaacacaaucaugcugccuucgucaaccuccugaauauugaaaccgauuauaugaagaccuuucacuuccauucuaagagaguuacagcccacggggacacgccucagcuugaucugaaagcucggcccaccuacggagccggcgagaucacagugcucguggaggucgcggacauggaacugcauaccaagaaaguggagauuagcggccucaaguuuguuucccuggcuugcacaggguguuaugccugcucuagcggaaucuccuguaaagugagaauccacgucgaugaaccugacgagcuuaccgugcacguuaagagcuccgaucccgacguggucgccgcuucuacgagccugauggcccgcaaacuggaauuuggcacagauuccaccuucaaggcguuuucugcuaugccgaagaccagccucugcuucuacauuguggagcgggaguacuguaaauccugcucugaagaggacacacagaagugugucgacaccaaacuggaacagccucaaagcauccuuauugagcauaaggggacaaucauuggaaaacagaacgauaccugcacggccaaggccuccuguuggcuggaaagcgugaaguccuuuuucuauggccucaaaaauaugcuggggucuguuuuuggaaacuucuuuaucggcauccuccuguuccuugcucccuuugugcugcugguccucuucuuuauguucggcuggaagauucuguucugcuuuaaauguugcagacgcacacgggggcuucugaaguacagacaccucaaagacgaugaggagaccggauaucgccggaucauugaaagacugaauaacaagaagggcaaaaaucgccuccuggacggggagcggcuugccgauagaaagaucgcugaacuguucagcacaaaaacccauauuggauga

SEQ ID NO: 13594 - RNA, 5067 nt, Artificial Sequence
  derived and/or modified CDS sequence (opt5) from CCHFV(Min)__KX013481.1__GP
augcccaccaacaucaugcacacacugcucgugugcuucauucuguaccuucagcugcucggccuugggggagcccauggccaaagcaaugcuacggagcacaacgggaccaauacaaccacagccccuuccaccucucagagcccgaagccccuugucuccacagcgccuccccaugcucuggaaucuagcaccaucaaaccuacgacccccgccuccgagacagaaggaucuggcgagaccacaccuccgcccaacaccacgcaggggccuagcccucccgaaacaacccccgagagaccggccacaaccgcuaccuccacaccuagcacggacaauaccaacucuacaacccacguuacagauaauaaccccaccuccacgauuagcacaucuccuuccagcucucccuccacccccagcaccccucagggaauccaucacccggcccggaaucuccuguccgugucuagccugaagacagcuaccacacccacgccuaccucccccggcgagauuagcucugaaacauccagccuccacucugccaugagccgcaccuccacacuguauaccgcgacgcaagugucuaccgagaacgccaaucauagcgcuccuagacaguccgaaagcucugcccagcccacaaccacauccccgaugaccagcccugcucagucuauccuugucauguccgccgcgcccaucgccauucaaaacauccacccuagccccacgaaucgguccaaacgcaaccuggagauggagauuauccucacacugucucagggccuuaagaaauacuaugggaagauucugaagcuccugcaucugacccucgaagaggacacagaaggacugcuugagugguguaaaagaaaucugggcagcaacugcgaugacgauuucuuccagaagcggaucgaagaguuuuucaugaccggggagggauacuuuaacgaagugcuccaguucaaaacccuguccacacuuucuccuacggagcccagccacgcucgcccgccuaccguugaacccuuuaaguccuauuucgccaaaggcuuucugagcauugacucuggguacuucuccgcuaaguguuaucccagaagcucuacauccggacuccaacugaucaaugugacccagcacccugcccggaucgccgagacaccgggccccaagaccacgagccugaaaacaauuaacugcaucaaucuccgcgcuucugucuuuaaggaacauagagagauugagaucaacgugcugcuuccucagauugcgguuaaucugagcaacugucacguggucaucaauucccaugugugcgauuacagccucgacaccgauggccccgugcggcugccucacaucuaccaugaagggaccuucauucccggaacauauaaaaucgucauugacaagaaaaacaaacuuaaugaucgcuguacccugguuacaaacugcgugaucaagggcagagaggugcggaaggggcaaucuguccuccgccaguacaagacggaaauuaaaaucggaaaggccuccaccggcagcagaaaacugcuguccgaggaaccuggggacgauuguaucucucggacacagcuccugagaaccgagacagcugagauucacgacgacaauuauggaggccccggcgauaagaucaccauuugcaacgggagcacgaucguggaccagcgccuuggauccgaacugggcuguuacaccauuaaucggguuaaaucuuuuaagcucugcgagaacagcgccacagggaagaccugcgaaaucgauuccacaccggugaaauguagacaaggauucugccugaagauuacccaggagggccgcgggcacgucaaacugucucggggcagcgaggugguucuugacgccugugauuccagcugcgaagugaugaucccuaagggaacaggcgacauccucgucgauuguucugggggacagcagcauuuccugaaagacaaucugauugaucucggcugcccccacaucccucugcuugggaagauggcuauuuauaucuguagaauguccaaccauccccgcaccacgauggccuuucuguucugguuuagcuucggauacgugauuacaugcaucuuuuguaaggcgcucuuuuauucucugaucauuaucggcacccuggggaaaaagauuaaacaauaccgggagcuuaagccgcagaccugcacaaucugugaaaccgcuccugucaacgccauugacgccgagaugcacgaucucaauugcuccuacaacaucugccccuauugugcuagcagacugacgucugacggccuggcccgccacgugccucagugccccaaacggaaggaaaagguugaggagacagaacucuaccugaaucuugagagaauccccuggauugugcgcaaacugcuccaggucuccgaaagcaccggaguggcucugaagcgguccagcuggcugaucguucuucucgugcugcugacagucucucucagcccugugcaauccgccccggugggccaugggaaaaccauugagacauaucagaccagagaaggauuuacgucuaucugucuguucaugcuuggcagcauucuguuucucguuuccugccuggucaaggggcugguggacucugugagcgauuccuucuuucccggacuuucugucuguaaaaccugcacaaucggcagcaucaacggguucgagauugagucccacaaguguuacugcagccucuuuuguugcccuuauugucggcauugcucugcggaccgcgaaauccaccagcugcaucuguccauuugcaaaaagagaaagaccggcagcaaugugaugcucgccguuuguaaacggaugugcuucagagcuacaaucgaggccucucgccgggcucugcuuauuagauccaucauuaacaccacguucgugaucuguauccugacacucaccauuugcgucgugagcacauccgccguugaaauggagaaucugcccucuggaaccugggaacgcgaggaggaucugaccaacuuuugucaccaggaaugccaagugacagagacggaaugucuuugcccuuacgaggcgcugguccucagaaagccccuguuccucgacagcaucgugaaaggcaccaagaaucugcuuaacuccacaagccuggagaccucucucuccauugaagccccuuggggagcuaucaauguucagagcacauuuaaaccgaccgugucuacggccaacauugcucugagcugguccucugucgagcaccgggggaauaagauccuggugacaggccgcagcgaauccaucaugaaacuugaggaaagaaccggggugucuugggaucugggagucgaggacgccagcgaguccaagcuccugaccguuagcauuauggaucucucucagauguauucccccguguucgaauaccugagcggcgaccggcaaguggaggaauggccuaaggccacauguaccggggauugccccgagcgcuguggcugcacauccucuacgugccuucauaaagaauggccucacagcagaaacuggcgguguaaucccaccuggugcuggggagucggcacaggguguaccugcuguggaguggacguuaaggaucuguuuacagaccauauguucgugaaauggaaggucgaguacaucaagaccgaggcuauugugugcguugaacucacgucccaggagcgccaguguucucugaucgaagcgggcaccagauuuaaccuggggccggugacaauuacccuuagcgagccucggaacauccagcaaaaacugccucccgaaaucauuacacuccaccccaaggucgaggagggauucuuugaucugaugcaugugcagaaaguucucuccgccagcaccgugugcaagcugcagucuuguacacacggcauccccggcgaccuucaggucuaucacauugggaaucugcugaaaggagaccgcaucaacggccaucucauucacaagaucgaaccucauuucaauacguccuggaugagcugggaugggugcgaccuggauuacuauuguaacaugggagacuggccgucuugcaccuacacaggcgugacccaacacaaucacgcugccuuugugaaccuucugaauauugagaccgauuauacaaagacguuccauuuucacuccaaaagagucaccgcccauggggacacaccccagcucgaucugaaggcucggccuaccuacggagccggcgaaaucacaguucucguggagguggcggacauggagcugcacaccaaaaaggucgaaaucagcggccuuaaauucgcuucucuggccugcacgggguguuaugccugcagcuccggaauuucuuguaaggugagaauccauguugaugagcccgacgaacugacagugcacgucaaaagcuccgauccugacgugguugcugccagcaccucccucauggcgcgcaagcuggaguucggcaccgauucuacauuuaaggcuuucagcgccaugcccaaaaccucccuuugcuuuuacauuguggaacgggaguacuguaagucuugcagcgaggaagacacacagaaaugugucgacaccaagcuggagcagccgcaauccauccucauugaacacaaagggacgaucaucggaaagcagaacgauacaugcaccgccaaggcuucuuguuggcuggagagcgugaaauccuucuuuuauggccucaagaauaugcuggggagcgucuucggaaacuuuuucauuggcauccuucuguuucuggccccuuucgugcuccugguucuguuuuucauguucggcuggaaaauucuguuuugcuucaaguguugcagacgcacacgggggcuccugaaauacagacaucucaaggacgaugaagagaccggauaucgccggaucauugagagacugaauaacaagaaaggcaagaaucgccuucuggacggggaacggcuggcugauagaaaaaucgccgagcucuuuucuacgaagacccacaucggauga

SEQ ID NO: 13595 - RNA, 5067 nt, Artificial Sequence
  derived and/or modified CDS sequence (opt5) from CCHFV(Mamon)__KX013478.1__GP
augcccaccaacaucaugcacacacugcucgugugcuucauucuguaccuucagcugcucggccuugggggagcccauggccaaagcaauacgaccgagcacaacgggacaaauaccacaaccgcuccuuccacaucucagagcccgaagccccuugucuccaccgccccuccccaugcgcuggaaucuagcacgaucaaaccuaccacacccgcuuccgagaccgaaggaucuggcgagacaaccccuccgcccaacauuacgcaggggccuagcccucccgaaacaacccccgagagaccggccacaaccgccaccuccacaccuagcacggacaauaccaacucuacaacccacguuacagauaauaaccccaccuccacgaucagcacaucuccuuccagcucucccuccacccccagcaccccucaggggauucaucacccggcucggaaucuccuguccgugucuagccccaagacagccaccacaccuacgcccaccuccccuggcgagaucagcucuaaaacauccagccugcacucugcuaugagccgcaccuccacacucuauaccgccacgcaagugucuaccgaaaacgcgaaucauagcgcccccagacaguccgagagcucugcucagccgacaaccacauccccuaugaccagccccgcccagucuauccuggucauguccgcugccccuacggcgauucaaaacauccaccccagcccuacaaaucgguccaagcgcaaccuugaaauggagauuauccugacccucucucagggccugaaaaaguacuaugggaagauucuuaaacugcuccaucugacacuggaggaagacaccgagggacuccuggaaugguguaagagaaaucuuggcagcaacugcgaugacgauuucuuccagaaacggaucgaggaauuuuucaugaccggggagggauacuuuaacgaggugcugcaguucaagacacucuccacgcugucucccaccgaaccgagccacgcccgcccucccacaguugagcccuuuaaauccuauuucgcuaagggcuuucuuagcauugacucuggguacuucuccgccaaguguuauccuagaagcucuaccuccggacugcaacucaucaaugugacacagcacccggcucggaucgccgaaacccccggcccuaaaacgacaagccugaagaccauuaacugcaucaaucugcgcgccucugucuuuaaagagcauagagaaauugagaucaacgugcuccugccccagauugcuguuaaucuuagcaacugucacguggucaucaauucccaugugugcgauuacagccuggacaccgauggcccugugcggcucccccacaucuaccaugaggggacauucauuccuggaaccuauaagaucgucauugacaaaaagaacaaacugaaugaucgcuguacacuuguuacgaacugcgugaucaagggcagagaagugcggaaggggcaaucuguccugcgccaguacaaaaccgagauuaagaucggaaaagcguccacaggcagcagaaagcuccuguccgaggaacccggggacgauuguaucucucggacccagcugcucagaacagaaaccgccgagauucacgacgacaauuauggaggcccgggcgauaaaaucacgauuugcaacgggagcaccaucguggaccagcgccugggauccgagcuuggcuguuacacaauuaaucggguuaagucuuuuaagcugugcgaaaacagcgcuaccgggaaaacaugcgagaucgauuccaccccugugaaguguagacaaggauucugccucaaaauuacacaggaaggccgcgggcacgucaagcugucucggggcagcgaggugguuuccgacgccugugauagcucuugcgaggugaugauccccaaaggaaccggcgacauccuggucgauuguuccgggggacagcagcauuuccuuaaggacaaucucauugaucugggcugcccucacaucccccugcucgggaagauggccauuuauaucuguagaaugagcaaccauccgcgcacgacaguggcuuuucuguucugguuuucuuucggauacgucauuaccugcaucuuuuguaaagcccuuuucuauucccugaucauuaucggcacccucgggaagaaaauuaagcaauaccgggaacugaaaccucagacaugcaccaucugugagacggcgcccgugaacgcuauugacgccgaaaugcacgaucugaauugcagcuacaacaucugcccuuauugugccucuagacuuacauccgacggccucgcucgccacguuccccagugccccaagcggaaggagaaaguggaagagaccgagcuguaccugaaucucgaaagaaucccuuggauuguccgcaagcugcuucaggugagcgaguccacaggaguugcccugaaacggagcucuuggcucaucgugcugcugguccuucucaccgugagccuguccccggugcaaucugcucccguuggccaugggaagacaauugaaaccuaucagacgagagagggauuuaccagcaucugucuguucaugcucggcuccauucuguuucuugucucuugccuggugaaagggcucguggacagcgucuccgauucuuucuuuccuggacugagcguguguaagacaugcuccaucggcagcaucaacggguucgaaauugagucucacaaauguuacugcucccuguuuuguugccccuauugucggcauugcagcgccgaccgcgagauccaccagcuucaucucucuauuugcaagaagagaaaaaccggcuccaauguuaugcuggcgguguguaagcggaugugcuucagagccacaaucgaagcuagccgccgggcccugcucauuagauccaucauuaacaccacguucgucaucuguauccugacacuuaccauuugcgugguuucuacaagcgcuguggagauggaaaaucugccuuccggaaccugggagcgcgaagaggaucucaccaacuuuugucaccaggagugccaagucacagaaacggagugucugugccccuacgaagcccuggugcuuagaaaaccucuguuccucgacagcaucguuaagggcaugaaaaaucugcucaacucuaccucccuggagacaagccuuucuauugaggcgccguggggagccaucaaugugcagagcaccuuuaagcccacagucuccaccgcuaacauugcccugucuuggagcuccguggaacaccggggaaauaagauccucgugacgggccgcucugagagcaucaugaaacuggaagagagaacaggggucuccugggaucugggaguugaagacgcuagcgagucuaagcugcugaccguguccauuauggaucucagccagauguauuccccuguguucgaguaccugucuggcgaccggcaagucgaagaguggcccaaagccaccuguacaggggauugcccugaacgcuguggcugcaccagcuccacaugccuccauaaggaguggccccacucuagaaacuggcgguguaauccgacguggugcuggggagugggcaccggguguacaugcuguggaguugacgugaaagaucuguuuaccgaccauauguucgucaaguggaagguggaauacaucaaaacagaggccauuguuugcguggagcuuaccagccaggaacgccaguguucccugaucgaggcuggcacgagauuuaaccucgggccugucaccauuacacugagcgaaccccggaacauccagcaaaagcugcccccugagaucauuacccuucaccccaaaguggaagagggauucuuugaucugaugcauguucagaaggugcucucugcguccacagucugcaaacugcagagcuguacccacggcaucccuggcgaccuccagguguaucacauugggaaucugcuuaagggagaccgcgugaacggccaucugauccacaagauugagccgcauuucaauacaucuuggauguccugggaugggugcgaccuggauuacuauuguaacaugggagacuggcccagcugcacguacaccggcgucacacaacacaaucacgccgcuuuuguuaaccuccugaauaucgaaaccgauuauaccaaaacauuccauuuucacucuaagagagugacggcccauggggacaccccucagcuugaucugaaagcccggcccacauacggagcuggcgagauuaccgugcucgucgaaguggccgacauggagcugcacacaaagaaaguugagaucagcggccucaaguucgcgucccuggcuugcaccggguguuaugccugcucuagcggaaucuccuguaaagugcgcauucaugucgaugaaccugacgagcuuacggugcacguuaagagcuccgaucccgacguggucgccgcuucuacaagccugauggccagaaagcuggaauuuggcaccgauuccaccuuuaaagcguucucugcuaugccgaagacaagccucugcuuuuacaucguggagcgggaauacuguaaauccugcucugaggaggacacccagaagugugucgacacaaaacuggaacagccucaaagcauucuuaucgagcacaaggggaccauuaucggaaagcagaacgauacgugcacagccaaaaccuccuguuggcuggaaagcgugaagucuuucuuuuauggccucaaaaauaugcugggguccguuuucggaaacuuuuucaucggcauucuccuguuucuugcccccuucgugcugcugguccucuuuuucauguucggcuggaagauccuguuuugcuucaaauguugcagacgcacacgggggcuucugaaguacagacaucucaaggacgaugaggaaaccggauaucgccggauuaucgagagacugaauaacaaaaagggcaaaaaucgccuccuggacggggagcggcuugcugauagaaagauugccgaacuguuuagcacgaaaacccacaucggauga

SEQ ID NO: 13596 - RNA, 5067 nt, Artificial Sequence
  derived and/or modified CDS sequence (opt5) from CCHFV(K340_6)__KX013475.1__GP
augcccaucaacauuaugcacacccugcucgugugcuucauccuguaccuucagcugagcggccucgggggagcccauguccaauccaaugcuacagagcacaacggcacgaauaccacaaccgccccugggacaucucagagcccgaagcccccugcguccaccacacugccccauaccccugaaucuagcacgguuaaacccaccacaccuaccuccgagacagaaggaucuggcgagaccacgccgcccccuaacacaacccaggggcuucccccuacaggaaccacccccgaaagaagcgcuacaacggccaccuccacaagcucuaccgacaauaugaacuccacaacccaggugacggauagcacaccgaccucuaccguguccacaagcccuucuuccagcuccucuaugcccagcaccucccaaggcauucaccauccuguccggagccugcucucuguguccagccccaagacaguuacgacccccacaccuaugucuccgggcgagaugagccccgagaccuccucucagcacagcgccaugucccgcgugccuacacuguauaccgcuacgcaggucagcaccgaaaauacagacagaucuacaccccggcaguccgagagcucugugcaaccugccacccagucccccaucaccagcccggcucagacgauucugcucauguccgccgcgccuaaagccauccaggauaugcaccccucuccuacaaaccgcagcaagagaaaucuggaaguugagaucauucuuacccugucccaagggcucaaaaaguacuauggaaagauccugaaacuucugcaucucacacuggaggaagacaccgagggccugcucgaaugguguaagcggaaccuggggucuaauugcgaugacgauuucuuccagaaacgcauugaggaauuuuucaucaccggagagggcuacuuuaacgaggugcuucaguucaagacacugagcacgcucucccccaccgaaccuagccacgucagacugcccacagcugagccguuuaaaucuuauuucgccaagggguuucuuuccauugacagcggauacuucucugcuaaguguuauccucgguccagcaccucuggccugcaacucaucaaugugacacagcaucccgcccgcauugcggaaacccccggcccuaaaacgacaagccugaagaccaucaacugcaucaaucugagagccuccguguuuaaagagcaccgggaagucgagauuaacguucuccugccgcagaucgcugugaaccuuagcaauugucacguggucauuaacucucaugugugcgauuacucccuggacaccgaugggcccguucgccucccuagaauccaccaugagggaacauucauucccggcaccuacaagaucgugaucgaccggaaaaauaagcugaacgaucgcuguagccuugucacaaauugcgugauuaaagggagagaaguucggaagggacaguccgugcugagacaauauaagacggagaucaaaauuggcaaggccucuaccgggagccgcaaacuccuguccgaggagccuggagacgacuguaucucucggacacagcugcucaagaccgaaacagcugagauucacgaugacaacuacggcggccccggggauaaaaucaccaucugcaauggaagcacgauugucgaccagagacugggcuccgagcuuggguguuauaccaucaaccgcgugaagucuuuuaagcugugcgaaaauagcacaaccggaaaaacaugcgagauugauuccaccccugucaagugucggcagggcuucugccucaaaaucacacaagaagggagaggccaugugaagcugagccgcggaucugagguugugcuggacgccugugauuccagcugcgagauuaugauccccaaaggcaccggggacauucuugucgauuguucuggaggccagcagcacuuccucaaggacaaccugaucgaucuggggugcccgcacaucccuccccucggaaagauggccauuuacaucugucggauguccaaucauccuagaacgacaauggcuuuucuguucugguuuagcuucggcuaugugauuaccugcaucuuuuguaaagcgcuuuucuacucucugauuaucaucgggacccucggcaagaaaauuaagcaguaucgcgaacugaaaccccaaacaugcaccaucugugagacggccccgguuaacgcuauugacgccgaaaugcacgaccugaauugcuccuacaacaucugcccuuacugugccagccggcuuacauccgauggacucgcuagacaugugacccagugccccaagcgcaaggagaaagucgaagagacagagcuguaucugaaucucgaacggauuccuuggaucgugagaaagcugcuucaggugagcgagucuaccggcguugcccugaaacggagcuccuggcucaucguccugcuggugcuucucacagugucucugagccccguccaguccgcgcccguggggcacggaaagaccauugaaacguaccaaacccgcgagggcuuuacaucuaucugucuguucaugcucgggagcauucuguuuaucguuuccugccuugugaaaggacuggucgacucugugagcgauuccuucuuuccuggccucagcguuuguaagaccugcucuauuggguccaucaacggcuucgaaaucgagagccacaaauguuauugcucucuguuuuguugcccguacuguagacauugcuccgcugaccgggagauucaccagcugcaucuuagcaucugcaagaagagaaaaacaggauccaacgugaugcucgccgucuguaagcgcaugugcuucaaagccaccauugaggcuucucggagagcccugcugauccgcagcauuaucaauacgacauucgugauguguauucucacccuggcuaucugcguuguguccacaagcgccgucgaaauggaagaucuucccgcgggcaccugggagagagaagaggaccugaccaacuuuugucaccaggagugccaagugacagaaacggagugucucugcccuuaugaagcccuggugcugcggaagccccuuucucuggauuccaucgucaaagggaugaagaaucuccugaacagcaccucucucgagacaagccuguccauugaggcuccuuggggagccaucaauguucagucuaccuucaagcccacagugagcaccgcuaacauugcccuuuccuggucuagcguggaacaucgcggcaauaaaauccuggucacggggagauccgagagcauuaugaagcucgaggaacggacaggagugucuugggaccugggcguugaagaugcguccgagagcaaacugcuuaccguguccaucauggaccugucucagauguacagcccugucuuugaguaucucuccggggaucgccagguggaagaguggccgaaggccaccuguacaggcgacugccccgaaagauguggaugcaccucuagcacaugccugcacaaagaguggccucacucccggaacuggcgcuguaaucccacguggugcuggggcguugggaccggauguacaugcuguggcguggaugucaaggaccucuucaccgaccauauguuuaucaaguggaaaguggaauacauuaagacagaggcuaucguuugcguggagcugaccagccaagaaagacaguguucucuuauugaggccgggacgcgguucaaccugggaccugucaccaucacacucuccgaaccccgcaauauucagcagaaacugccgccugagaucaucacccugcaccccaagauugaagagggcuuuuucgaucuuaugcaugugcaaaaagugcugagcgcuucuacagucugcaagcuccaguccuguacccacggcauccccggggaccugcagauuuaccauaucggaaaccuccugaagggcgauagaguuaaugggcaccuuauucacaaaaucgagccucauuuuaacacaagcuggaugucuugggacggaugcgaucuggacuauuacuguaauaugggcgauuggcccagcugcacguauaccggggugacacagcacaaccaugccgccuucgugaaccugcucaauauugaaaccgacuacaccaagacauuucacuuccacuccaaacgggucacggcucauggagauaccccucaacuggaccuuaaggcgagaccgacauauggcgccggcgagaucaccgugcugguugaagugacagauauggagcuccacaccaaaaaggucgagaucucugggcugaaauuugcuagccucacgugcacaggauguuacgccugcuccagcggcauuuccuguaaggugcgcauccauguugacgaacccgaugagcugaccgugcacgucaagucuagcgacccugacguggucgccgcuuccaccucucuuauggcccggaaacuggaauuugggacagauagcaccuucaaggcguuuuccgcuaugcccaaaacaucucugugcuucuauauuguggagagagaauacuguaagagcugcuccgaggacgauaccaaaaaguguguugacacgaagcucgagcagccucagagcauccugauugaacauaaaggaacaaucaucggcaagcaaaacgauaccugcacagccaaagccucuuguuggcuugaguccgucaagagcuuuuucuacgggcugaaaaauaugcucggaucuguguuuggcuccuucuuugugggcauucuccuguuccuggcucccuuuguucuucuggugcuguucuuuauguucggguggaagauccucuucugcuuuaaguguugccgccggaccagaggacuguucaaauaucgccacuuuaaggacgaugaagagacgggcuaccggagaauuaucgaacgccuuaacagcaaaaaggggaaaaaucggcugcucgacggagagagacuggccgaucggaagauugcggaacucuucucuaccaagacacacaucggcuga

SEQ ID NO: 13597 - RNA, 5067 nt, Artificial Sequence
  derived and/or modified CDS sequence (opt5) from CCHFV(K323_27)__KX013472.1__GP
augcccaucaacauuaugcacacccugcucgugugcuucauccuguaccuucagcugagcggccucgggggagcccauggccaauccaaugcuacagagcacaacgggacgaauaccacaaccgucccuggaacaucucagagcccgaagcccccugccuccaccacacugccccauaccccugaaucuagcacgguuaaacuuaccacacccaccuccgagacagaaggcucuggggagaccacgccuccgcccaacacaacccagggacugccucuccccggcacaaccccugaaagaagcgcgaccacagcuacguccaccagcucuacagacaauaugaacuccaccacacaggugaccgauaauacgcccacaagcaccgugucuauuuccccguccucuuccccuagcaugcccuccaccucucaaggcauccaccauccuguccggagccugcuguccgugagcucucccaagacaguuaccacacccacgccuauguccccgggggagaugagccccgagaccucuagccagcacuccgccaugucucgcauuccuacacucuauaccgccacacaggugagcaccgaaaacacggacagauccacaccccggcagagcgagucuuccguccaaccugcuacccagagccccaucaccucuccggcccagacaauccugcuuauguccgcugccccuaaagcgauucaggauaugcaccccagcccuaccaaucgcuccaagagaaaccuggaaguggagaucauucucacgcugucucaaggacuuaaaaaguacuauggcaagauccugaaacuccugcaucugacacucgaggaagacaccgaggggcugcuugaaugguguaagcggaaucugggaagcaacugcgaugacgacuuuuuccagaaacgcauugaggaauuuuucaucacaggcgagggguacuuuaaugagguucuccaguucaagacccuguccacccuuucucccacagaaagcucccacgugagacugccuacggccgagcccuuuaaaagcuauuucgcuaagggauuucucucuauugauuccggcuacuucagcgccaaguguuauccgcggucuuccaccagcggccugcaacugaucaacgucacacagcauccugcucgcaucgccgaaacccccgggcccaaaacaaccucucucaagacgauuaauugcaucaaccugagagcgagcguguuuaaagagcaccgggaaguggagauuaacguccuucugccucagaucgccguuaaucucuccaacugucacguggugauuagcucucaugucugcgauuacucccuggacacagauggaccggugcgccuucccagaauccaccaugagggcaccuucaucccugggaccuacaagauuguuaucgaccggaaagauaagcugaaugaccgcuguagccucgugacaaacugcgucauuaaaggaagagaagugcggaagggccaguccguucugagacaauauaagaccgagaucaaaauugggaaggcuucuacaggaagccgcaaacugcucuccgaggagcccggcgacgauuguaucucucggacgcagcugcuuaagaccgaaacagccgagauccacgacgauaauuacggcgggccuggagacaaaauuaccaucugcaacggcagcacaauuguggaucagagacugggguccgagcucggauguuauaccaucaaucgcgucaagucuuuuaagcugugcgaaaacagcgcuacgggcaaaaccugcgagauugacuccacacccgugaagugucggcagggguucugccugaaaaucacccaagaaggcagaggacaugucaagcugagccgcggcucugaggugguucucgaugccugugacuccagcugcgagauuaugaucccuaaagggacaggagauauccugguggacuguucuggcgggcagcagcacuuccugaaggauaaucucauugaccugggaugcccccacaucccgcuucugggcaagauggccauuuacaucugucggauguccaaccauccuagaaccacaauggcuuuucucuucugguuuagcuucggguaugucauuaccugcaucuuuuguaaagcgcuguucuaccugcuuaucauuaucggcacgcucggaaagaaaauuaagcaguaucgcgaacugaaaccccaaacaugcaccaucugugagaccgccccugugaaugcuauugacgccgaaaugcacgaucugaacugcucuuacaauaucugccccuacugugccucccggcucacaagcgacggccuggcuagacauguuacccagugcccgaagcgcaaggagaaaguggaagagacggagcuuuaucugaaccucgaacggaucccuuggauugucagaaagcugcuucagguguccgagagcacagggguggcccuuaaacggucuagcuggcucaccguucugcugguccuccugacagugucccuuucucccgugcagagcgcgccugucggacacggcaauaccaucgaaacauaccaaacccgcgagggguuuacguccauuugucuguucaugcucggaucuauccuguuuauugugagcugccugguuaagggccuuguggauuccgucucugacagcuucuuucccgggcucuccguguguaaaaccugcagcaucggcucuaucaacggauucgaaauugagucccacaaguguuauugcagccuguuuuguugcccccauuguagacaccggucugcugauagagagauccaucagcugcaccucuccauuugcaaaaagcgcaagacaggcagcaacguuaugcuggccgugugcaaacggauguguccuaaggccaccaucgaagcuagcagacgcgcccuuccgauuagaucuaucauuaauacaacccuggucaugugcauccucacgcuggcuaucugugugguuagcacauccgccguggagauggaagaccugcccgcggggaccugggagcgggaagaggaucuuacaaacuucugccaucaggagugucaagucaccgaaaccgagugccuguguccuuacgaagcccucgugcugcgcaaaccccucuuccuggacagcauugcuaagggaaugaaaaaucuucugaacucuacaucccucgagacgagccugucuaucgaggccccuuggggcgcuauuaaugugcagagcaccuuuaagcccacagucuccaccgccaacaucgcgcugucuuggagcuccguugaacacagagggaauaagauucuugugacaggacggucugagagcaucaugaaacuggaggaacgcaccggcguguccugggaucucggggucgaagacgccagcgagucuaagcugcucacgguguccaucauggaucugagccagauguauuccccuguuuucgaguaccuuucuggcgacagacagguggaagaguggccgaaagcuacaugcaccggagauugucccgaacggugcggcuguaccagcuccacaugccugcacaaggaguggccucauucucgcaacuggagaugcaaucccaccugguguuggggagucggaacaggcugcacguguugcgggguggacguuaaagaccucuuuaccgaucacauguucauuaaguggaagguggaauauaucaaaacagaggccauugucuguguggagcugaccggacaagaacggcagugcagccugaucgaggcuggcacacgcuuuaaccuuggcccuguuaccauuacgcuguccgaacccagaaauauccagcagaagcucccgccugagaucauuacccugcaucccaaaaucgaagagggguucuuugaccucaugcacgugcaaaagguccugagcgccucuacaguguguaaacuucaguccugcacccaugggauucccggcgaucugcagaucuaccacauugggaaccugcucaagggagaccgggugaauggccaccugauccauaagauugagccucacuucaacacaagcuggaugucuugggaugggugugaccuugauuacuauugcaauaugggagacuggcccuccuguaccuacacaggcgucacgcagcauaaccacgccgcuuuuguuaaccugcucaauaucgaaaccgauuauacaaaaaccuuccacuuucauagcaagagagugaccgcgcacggcgacacaccucaacuggaucucaaagcccgcccgacguacggggcuggagagaucaccgugcuggucgaaguggccgacauggagcuucauacaaagaaaguugagauuucuggccugaaguucgccagccugaccugcacagggugcuaugcuuguuccucuggaaucagcugcaaagugcggauucacgucgaugaacccgacgagcucaccgugcauguuaaguccagcgacccugauguggucgccgcguccacgucucugauggcuagaaaacuugaauuuggcacagacagcaccuucaaggccuucuccgccaugcccaagaccucucuguguuuuuacaucguggagcgcgaauauugcaaaagcuguuccgaggaugacacaaagaaaugcgucgauaccaagcucgagcagccucagucuauucugaucgaacacaaggggacaaucauuggaaaacaaaacgacaccuguacggcuaaggccagcugcuggcucgaguccgugaaaucuuucuuuuacggccugaagaauaugcuuggcagcguuuucggguccuuuuucgugggaauccugcuguuucucgcgcccuucguccugcuugugcuguuuuucauguuuggcuggaaaauucucuucuguuucaagugcugucggagaacacgcgggcuguuuaaguaccggcaccucaacgaugacgaagagaccggauauagacgcaucauugaacggcugaauagcaaaaagggcaaaaacagacuucuggauggggagcggcuggcugaccgcaagaucgccgaacucuucucuacaaaaacccauaucggauga

SEQ ID NO: 13598 - RNA, 5067 nt, Artificial Sequence
  derived and/or modified CDS sequence (opt5) from CCHFV(K315_14)__KX013469.1__GP
augcccuucaacaucaugcacacccugcucgugugcuuuauucuguaccuucagcugagcggccucgggggagcccauggccaauccaaugagacagaacacaacgggacgaauaccacaaccgucccuggaacaucucagagcccgaagcccccugcuuccaccacacugcagcauacccccgagucuagcacgguuaaacuuaccacaccuaccuccgaaacagagggcucuggggaaaccacgcccccuccgaacacaacccagggacugcccccucccggcacaaccccugagagaagcgccaccacagcgacguccaccagcucuacagacaauaugaacuccaccacacaagugaccgauaauacgcccacaagcaccgugucuaucuccccgagcagcuccccuagcaugcccuccaccucucagggcauucacuauccuauccggagccuccuguccgucagcucucccaagacagugaccacacccacgccuauuuccccgggggagaugagccccgaaaccucuagccagcauuccgcuaugucucgcaucccuacacuguacaccgccacacagguuagcaccgagaacacgaauagauccacaccccggcaaagcgaaucuuccgugcagccugccacccagagccccaucaccucuccggcucagacaauucuccugauguccgccgcuccuaaagccauccaagacaugcaccccagcccuaccaaccgcuccaagagaaaucuugaggucgagauuauccugacgcucucucagggacugaaaaaguauuacggcaagauucuuaaacugcuccaccugacacuggaagaggauaccgaagggcuccuggagugguguaagcggaaccuuggaagcaauugcgacgaugacuucuuucagaaacgcaucgaagaguucuuuauuacaggcgagggguauuucaacgaagugcugcaauuuaagacccucuccacccugucucccacagagccuagccauguuagacuucccacggcggaaccguucaaauccuacuuugccaagggauuccugagcaucgauucuggcuauuuuuccgcuaaguguuacccucggagcucuaccuccggccuccagcugaucaaugugacacagcaccccgcccgcauugcugagacccccgggccuaaaacaaccagccugaagacgaucaacugcauuaaccucagagccucugucuucaaagaacaucgggagguggagaucaaugugcugcuuccgcagauugcggucaaccugagcaauugucacguugugaucaacucccacgugugcgacuacagccucgauacagacggacccguccgccugccuagaauccaucacgaaggcaccuuuauucccgggaccuauaagaucgugauugauaaaaagaauaaacuuaacgaccgguguucucugguuacaaauugcgugaucaagggacgcgaggucagaaagggccaauccgugcuccggcaguacaaaaccgaaauuagaaucgggaaggccagcacaggaucccgcaaacugcugucugaggaaccuggcgaugacuguaucagccggacgcagcuccugaagaccgagacagcugagauucaugacgauaacuauggcgggcccggagacaaaaucaccauuugcaauggcuccacaguuguggaucagagacuugggucugaacugggauguuacaccaucaaccgcgucaagagcuucaagcucugcaaaaauuccgccacgggcaagaccugcgagauugacucuacaccugugaaaugucggcaaggguucugccugaagaucacccaggaaggcagaggacacgucaaacugagccgcggcuccgaggugguucuugaugugugugacagcucuugcgagauuaugauccccaaggggacaggagauauccucgucgacuguuccggcgggcagcagcauuuucugaaggauaaccugauugaccucggaugcccgcacaucccucugcuuggcaaaauggcuauuuauaucugucggaugagcaaucaccccagaaccacaauggccuuccuguuuugguucucuuuuggguacgugauuaccugcaucuucuguaaggcccucuuuuauucccugaucauuaucggcacgcuggggaaaaagauuaaacaauaccgcgaacuuaagccucagacaugcaccaucugugagaccgcucccguuaacgcgauugaugccgaaaugcaugaccucaauugcagcuacaacaucugcccguauugugcuucucggcugacauccgagggccuggccagacacgugacccagugcccuaagcgcaaagaaaaggucgaggagacggaacucuaccugaaccuugagcggauccccuggauugugagaaaacugcuccaggugagcgaauccacagggguugcccugaagcggagcucuuggcugaucguccuucucgugcugcugaccgugagccucuccccuguccaaucugcucccgugggacauggcaaaacaauugagaccuaucagacacgcgaaggguucaccagcaucugucuguuuaugcuuggauccauucuguucaucguuucuugccucgugaagggccuggucuacagcguguccgacagcuuuuuccccgggcugucuguuuguaaaacgugcuccaucggcagcauuaauggauuugagaucgagucucacaaguguuauugcucccuuuucuguugcccuuacuguagacacugcagcgccgaucgggaaauucaucagcuccaccugucuaucugcaagaaaagaaagaccggcuccaacgugaugcuggcggucuguaaacgcaugugcuucaaggcuacaauugaggccagccggagagcccuccugauccgcuccauuaucaauaccacauuugugaucuguauucuuacccuggcuaucugcguugugucuacgagcgccgucgaaauggaggaccucccggcugggacaugggaaagagaggaggaucugaccaacuucugucaucaagaaugccaggugacagagaccgaaugucugugccccuaugaggcccuugugcugcggaaaccucucuuucuggacuccauugucaagggaaugaagaaacuccugaauagcaccucucuugagacaucccugagcaucgaagcgcccuggggcgccauuaacguucagucuacguucaagccuaccgugagcacagcuaauaucgcccucuccuggucuagcguggagcaccgcgggaacaaaauccuggucaccggaagauccgaaucuauuaugaagcuggaggaacggacaggcgugagcugggaucuugggguugaggacgcuuccgagagcaaacugcucaccgugucuaucauggaucugucccagauguacagccccgucuuugaauaccucuccggcgaccgccaaguggaggaauggccuaaggccacguguacaggagauugcccggagagauguggcugcaccucuucuaccugccugcauaaggaauggccccacucccggaauuggcgcuguaacccuacauggugcuggggaguuggaaccggcuguacaugcugugggguggacgucaaagaucuuuucacggaccacauguuuauuaaguggaaaguggaguauaucaagaccgaggcgauuguuugcguggaacugacaucucaggagagacaguguagccucaucgaagccggaacccgguucaaucugggccccgucacaaucacccuguccgagccucgcaacauucagcaaaaacuucccccggaaaucauuacgcugcauccuaagaucgaggagggcuuuuucgaucucaugcacgugcagaaggugcugagcgcuucuaccgucugcaaacuccaguccuguacacaugggauucccggagaccugcagaucuaccacauuggcaaucuucugaagggggacagaguuaacggacaucugauccacaaaaucgaaccccacuuuaauaccagcuggaugucuugggauggcugcgaccucgauuauuacuguaacaugggggacuggccuuccugcacauauaccggagugacacaacauaaccacgccgcuuucgugaaucugcuuaacauugagacggauuacaccaagacauuucauuuccacagcaaacgggucaccgcccacggcgacacaccccagcuggaucucaaggccagaccuaccuauggcgcuggggaaaucacggugcugguugagguggcggacauggagcuccauaccaaaaaggucgaaauuucuggacugaaguucgccagccuuacaugcaccggcuguuacgcuugcuccucugggaucagcuguaaagugcgcauucacguugaugagccggacgaacugacagugcaugucaaguccagcgaucccgacguggucgccgccuccaccucucugauggcucggaaacucgaguuuggaacggauagcacauucaaggccuuuuccgcgaugccuaaaaccucucugugcuucuacaucguggaaagagaguauuguaagagcugcuccgaggacgacaccaagaaauguguugauacaaaacuugaacagccccaaucuauccugauugagcacaagggcaccaucauugggaagcagaaugacacaugcaccgcuaaagccagcuguuggcucgaauccgucaagagcuuuuucuacggacugaagaacaugcucggcucuguguuuggcuccuucuuuguggggauccugcuuuuccuggccccuuuuguucugcucgugcuguucuucauguuuggauggaaaauucuuuucugcuuuaaguguugccgccggacgagaggccuguucaaauaucgccaucucaaggaugacgaggaaacaggguaccggagaaucaucgagcgccugaauagcaaaaagggaaagaaccggcuccuggauggcgagagacuugcugaccggaaaauugccgaacuguuuucuaccaagacacacaucggguga

SEQ ID NO: 13599 - RNA, 5067 nt, Artificial Sequence
  derived and/or modified CDS sequence (opt5) from CCHFV(K229_243)__KX013466.1__GP
augcccaccaacaucaugcacacacugcucgugugcuucauucuguaccuucagcugcucggccuugggggagcccaaggccagagcaaugcuacggagcauaacgaaaccaauacaaccacagccccuuccaccucucagagcccgaagcccccugucuccacaacacccccucacgcgcuugagucuagcacgaucaaacccaccaccccugcuagagaaaccgagggguccggagaaacaaccccgcccccuaacacgacacagggccccucuccucccgaggccaccccggagcggccugccacaaccgcuaccagcacacccuccacggacaauaccaacagcacaacccauguuacagauaauaacccuaccucuacgauuuccacaagccccucuuccagccccucuaccccuuuuaccccgcaagggauccaccaucccgcccgcaaucugcucuccgugagcuccccuaagacagcuaccacacccacgccuaccucucccagagaacugagcuccgagacaagcucucugcacuccgccauuagccggaccucuacacucuauaccgcgacccaggugagcacggaaaacgccaaucacuccgcuccgcgccagucugagagcuccgcccagccuacaaccacaagccccaugaccucuccugcucaauccauccuggucaugagcgccgcgcccacggccauccagaacauucauccuucucccacaaauagauccaaacggaaccuugagauggaaaucauucugacccucagccagggacugaagaaauacuauggcaagauccuuaagcugcuccaccugacacuggaggaagacaccgagggccuccuggaaugguguaaacgcaaucuuggguccaacugcgaugacgauuucuuucagaagagaauugaggaguucuuuaugaccggagaaggcuacuucaacgaggugcugcaauuuaaaacacucucuacgcugagcccgaccgaaccuucccaugcucggccucccgccguugagcccuucaagucuuauuuugcuaaaggguuccuuagcaucgacuccggauacuuuagcgccaaguguuauccgagaucuuccacaagcggccugcagcucauuaaugugacccagcaccccgcccgcaucgcugaaacaccugggcccaagaccacgucucugaaaacaaucaacugcauuaaucugcgggcguccgucuucaaggagcaccgcgagaucgaaauuaacgugcuccugccucaaaucgccguuaaucuuagcaacugucauguggucauuaauucucacgugugcgauuacagccuggacaccgauggacccgugagacucccucauaucuaccacgagggcaccuuuauccccggcacauauaaaauugucaucgacaagaaaaacaagcugaaugaucgguguacccuuguuacaaacugcgugauuaaagggcgcgaagugagaaagggacaguccguccugcggcaguacaagacggagaucaaaauuggcaaggcuagcaccgggucuagaaaacuccuguccgaggaaccgggagacgauuguaucagccgcacacagcugcuccggaccgagacagccgaaauccaugacgacaauuauggcgggccuggagauaagauuaccaucugcaacggcuccacgauuguggaccaaagacugggcucugagcuuggguguuacaccaucaaucgcguuaaaucuuucaagcugugcgaaaacuccgccacaggaaagaccugcgagauugauucuacacccgugaaaugucggcagggcuucugccucaagaucacccaggaggggagaggacacgucaaacugagccgcggcuccgaagugguucuggacgcuugugauucuagcugcgaggugaugauuccuaaggggacaggcgacauccuugucgauuguuccggaggccagcaacacuuucucaaagacaaucugaucgaucuggggugcccccauauuccgcuccugggaaagauggccaucuauauuugucggaugagcaaccacccuagaaccacgauggcguuccuguuuugguucucuuuuggcuacgugaucacaugcauuuucuguaaggcucuguuuuauucccucaucaucauugggacccuggggaaaaagaucaaacaguaccgcgaacugaagccccagaccugcacaauuugugagaccgccccugucaacgccaucgacgcugaaaugcaugaucuuaauugcagcuacaacauuugccccuauugugccucucggcucacguccgacggccuggcuagacacgugccccagugcccuaaacgcaaggagaagguugaggaaacagagcuguaccucaaucuggaacggaucccguggaucgugagaaaacuucugcaagucagcgagucuaccgggguggcccucaagcgguccagcuggcugauuguucugcuugugcuccugacagucucccugagccccgugcagucugcgccugugggccacggaaaaaccaucgaaacauaucagacccgcgagggcuucacgagcauuugucucuuuaugcugggguccauccuuuuccugguuucuugccucgucaagggacugguggacagcguguccgauagcuuuuuccccggccugagcgucuguaaaaccugcuccauugggucuaucaacggauuugagaucgaaagccauaaguguuacugcucccuuuucuguugcccuuauuguagacacugcagcgccgaccgggagauucaucagcuccaccugucuaucugcaaaaagagaaagacaggcuccaaugugaugcuggcuguuuguaaacgcaugugcuuccgggccaccauugaagcuagcagacgcgcccuccugaucagaucuauuaucaacacaaccuuugugauuuguauccuuacgcugacaaucugcgucguguccaccagcgcgguugagauggaaaaucuccccgccgggacaugggagcgggaggaagaucugaccaacuucugucaucaagagugccaggugaccgaaacagagugucugugcccuuacgaggcucuuguccugcgcaagccgcucuuucuggacuccauugugaaaggcaugaagaaucuccugaacucuacgagccuugaaaccucccugagcaucgaggcccccuggggagcuauuaauguucagucuacauucaaaccuaccguguccacagccaacaucgcccucagcuggucuagcgucgaacacagaggcaauaagauucuggugaccgggcgguccgagucuaucaugaagcuggaggaacgcacgggagugagcugggaucuuggcgucgaggacgcuuccgaaucuaaacugcucacaguuagcaucauggaucugucccaaauguauagccccguguuugaguaccucucuggggacagacagguggaagaguggccuaaggcgaccuguaccggagauugccccgaacgguguggcugcacauccucuaccugccugcacaaagaguggccgcauucccgcaacuggagauguaauccuacauggugcuggggagucggcacgggauguaccugcuguggcguggacguuaaggaucuuuucacagaccacauguuugugaaauggaaggucgaguacauuaagaccgaagccaucgugugcguugagcugacaucucaggaacggcaguguagccucauugaggcugggacccgcuucaaccugggacccgugacgaucacccuguccgaacccagaaacauucaacagaaacuuccucccgagaucaucacacugcauccuaaggucgaggaaggcuuuuucgaucucaugcacgugcagaaaguucugucugccagcaccgugugcaagcuccaguccuguacacaugggauuccgggagaccugcaagucuaucacaucggcaaucuucugaaaggcgaccgggugaacgggcaccugauucauaagaucgagccccacuuuaauaccagcuggaugucuugggauggaugcgaccucgauuacuauuguaacaugggcgacuggccuuccugcacauacacgggggugacccagcauaaucacgccgcuuucgucaaccugcuuaauauugaaacagauuauaccaagaccuuucacuuccauagcaaaagaguuacagcccacggagacacgccccagcuggaucucaaggcgcgcccuaccuacggcgcuggggagaucacagugcugguggaggucgccgacauggaacuccauaccaaaaagguggagauuucuggacugaaauucgccucccuugcuugcacaggcuguuaugccugcagcucuggcaucagcuguaagguucggauccacguggaugaacccgacgagcugaccguccaugugaaauccucugauccggacguuguggcggcuagcacgucccugauggccagaaagcucgaauuugggacagauagcaccuucaaggccuuuuccgcuaugccuaaaaccucucugugcuucuacauugucgagaaggaguacuguaaaagcugcuccgaagaggacacacagaaguguguggacaccaaacuugaacaaccccagucuauccugauugagcacaagggaacaaucauuggcaagcagaacgauaccugcacggccaaagcuagcuguuggcucgaauccgucaagagcuuuuucuaugggcugaaaaauaugcucggaagcguguuuggcaacuucuuuaucgggauccugcuuuuccugacaccuuuuguucugcucgugcuguucuucauguuuggauggaagauucuuuucugcuuuaaauguugccgccggaccagaggccugcucaaguaccgccaccugaaggacgaugaggagacaggcuaucggagaaucauugaacgccucaauaacaaaaaggggaaaaaucggcugcuugacggagagagacuggccgaucggaagaucgcggaacuguucuccaccaaaacgcauauuggcuga

SEQ ID NO: 13600 - RNA, 5067 nt, Artificial Sequence
  derived and/or modified CDS sequence (opt5) from CCHFV(K229_194)__KX013463.1__GP
augcccaucaacauuaugcacacccugcucgugugcuucauccuguaccuucagcugagcggccucgggggagcccauggccaauccaaugcuacagagcacaacgggacgaauaccacaaccgucccuggaacaucucagagcccgaagcccccugccuccaccacacugccccauaccccugaaucuagcacgguuaaacuuaccacacccaccuccgagacagaaggcucuggggagaccacgccuccgcccaacacaacccagggacugccucccccuggcacaacccccgaaagaccggcgaccacagcuacgagcaccuccagcacagacaauaugaacucuaccacacaggugaccgauaauacgccuauuuccacagugagcaucucucccuccagcucuccuuccaugcccagcaccucccaaggcauucacuaucccguccggucucuccugagcguguccagcccuaagaccguuacaaccccgacacccaugucuccuggggagaugucccccgagacgagcucucagcauagcgccaugucccgcaucccuacccuguacacagccacccaggugucuacagaaaacaccaauagaagcacgccccggcaguccgagagcucugcucaaccggccacccaguccccuacaaccagccccacacagaccauccuccugaugucugcugccccuaaagcgauucaggacaugcaccccuccccuacgaaccgcagcaagagaaaucuugaagucgagaucauucugacacucucccaaggacugaaaaaguauuacggcaagauccuuaaacugcuccaccugacccuggaggaagauacagaggggcuccuggaaugguguaagcggaaccuuggaucuaauugcgacgaugacuuuuuccagaaacgcauugaggaauuuuucaucaccggcgagggguauuuuaacgaggugcugcaguucaagacccucaauacacugagccccacggaaccgucccauguuagacuuccuaccgccgagcccuuuaaaucuuacuucgcuaagggauuucugagcguggauuccggcuauuucagcgccaaguguuacccccggucuuccacaagcggccuccaacugauuaacgucacccagcacccugcucgcaucgccgaaacaccggggcccaaaaccacgucucugaagacaaucaacugcauuaaucucagagcguccguguuuaaagagcaucgggaaguggagaucaacguccugcuuccucagauugccguuaaucugagcaacugucacguggugaucaauucucacgucugcgacuacagccucgauaccgacggacccgugcgccugccucggauucaucacgagggcaccuucauccccgggacauauaagaucguuauugauaaaaagaacaaacuuaaugacagauguucccuggugaccaacugcgucaucaagggacgcgaagugagaaagggccagagcguucuccggcaauacaaaacagagauuaagaucgggaaagcuagcacgggauccagaaagcugcugagcgaggaaccuggcgaugacuguauuucccgcacccagcuccugaaaacagaaaccgccgagauccaugacgauaauuauggcgggcccggagacaagaucacaauuugcaacggcucuaccaucguggaucagcggcuugggagcgagcugggauguuacacgauuaauagagucaaguccuuuaaacucugcgaaaacucugcuaccggcaagacaugcgagaucgacagcaccccggugaaaugucgccagggguucugccugaagauuacacaagaaggccggggacacgucaaacuguccagaggcucugaggugguucuugaugccugugacagcuccugcgagaucaugauuccuaaggggaccggagauauccucguggacuguagcggcgggcagcagcauuuccugaagggaaaucugaucgaucucggcugcccccacauuccucugcuugggaaaauggccaucuauauuugucgcaugucuaaccacccccggacaaccauggcuuuucuguucugguuuuccuucggcuacgucaucacgugcaucuuuuguaaggcucucuucuauagccugauuaucauuggaacacugggcaaaaagaucaaacaguacagagaacuuaagccgcaaaccugcaccauuugugagacagccccugugaaugcuaucgacgccgaaaugcaugaucucaacugcucuuacaacauuugccccuauugugccucccgccugaccagcgacgggcuggcucggcacguuacgcagugcccuaagagaaaagagaagguggaagagacagagcucuaccugaaucuugaacgcauccccuggaucguccggaaacugcuccaggugucugaguccaccggaguggcccugaagagaagcuccuggcugauuguucuucucguccugcugacagugagccucucucccgugcagagcgcgccugucggccaugggaaaaccaucgaaacauaucaaacccgggagggauuuacgaacauuugucuguucaugcuuggcuccauccuguuuauugugucuugccucguuaaggggcugguggacagcgucuccgauucuuucuuuccgggccugagcguguguaaaaccugcuccaucggaucuaucaauggcuucgaaauugagagccacaaguguuacugcucccucuuuuguugccccuauugucgccacugcagcgcugacagagagauccaucagcuucaccuggggauuugcaagaaacggaagacaggaucuaacguuaugcuggccguguguaaaagaaugugcuucaaggccaccaucgaggcuucccgccgggcccuccugauuagaagcaucauuaauacaaccuucgucaucuguauccuuacgcuggcuauuugcgugguuucuacauccgccguggaaauggaaaaccucccugcgggcaccugggagcgcgaagaggaucugacaucuuuuugucaucaggagugccaagucaccgaaaccgagugucugugccccuacgaagcccuugugcugagaaaaccucucuuccuggacuccaucgugaaggggaagaaaaaucuccugaacucuacaagccuugagacgucccugagcauugaggcucccuggggagccaucaauguccagucuaccuuuaagccuacaguuuccaccgcuaacauugcccucagcuggucuagcguggaacaccggggcaauaaaauccuggugacagggcgcuccgagucuaucaugaagcuggaagagagaaccggcgucagcugggaucuuggaguggaagacgcguccgagucuaaacugcucacgguuagcauuauggaucugucccagauguauagcccgguguucgaguaccucucuggcgaccggcaggucgaagaguggcccaaggccacauguaccggggauugcccugaacgcuguggaugcaccuccagcacaugccugcauaaggaguggccccacuccagaaacuggcgguguaauccuaccuggugcuggggcguggggacaggauguacgugcuguggcguugacgugaaagaucuuuuuaccgaccacauguucaucaaguggaaagucgaauacauuaagacagaggcuaucgugugcguugagcugaccucucaagaacgccaguguagccucauugaggccggcacaagauuuaaccuggggcccgugaccaucacgcuguccgaaccgcggaauauccagcagaaacuuccucccgagauuaucacccugcaucccaagauugaagagggauucuuugaucucaugcacguccaaaaggugcugucugcuagcacagugugcaaacuccaguccuguacccauggcaucccuggggaccugcagauuuaucacaucggaaaccuucugaagggcgaccgccugaacgggcaucucauucacaaaaucgagccccacuucaauacaagcuggaugucuugggauggaugcgaccuggauuacuauuguaacaugggcgacuggccuuccugcaccuacacaggcgucacgcagcauaaucacgccgccuuuguuaaccuucugaauaucgaaaccgauuauacaaagaccuuccauuuucacagcaaaagagugaccgcucacggggacacaccgcaacucgaucugaaggcgcggcccacguacggagccggcgagauuaccgugcucgucgaaguggcugacauggagcugcauaccaaaaagguugagaucucugggcuuaaguucgccucccuggccugcacaggauguuauagcugcucuagcggcauuuccuguaaagugagaauccacgucgaugaaccugacgagcugacagugcauguuaagucuagcgaucccgacguggucgcugccuccaccagccucauggcgcgcaaacuggaguucgggacggauuccacauuuaaggcuuucucugccaugccuaaaaccagccuuugcuuuuacauuguggaacgggaauacuguaaguccugcucugaggacgacaccaagaaaugugucgauacaaagcuggagcagccccagagcauccucaucgaacacaaaggaaccauuaucggcaagcaaaacgacacaugcaccgccaaagcguccuguuggcuggagucuguuaagagcuucuuuuauggccucaagaauaugcugggguccguguucggaaacuuuuucgugggcauucuucuguuucuggccccguucguccuccuggugcuuuucuuuauguucggguggaaaauccuguuuugcuucaaguguugcagacgcacgcggggacucuuuaaauacagacaucugaaggaugacgaagagacaggcuaucgcaaaauuaucgaacggcucaauagcaagaaggggaaaaacagacugcuugauggagagcgccuggcggaccggaagaucgcugagcuguucucuaccaaaacacacauuggcuga

SEQ ID NO: 13601 - RNA, 5067 nt, Artificial Sequence
  derived and/or modified CDS sequence (opt5) from CCHFV(Gaib)__KX013445.1__GP
augcccgugagcaucauguacauuccucuggucuaugccguuaucuaccuccagcuguauggccuugggggagcucacggccugcucaacaagaccgagcaaaaugaaacagggauuacggccacccauggaagagugcagggcccgcccuccgcgucuaucacacugccugugacccccgacccucuuagcgcuacauccgccgccucuaccagcgggcccgagggauccggcgaagucccuacaucuccgagcaccauuacgcagggccugaccuccagcgagaacacaccccagcucccuaccgcuacagauaccgggaucucuuccacgagcaucauugacgugucuacacaaaccgccggagauacauccacccccaccgcucacacaagccugccuaauucucccuccgccccguucacgagccaggacacccggcauacaguucgcggccugcucaccgugacauccaccaaaucugaugaagcgagcacgcugacagacccuaaggaggccuccaccgaggcuagaagccccucuccuuccaucagccggacccccacacccucuccuaccguccaggccagcacagaaaacaauacgccguccacccccagacagccugagcccacaaccagaccugcccuucccucuccgacaaccagcccuacgcaacccucccugagccagucugcuaccuccgcggccauucaggauaugcacccuagccccacaaaccggucucgcagaaaucucgaaauggagaucauucugacccuuucccaggggcugaaaaaguacuauggaaaaauccucaagcugcuggaccucacacuggaggaagauaccgagggccuucuggaauggugcaagcggaaccucgaccugacgugugaugagaacuuuuuccuuaaacgcauugaagaguuuuuccugagcggggagggacauuuuaaugaagugcuccaauucaaggcuccuuccacaaugucuagcaccgagcccacacacgccggcccgccuaccguugaacccuuuaaauccuacuucgcuaagggcuuucugucuaucgacagcggguauuucuccgccaaaugcuaccccagaaccagcaauucuggacugcagcucaucaacgugacacagcacacggcccggauugcugauaccccuggcccgaagaucacaaaugucaagaccauuaacuguaucaaucugaaagcguccguguuuaagaaacaucgcgagguggaaauuaacguccuucugccccaaaucgccguuaaccucagcaauugccacgugcugaucaagucucaugugugugacuacucccuuaacuucgacgggauggucagacugccucggauucaccacgagggaacauuuauccccggcaccuauaaaauugugaucgaucgcaagaauaaacagaacgacagaugcacgcucguuacaaauugugugauuaaggggcgggaggucagaaagggacagagcgcucugcgccaguaccggaccgaaaucaaaaucggcgaggccucuauuggcagcagacgccugcucuccgaagagagcucugaugacugcaucucccggacccaacugcuuagaacagaaaccgccgagauucauaacgauaauuaugggggaccuggcgacaagaucacaauuuguaacgggagcacgaucguggaucagcgccugggauccgagcucggcugcuacaccauuaaucggguuaaaucuuucaagcugugugaaaacagcgcuacagggaaauccugcgagaucgacucuauccccgugaagugcagacagggcuucugucugaagauuacccaggaaggacgcggccacgucaaacuuagccggggguccgaggugguccucgaugccugcgacucuagcugugagaucaugauuccuaagggaacaggcgauauccugguggacugcuccgggggacaacagcauuuucugaaagacaaucucauugaucugggcugucccaacaucccgcuucuggggaagauggcgaucuauauuugcagaaugagcaaucacccuaaaaccacgauggcuuuccucuuuugguucucuuuuggcuacguuaucaccuguauuuucugcaaggccaucuuuuaucugcugauuaucgugggaacacuuggcaagaaauucaagcaguaccgcgaacucaaaccccagaccuguacaaucugcgagaccacaccugucaacgccauugacgcugaaaugcaugaucugaauuguuccuacaacaucugccccuauugcgccagccggcugaccucugacgggcucgcuagacacgugguucacuguccgaagcggaaagagaagauugaagagacggagcuguaccuuaaccuggaacgcgugccuugggucgugagaaagcuccugcaaguguccgagagcacaggaguugcccugaaacggucuuccuggcuuaucguccuccuggugcugcucaccgugagccugucccccguccagagcgcgccuauuggccaugggaagaccaucgaaacauaucagaccagagagggauacacgucuaucugccuuuuugugcugggcgggauucucuucaucguuagcugucugaugaaaggccugguggauuccgucggaaauaacuuuuuccccggccuuacaauuugcaagaccuguucuaucagcuccauuaauggguuugaaaucgagucucacaaaugcuauuguagccuccugugcugucccuacugccgccauuguuccgccgaccgggagauucaccagcugcaccucucuaucugcaagaaaagaaagacaggaagcaacgugaugcuggcuguuugcaagcgcaugugucuuagagugaccacagaagucuccaaucgggcccuguucauccgcagcauuaucaacaccacguucgugauuugcauccucauucuggcuguuugugugaucucuaccuccgccgucgagauggaaaaucugccugcgggcacaugggagagagaagaggaucuuaccaacuuuugccaucaagagugucaggugacagaaaccgagugccuguguccguaugaagcccucgugcugcggaaaccccucuucagcgacucuaucgucaaggggaugaaaaaucugcuuaacuccacgagccuggagacaucccucucuauugaggcuccuuggggagccaucaauguucagagcaccuuuaagcccacaguguccaccgcuaacauugcccugagcuggucuuccaucgaacaccgcggcaauaaaauucuggugagcgggagaucugagagcaucaugaaacuugaggaacggaccggcaucuccugggaucugggagucgaagacgccucugagagccgccuccugacaguguccguuauggaucucucucaaauguacagcccuguguucgaguaccuguccggcgacagacaggucgaagaguggcccaaggcuacgugcaccggggauuguccugaacggugcggauguacaagcucuaccugccuucauaaagaguggccgcacucccgcaacuggagaugcaaucccacaugguguuggggcguggggaccggaugcacguguugcggccuggacguuaaggaccucuuuacagauuauauguucgugaaauggaaggucgaauacauuaaaaccgaggcgaucguguguguugagcugaccagccaggaacggcagugcucccugauugaggccggcacaagauuuaaccuugggccugugaccaucacacugucugaaccccgcaacauucaacagaagcucccucccgagaucauuacgcugcauccgcggaucgaagagggauucuuugaccucaugcacguccagaaggugcugagcgcuuccaccguguguaaacuucagucuugcacacacggcgucccuggggaucugcaaguuuaucauaucggaaaucugcucaagggcgacaaagugaacgggcaccugauucauaagaucgagccccacuucaauaccagcuggauguccugggauggaugugaccuugauuacuauugcaacaugggcgacuggcccagcuguacauacaccggcgugacgcagcauaaucacgccgccuuugucaaccugcucaauauugaaaccgauuauacaaagaacuuccacuuucauucuaagagagugaccgcucacggggacacaccucagcuggaucucaaggcccgccccaccuacggagcgggcgagaucacaguucugguggaagucgcugacauggagcuucauacgaaaaagauugagaucuccgggcugaaauucgccagccugaccugcacaggaugcuacgccuguucuuccggcaucagcugcaaggugcggauucacguugaugaaccugacgagcucaccgugcacgucaaaucugaagacccggauaucguggcugccagcuccucucugauggcgagaaaacuugaguucgggaccgacagcacauuuaaggcuuucuccgccaugcccaagacgagccuguguuuuuauauugucgaacgcgaguacugcaaguccuguucucgggaggauacccagaaaugcgugagcacaaagcucgaacaaccucaguccauccugauugagcauaaaggaaccaucaucggcaagcagaauaacacauguaccacgaaaacaaccugcuggcucgaaucuguuaagagcuucuuuuauggccugaagaauaugcuuuccucuauuuucgggaacguguuugucggaaucuucagcuuucuggcccccuucauucugcucauccuguuuuucauguucggcuggcgcauucuguuuuguuucaaaugcugucgccggaccagagggcuuuuuaaguaccggcaccucaaagacgaugaggaaacaggauaucgcagaaucauugagcggcugaauaacaagaaaggcaaguccaagcuccuggacggggagcgccuugcugauagaaaaaucgccgaacuguucagcaccaagacacauaucggauga

SEQ ID NO: 13602 - RNA, 5067 nt, Artificial Sequence
  derived and/or modified CDS sequence (opt5) from CCHFV(Kosova Hoti)__EU037902.1__GP
augcccaucaacauuaugcacacccugcucgugugcuucauccuguaccuucagcugcucggccugggaggagcccauggccaaagcaaugcuacagagcacaacgggacgaauaccacaaccgccccuggaacaucccagucuccgaagcccccugcgagcaccacacccucccaugcuccugaacccucuaccauuaaacuuacgaccccuacaagcgagaccgaaggcuccggggagacaaccccgcccacgaacacaacccaggacucuccuccccuggaaacaaccccugagagaagcgccaccacagccacguccaccagcggaacagauaauaugaacucuaccacacagaugaccgacaauacgcccacauccaccgucagcaccucucucuccagcucuccguccacaccuagcaccucccaaggcaugcaccaucccguucggucucugcugagcguguccagcccuaagacagcuacgacccccacacccaugucuccuggcgagauguccagcgaaaccucuagccagcacuccgccaugucucgcacaccgacgccccacaccgcuacccaggugagcacagagaacgccaauagauccaccagccggcagucugaauccagcgcgcaaccugccacacagucucccgucaccuccccugcucagagcauccuccugauguccgccacgcccacaaccauucagaacauccauccgucuccuacaaaucgcagcaaaagaaaccuugagauggagaucauucugacccucucccaagggcugaagaaauauuacggaaagauccuuaagcugcuccaccugacccuggaagaggauacagaaggccuccuggagugguguaaacggaaucuugggucuaacugcgacgaugacuuuuuccagaagcgcauugaagaguuuuucaucacgggagagggcuauuuuaaugaagugcugcaguucaaaacccucagcacacccuccagcaccgagccuucucaugcuagacugcccacagccgaaccuuuuaaguccuacuucgcgaaaggguuucuuagcauugauucuggauauuucuccgccaaguguuacccccggagcucuaccagcggccugcaacucaucaacguuacgcagcacccggcucgcauugccgagacaccuggccccaagaccaccucccugaaaacaaucaacugcaucaaucugagagcuagcguguuuaaggaacaccgggaggucgagauuaacgugcuccugccccagaucgccguuaaucuuucuaacugucauguggucauuaauucccacgugugcgacuauagccuggauaccgacgggccugugcgccucccgagaaucuaccaugaaggaacauucaugcccggcacguacaaaauugucaucgaucggaagaacaaacugaaugaccgcuguacccuuguuacaaacugcgugaucaaggggagagaggugcggaaaggacaguccguccugagacaauauaagaccgaaauuaagaucggcaaagccccuacagggucucgcaagcuccugagcgaggaacccggagaugacuguauuucccggacccagcugcucagaacggagaccgcugagauccacgacgauaauuacggcggcccuggggacaaaauuacaaucugcaacggaucuaccaucguggaucagcgccugggcagcgaacuuggguguuauacaauuaaucggguuaaguccuuuaaacugugcgagaacucugcgaccggaaagacaugcgaaaucgacagcacccccgugaaguguagacagggcuucugccucaaaauuacgcaaaaggggcgcggccaugucaaacugucccggggaagcgaggugguucuggaugccugugacucuaauugcgaggugaugaucccuaagggcacaggggauauucuugucgacuguuccggaggccagcagcacuuccucaaagauaaccugaucgaccuggggugcccccacauuccgcuccugggaaagauggcuaucuacaucuguagaaugagcaaucauccuaagaccaccauggccuuucuuuucugguuuucuuucggcuaugugauuacaugcaucuuuuguaaagcccuguucuacucccucauuaucauugggacccugggcaagaaaaucaagcaguaucgcgaacugaaaccccaaacgugcacaaucugugagaccgcuccugucaacgccauugaugcggaaaugcacgaccuuaacugcagcuacaauaucugccccuacugugcuucucggcucacauccgacggacuggccagacaugugaagcagugcccgaagcgcaaagagaagguugaagagaccgagcuguaucucaaccuggaacggauuccuuggguggucagaaaacuucuccaggugagcgaguccacaggcguugcccugaagcggagcucuuggcugaucgugcugcuuguccuccugaccgugagccugucccccgugcagucugcuccuguugggcacggaaaaacgauugaaaccuaccaaacacgcgagggcuuuaccagcaucugucucuucaugcugggguccauccuuuuuauugucucuugccuggugaagggacucguggauagcgucuccgacucuuucuuucccggccugagcguguguaaaacaugcuccaucgggagcauuaauggcuucgaaaucgagucucacaaguguuauugcucccuguuuuguugccccuacuguagacauugcagcgccgaucgggagauucaccagcuucaucucaacaucugcaagaaaagaaagaccggaucuaauguuaugcuggcuguguguaaacgcaugugcuuccgggccacgaucgaagcguccagacgcgcccugcucauuagaagcaucauuaacacaaccuucgucaucuguauucugacacuuaccaucugcgugguuuccaccucugcuguggagauggaaaaucugccugccggcacaugggagcgggaagaggaccucacgaacuuuugucaccaggagugccaagucaccgaaacagagugucugugcccguaugaagcucuggugcuucgcaagccccuguuccucgauagcauuguuaaagggaugaagaaucugcucaacuccaccagccuggagacaucucuuuccaucgaggccccuuggggagcgaucaaugugcagagcaccuuuaagcccacggucucuacagccaacauugcucugagcugguccucuguggaacauagaggcaauaaaauccucgugaccgggcggagcgaguccauuaugaagcuggaggaacgcaccggaaucucuugggaccugggcgucgaagaugccagcgaguccaaacuucugacaguuagcauuauggaccucucucagauguacuccccuguguucgaguaucugagcggggauagacagguggaagaguggcccaaggcuaccuguacaggcgacugcccucaacgguguggaugcacguccucuaccugccuccacaaagaauggccgcacagccgcaacuggagauguaaucccacauggugcuggggcgucgggaccggauguacaugcuguggcguggauguuaaggaccuguuuaccgaucauauguucgugaaguggaaagucgaguacaucaagacggaagccaucgugugcguugagcuuaccucccaggagcggcaguguucucugauugaagccgggacacgcuuuaaccucggaccugugaccaucacacugagcgagcccagaaacauucagcaaaaacugccucccgaaaucauuacccuucacccgaagaucgaggaaggcuucuuugaccugaugcauguccagaaagugcucuccgcuagcacaguuugcaagcugcagucuuguacgcacggcaucccuggggaccuccagguguaccauauuggaaaucugcuuaagggcgaucgggucaacgggcaccugauccacaaaauugagccccauuucaauaccuccuggaugagcugggacggaugcgaucuggacuauuacuguaacaugggcgauuggcccucuugcacauauaccggggugacccaacacaaucaugcggccuuugugaaccuccugaauaucgagacagacuacacgaagaccuuccacuuucacuccaaaagagucacagcucauggagauaccccucagcuugaccugaaggcccgccccacauauggcgccggcgaaauuaccguucucguggagguggcugauauggaacugcacacgaaaaaggucgagaucagcgggcucaaauucgccucucuggcgugcacaggauguuacgcuugcagcuccggcauuucuuguaaggugcggauccauguugacgagccugaugaacuuaccgugcacgucaagagcuccgacccggaugugguugccgccgggaccagccugauggcuagaaaacuggaguucggaacagacuccaccuuuaaggccuucucugcgaugcccaaaacaagccucugcuuuuauaucguggaaaaggaguacuguaaauccugcucugaagacgauaccaagaagugugucgacacgaaacuggagcagccucaaagcauucuuaucgagcaucgcggcacaauuaucgggaagcagaacgauaccugcacagcuaaagccuccuguuggcuggaaucugucaagagcuucuuuuacggacucaaaaauaugcugggcuccguguucggcaacuuuuucauugggauccuccuguuucuugcccccuucgugcugcugguucucuuuuucauguucggauggaagauccuguuuugcuucaaguguugccggagaacccgcggccuuuuuaaauaucggcaccugaaggacgaugaggaaacgggguacagacgcauuaucgagcggcucaauaacaaaaaggggaaaaauagacugcucgacggcgaacggcuggcugaucgcaagauugccgagcuuuucagcaccaagacacacaucggguga

SEQ ID NO: 13603 - RNA, 5067 nt, Artificial Sequence
  derived and/or modified CDS sequence (opt5) from CCHFV(Turkey200310849)__DQ211636.1__GP
augcccaccaacaucaugcacacacugcucgugugcuucauucuguaccuucagcugcucugucugggcggggcccauggacaacuuaauacgaccgagcacaacggcacaaauaacaccacagcuccuggggccagccaguccccgaagcccccuaugucuaccacacccccucaugcgcccgaaagcuccaccaucaaaccuacgaccccgauuucugaggcugaaggaagcggcgagacaaccuccacacccaauaccacgcaggggcugucuagcccugaaacaaccuccgagagacccgccacaaccgccaucagcaccucuuccacagacagcacgaacccuaccacacagaugaccgauaauacacccacccucacggucucuacauccccgucuagcuccccuagcacccccuccaccccucaaggaauuuaucaccccgcucggucucugcugagcguuuccagccccaagacagugaccacaccuacgccgaccucucccggcgagauguccagcgaaacaucuagccagcauuccgccaugucucgcaucccuacaccccacacagcuaccagagugagcacggagaacaccaaucacuccacaccucggcagagcgaaucuuccgcccagcaaaccacacccagcccgaugaccucuccugcgcaguccauccuccugaugagcgccgcucccacggccguccaggacauucauccuucccccacaaaccgcucuaaaagaaaucuugagaccgagaucauucugacacucagccagggccugaagaaauacuaugggaagauccuuaagcugcuccaccugacccuggaagaggauaccgaaggacuccuggaguggugcaaacggaaccuuggcuccaauugugacgaugacuuuuuccaaaagcgcauugaagaguuuuucaugacaggggagggauacuuuaacgaagugcugcaguucaaaacgcucucuacccugagcccuacagagcccucccaugcuagacuuccgaccgccgaaccuuuuaagagcuauuucgcgaaaggcuuucugucuaucgauuccggguacuucagcgccaagugcuauccccggucuuccgcuagcggacuccagcugauuaauguuacacaacaccccgcccgcaucgcugagaccccuggcccgaagacgacaucucugaaaaccaucaacuguauuaaccucagagccagcguguuuaaggaacaccgggagaucgagauuaauguccugcuuccccagaucgccgugaaccuguccaauugccauguugugauuaacagccacgucugugacuacucucucgauaccgacggcccugugcgccugcccagaaucuaccaugaagggacauucaucccuggaaccuauaaaauugugaucgauaagaaaaauaaacuuaacgaccggugcacacuggucacgaauuguguuauuaagggccgcgaggugagaaaggggcaguccgugcuccggcaguacaagaccgaaaucaaaauuggaaaggcuagcacaggcuuuagaaaacugcuguccgaggaacccggggaugacugcaucucucgcacccaacuccugcggacagagaccgcggagauccacgacgauaacuauggaggcccuggcgacaagauuacgaucuguaaugggagcaccauugucgaucagagacuuggauccgaacugggcugcuacacaaucaaccgcgugaaaucuuucaagcucugcgagaauagcgccaccgggaagacaugugaaguugacuccacccccgugaaaugccggcagggauucugucugaagauuacacaggagggcagagggcaugucaaacugucucgcggcagcgaggugguucuugaugcuugcgacuccagcugugaagugaugaucccgaagggaaccggcgauauucucgucgacugcucugggggacaacagcacuuucugaaagauaaccugaucgaccucggcuguccucacaucccccugcuugggaagauggccauuuauaucugccggauguccaaucauccuagaacgacaauggccuuccuguuuugguucagcuuuggauacgugauuaccuguaucucuugcaaggcucucuucuauucccugauuaucaucggcacccuggggaaaaagauuaaacaguaccgcgagcuuaagccccagacauguaccaucugcgaaacggccccggucaacgcgauugaugcugagaugcacgaccucaauugcagcuacaacaucuguccuuauugcgccucucggcugacauccgacggccuggccagacaugugacccaaugucccaaacgcaaggaaaagguugaggagacagaacucuaccugaaccuugagcggauuccuuggaucgugagaaaacugcuccaggucagcgaauccaccggaguggcucugaagcggagcucuuggcugaucguucuucucgugcugcugacagucagccucucccccgugcagucugcccccgugggccacgggaaaaccauugagaucuaucagacgcgcgaaggauuugcuagcauuugccuguucaugcuuggcuccauccuguuuauuguuucuugucucgucaaggggcugguggauagcguguccgacucuuucuuuccuggacugagcgucugcaaaaccuguuccaucggcagcgugaauggguucgagaucgagucucacaagugcuacuguucccucuuuugcuguccguauugcagacauugcagcgccgaucgggaaauucaccaacuccaucugucuaucuguaaaaagagaaagacaggcuccaacguuaugcuggcggugugcaaacgcauguguuuccgggccaccauugaggcuagcagacgcgcccuccugaucagauccauuaucaauacaaccuucgucauuugcauccuuacgcugacaaucugugugguuucuaccagcgcuguggaaauggagaaccuccccgccggaacaugggaacgggaggaggaccugaccaauuuuugccaccaggaaugucaggucaccgagacagaaugccuguguccuuacgaggcgcuugugcugcgcaagccccucuuccuggauuccauuguuaaaggcaugaagaaccuccugaauagcacgucucuugagaccucccugagcaucgaagccccuuggggagcuauuaacgugcaaucuacauuuaaacccgccgucagcaccgcuaauaucgcccucuccuggucuagcguggagcauagagggaacaagauucuggugacaggccgguccgaaucuaucaugaagcuggaggaacgcaccggggucagcugggaccuuggaguugaggaugccuccgagagcaaacugcucacggugucuaucauggaccugucccagauguauagcccuguguucgaauaccucuccggcgauagacaggucgaggaauggccgaaggcuacaugcaccggggacugucccgagcggugcggcugcaccucuagcacaugucugcacaaagaauggccucacucccgcaauuggagaugcaaccccaccugguguuggggagugggcacagggugcacguguugcggaguugaugugaaggaccuuuuuaccgaucauauguucgucaaauggaagguggaguacauuaagacagaggcgaucguuuguguggaacugaccucucaggagcggcaaugcagccucauugaagccggcacacgcuuuaaucuggggccugucaccaucacgcuguccgagcccagaaacauucagcagaaacuuccgccugaaaucaucacccugcaccccaagauugaggagggauucuuugaccucaugcaugugcagaaaguucugagcgcuucuacaguguguaagcuccaauccugcacccacggcauccccggcgaccugcaggucuaucauauugggaaucuucugaaaggagaucgggugaacggccaccugauccacaagauugaaagccauuucaacacaucuuggauguccugggacgggugugaucucgacuacuauugcaauaugggagauuggccuagcugcaccuacacaggcgugacgcagcacaaccaugccgccuuugucaaucugcuuaacaucgagaccgacuauacaaagaccuuccacuuucacucuaaaagaguuaccgcucauggggauacaccccagcuggaccucaaggcccgcccuacguacggagcgggcgaaauuaccgugcugguggaggucgcugauauggagcuccacaccaaaaagguggaaaucagcggccugaaauucgccucccuugccuguaccgggugcuaugcuuguucuagcggaaucuccugcaagguucggauucauguggacgagccggaugaacugacaguccacgugaaaagcuccgaccccgauguuguggccgcgucuaccagccugauggcuagaaagcucgaguucggcacggacuccacauuuaaggccuucucugccaugccuaaaaccagccuguguuuuuacaucgucgaacgcgaguacugcaaguccuguucugaggacgauacccaaaaaugcguggacacacggcuugaacagccccagagcauucugaucgagcauaaggggaccauuaucggaaaacaaaaugauacauguaccgcuaaggccuccugcuggcucgaaagcgucaagucuuucuuuuauggccugaaaaacaugcucggguccguguucggaaaucuguuuaucggcauucuucuguuccuggcuccuuuuguucuccuggugcuuuucuuuauguucggcuggaagauccuguucuguuuuaaaugcugcagacgcacgcgggggcuuuucaaguacagacaccugaaagacgaugaggaaacaggauaucgccggauuaucgagagacucaacagcaagaagggcaaaaaucggcugcuugacggggaucgccuggccgacagaaagauugcggagcuguuuucuaccaaaacacacaucggauga

SEQ ID NO: 13604 - RNA, 5067 nt, Artificial Sequence
  derived and/or modified CDS sequence (opt5) from CCHFV(Kashmanov)__DQ211631.1__GP
augcccaccaacaucaugcacacacugcucgugugcuucauucuguaccuucagcugcucggccuugggggagcccauggccaaagcaaugcuacggagcacaacgggaccaauacaaccacagccccuuccaccucucagagcccgaagccccuugucuccacagcgccuccccaugcucuggaaucuagcaccaucaaaccuacgacccccgccuccgagacagaaggaucuggcgagaccacaccuccgcccaacaccacgcaggggccuagcccucccgaaacaacccccgagagaccggccacaaccgcuaccuccacaccuagcacggacaauaccaacucuacaacccacguuacagauaauaaccccaccuccacgauuagcacaucuccuuccagcucucccuccacccccagcaccccucagggaauccaucacccggcccggaaucuccuguccgugucuagccccaagacagcuaccacaccuacgcccaccuccccuggcgagauuagcucugaagccuccagccugcacucugcgaugagccgcacauccacccucuauacagccacccaagugucuacggagaacgcuaaucauagcgcccccagacaguccgaaagcucugcucagccgaccacaaccuccccuaugacaagccccgcccagucuauccuggucauguccgcggccccuaucgcuauucaaaacauccaccccagcccuaccaaucgguccaaacgcaaccuugagauggagauuauccugacgcucucucagggccugaagaaauacuaugggaagauucuuaagcugcuccaucugacacuggaagaggacaccgaaggacuccuggagugguguaaaagaaaucuuggcagcaacugcgaugacgacuuuuuccagaagcggaucgaagaguuuuucaugacaggggagggauacuuuaacgaagugcugcaguucaaaacccucuccacccugucucccacagagccgagccacgccggcccucccacgguugaacccuuuaaguccuauuucgcuaaaggguuucuuagcauugauucuggauacuucuccgccaaguguuauccucgcagcucuaccuccggccugcaacucaucaaugugacacagcacccggccagaaucgcugagacccccggcccuaagacaaccagccugaaaacgauuaacugcaucaaucugcgggcgucugucuuuaaggaacaucgcgagauugagaucaacgugcuccugccccagauugccguuaaucuuagcaacugucacguggucaucaauucccaugugugcgauuacagccuggacacagaugggccugugagacucccccacaucuaccaugaaggaaccuucauuccuggcaccuauaaaaucgucauugacaagaaaaacaagcugaaugaucgguguacacuuguuaccaacugcgugaucaaagggcgcgaggugagaaagggacaaucuguccugcggcaguacaagacagaaauuaaaaucggcaaggcuuccacggggagccgcaaacuccuguccgaggaacccggagacgauuguaucucuagaacccagcugcuccggacagagaccgccgagauucacgacgacaauuauggcggcccgggggauaagaucacaauuugcaacggaagcaccaucguggaccagagacugggcuccgaacuuggguguuacacgauuaaucgcguuaaaucuuuuaagcugugcgagaacagcgccaccggaaagacaugcgaaaucgauuccaccccugugaaaugucggcaaggcuucugccucaagauuacacaggaggggagaggccacgucaaacugucucgcggaagcgaggugguucuggacgcuugugauuccagcugcgaagugaugauccccaagggcaccggggacauccuugucgauuguucuggaggccagcagcauuuccucaaagacaaucugauugaucuggggugcccucacaucccccuccugggaaagauggccauuuauaucugucggauguccaaccauccgagaacaaccauggcguuucuuuucugguuuagcuucggcuacgugauuacgugcaucuuuuguaaggcucuguucuauucucucaucauuaucgggacacugggcaaaaagauuaaacaauaccgcgagcugaagccucagaccugcaccaucugugaaacagcccccgucaacgccauugacgcugagaugcacgaucuuaauugcuccuacaacaucugcccuuauugugccagccggcucaccucugacggacuggcuagacacgugccccagugccccaaacgcaaggaaaagguugaggagacggaacuguaccucaaucuggagcggaucccuuggauugugagaaaacuucugcaggucuccgaaagcacaggcguggcccucaagcgcuccagcuggcugaucguucugcuugugcuccugaccgucucucugagcccggugcaauccgcgcccguggggcauggaaaaacaauugagaccuaucagacacgggaaggcuuuaccucuaucugucucuucaugcuggggagcauucuuuuucugguuuccugccucgucaagggacugguggacucugugagcgauuccuucuuuccuggccugucugucuguaaaacgugcaccaucgggagcaucaacggcuucgagauugagucccacaaguguuacugcagccuguuuuguugccccuauuguagacauugcucugccgaccgggaaauccaccagcuccaucuguccauuugcaaaaagcgcaagacaggaagcaaugugaugcuggcuguuuguaaaagaaugugcuuccgggccaccaucgaggcuucuagacgcgcccuccugauucgguccaucauuaacacaaccuucgugaucuguauccuuacgcugacaauuugcgucgugagcaccuccgcgguugaaauggagaaucucccuucuggcacaugggaaagagaggaggaucugaccaacuuuugucaccaggaaugccaagugaccgagacagaaugucugugccccuacgaggcccuuguccugcgcaagccucucuuccuggacagcaucgugaaagggaugaagaauagccucaacagcacgucucuggagaccucccuuagcauugaagcuccguggggagccaucaauguucagucuacauuuaaacccaccgugagcacagcuaacauugcccuguccuggucuagcgucgagcacagaggcaauaagauccucgugaccgggcgguccgaaucuaucaugaagcuggaggaacgcacgggagugagcugggaucugggcgucgaggacgccuccgagagcaaacuucugacaguuucuauuauggaucucucccagauguauagcccuguguucgaauaccuguccggggacagacaaguggaggaauggcccaaggcuaccuguaccggcgauugcccugagcgguguggaugcacaucuagcacaugccuccauaaagaauggccccacucccgcaacuggagauguaauccgaccuggugcuggggcgucgggacgggauguaccugcuguggcguggacguuaaggaucuguuuacagaccauauguucgugaaauggaaggucgaguacaucaagaccgaggcgauugugugcguugaacuuacaucucaggagcggcaguguagccugaucgaagccgggacccgcuuuaaccucggaccugugacgauuacccuguccgagcccagaaacauccagcaaaaacugcccccugaaaucauuacacuucaccccaaggucgaggagggcuucuuugaucugaugcaugugcagaaaguucucagcgcuucuaccgugugcaagcugcaguccuguacacacggcaucccuggggaccuccaggucuaucacauuggaaaucugcuuaaaggcgaccggaucaacgggcaucugauucacaagaucgaaccgcauuucaauaccagcuggaugucuugggauggaugcgaccuggauuacuauuguaacaugggcgacuggcccuccugcacauacacgggggugacccaacacaaucacgccgccuuugugaaccuccugaauauugagacagauuauaccaagaccuuccauuuucacagcaaacgcgucacagcucauggagacacgccucagcuugaucugaaggccagacccaccuacggcgcgggcgaaaucacaguucucguggagguggcugacauggagcugcacaccaaaaaggucgaaaucucugggcucaaauucgccagccuggccugcacaggauguuaugcuugcuccucuggcauuagcuguaaggugcggauccauguugaugagccugacgaacuuaccgugcacgucaaauccagcgaucccgacgugguugccgcguccacgucucugauggcuagaaagcuggaguucgggacagauagcaccuuuaaggccuucuccgccaugccgaaaaccucucucugcuuuuacauuguggaacgcgaguacuguaagagcugcuccgaggaagacacacagaaaugugucgacaccaagcuggagcagccucaaucuauccuuauugaacacaaaggaacaaucaucggcaagcagaacgauaccugcacggcuaaggccagcuguuggcuggaguccgugaaauccuucuuuuaugggcucaagaauaugcugggaucugucuucggcaacuuuuucauuggcauccuccuguuucuugcucccuucgugcugcugguucucuuuuucauguucggguggaaaauucuguuuugcuucaaguguugccggagaacacgcggacuucugaaauaccggcaucucaaggacgaugaagagaccggcuauagacgcaucauugagcggcugaauaacaagaaagggaagaauagacuccuggacggagaacgccuugccgaucggaaaaucgcggagcuguuuuccacaaagacccacaucggcuga

SEQ ID NO: 13605 - RNA, 5067 nt, Artificial Sequence
  derived and/or modified CDS sequence (opt5) from CCHFV(Drosdov)__DQ211630.1__GP
augcccaucaacauuaugcacgcccugcucgugugcuucauccuguaccuucagcugagcggccucgggggagcucauagacaauccaaugccaccgagcacaacggcacaaauacgaccacagcgccugggaccucucagagcccgaagcccccugucuccacaacccugccccauacaccugaagccucuaccauuaaacuuacgacccccacaagcgagaccgaaggauccggcgagacaaccccuccgcccaacacgacacaggggcugccucuccccggaaccacaccugaacggucugccaccaccgccacaagcacguccagcaccgacgauaugaacucuacaacccagaugacagacaauacccccacguccacaguuagcaucggccugucuuccagcccgucuaugccuuccaccagccaaggcauucacuaucccgugcgcucccugcucucugugagcuccccuaagaccgcuacaacccccacacccaugagcccuggggaggucucuccggagacguccagccagcauucugccaugagcagaauccccacccuguacacagcuacccagguguccacagaaaauaccaaccggucuaucccucgccagagcgaguccagcguucaacccgccacgcagucuccuauuaccucccccgcgcagacaauccuucugaugagcgccgcuccgaccgccauucaggauaugcacccuucucccaaaaauagauccaagcggaaccucgaaguggagaucauucugacacuuagccaaggacugaaaaaguauuacggcaagauccucaaacugcugcaccucacccuggaggaagacacggaggggcuucuggaaugguguaagcgcaaucucggauccaacugcgaugacgacuuuuuccagaaaagaauugaggaauuuuucaucacaggcgagggguauuuuaaugagguccugcaguucaagaccccuucuacacuuagccccaccgaaccuucccaugugcggcugcccaccgcugagccguuuaaaucuuacuucgccaagggauuucucagcaucgauuccggcuauuucagcgcgaaguguuacccuagaucuuccacaagcggccugcaacugauuaacguuacgcagcaccccgcccgcaucgcugaaacccccgggccuaaaacaaccucucucaagacaauuaauugcaucaaccugcgggccuccguguuuaaagagcaucgcgaagucgagauuaacgugcuucugccgcagaucgcugugaaucucagcaacugucacgucguuaucaauucucacgugugcgauuacagccuggacaccgauggacccgugagacuuccucggauucaucacgagggcgccuucauccccgggacguauaagauugucaucgacaaaaagaacaaacugaaugaucgcuguucccucgugacaaacugcguuauuaagggaagagaagugcggaagggccagagcguccugagacaauacaaaaccgagaucaagaucgggaaagccucuaccggaucccgcaagcugcucagcgaggaaccuggcgacgacuguauuucccggacacagcugcuuaaaaccgaaacagcugagauccaugaugacaauuauggcgggcccggagauaagauuacgaucugcaacggcucuaccauuguggaccagagacuggggagcgagcucggauguuacacaaucaaucgcguuaaguccuuuaaacugugcgaaaacucugcgaccggcaagacaugcgagauugauagcaccccugugaaaugucggcagggguucugccugaagaucacgcaagaaggcagaggacacgucaaacuuucccgcggcucugaggugguccucgacgccugugauagcuccugcgaggugaugauccccaaggggaccggagacauucugguugauuguagcggcgggcagcagcauuuccugaaggacaaucucaucgaucugggaugcccgcacauuccucuucugggcaaaauggcuaucuauauuugucggaugucuaaccaccccagaacaaccauggccuuucucuucugguuuuccuucggguacgugaucacaugcaucuuuuguaaggcccuguucuauagccugauuaucauuggcacccuugggaaaaagaucaaacaguaccgcgaacucaagccucaaacaugcaccauuugugagacggcucccgucaaugccaucgacgcggaaaugcaugaccugaagugcucuuacaacaucugcccguauugugcuucccggcugacaagcgauggccucgccagacacgugacccagugcccuaaacgcaaggagaaaguugaagagaccgagcuguaccuuaaucuggaacggauucccuggaucgugagaaagcuccugcaggucucugaguccacagggguggcccugaaacggagcuccuggcuuauugugcuccugguucugcucaccgucagccugucuccugugcagagcgcucccgugggacauggcaagacgaucgaaacauaucaaacccgcgagggguuuacauccauuugucuuuucaugcugggaucuauccucuuuaucgucagcugccuggugaaaggccugguugacuccgugucugauagcuucuuucccgggcuuuccgucuguaagaccugcucuauuggcagcaucaacggauucgaaauugagucccacaaguguuacugcagccucuuuuguugcccuuauuguagacacuacucugccgaccgggagauccaucagcugcaccuguccauuugcaaaaagagaaaaacaggcagcaacgugaugcucgcuguuugcaagcgcauguguuucaaagccaccaucgaagcgucucggagagcccugcuuauucgcuccaucaucaauacgaccuucgugauuugcauccugauucucgcuaucugugucgugagcacauccgccguugagauggaaaaccugccggcugggaccugggagagagaagaggaucugacaaauuuuugccaucaggagugucaagugaccgaaacggagugccuuugucccuaugaagcccugguccuccggaagccucuguuccucgacucuacagugaagggaaugaaaaaccugcuuaauagcaccucccuggagacaagccucucuauugaggcgcccuggggcgccaucaacgugcaguccaccuuuaagccuaccgucagcacagcuaauaucgcccugucuuggagcuccguugaacaccgcgggaacaaaauucuggugacgggaagaucugagagcaucaugaaacuugaggaacggaccggcguguccugggaucugggggucgaagacgcuucugagagcaagcuccugacaguguccauuauggaucucagccagauguacucucccguuuucgaguaccuguccggcgaccgccagguggaagaguggccuaaggcuaccugcacaggagauuguccggaaagaugcggcuguaccagcuccacgugccuucauaaggaguggccccacucucggaauuggcgcugcaacccuacaugguguuggggagucggaaccggcugcaccuguugcgggguggacguuaaagaucuguuuacagaccacauguucgugaaguggaaagucgaauauaugaagaccgaggccaucguguguguugagcucacaagccaagaaagacagugcucccugauugaggcuggaacgcgguuuaaucugggccccgugaccaucacacuuucugaaccucgcaacauccagcagaaacugcccccggagauuaucacccuccauccuaagauugaagagggcuucuuugaccugaugcacguccaaaaggugcucagcgcguccacaguguguaaacugcagagcugcacccaugggauccccggagaucuucagauuuaccacaucggcaaucugcugaagggggacagagucaacggacaucucauucacaaaaucgagccccacuucaauacgucuuggauguccugggauggcugugaccuggauuauuacugcaacauggggaacuggccuagcuguaccuauacaggaguuacccagcauaaucacgccgcuuuugugaaccuucugaauaucgaaacagacuacaccaagacauuccauuuucacucuaaacgggugacggcccacggcgauacaccccaacucgaccugaaggccagaccuaccuauggcgcuggggagauuaccguccucguggaaguugccgauauggagcugcauaccaaaaagguggagaucuccggacuuaaguucgcgagccuggucugcacaggcugcuacgcuuguucuagcgggauuuccugcaaagugcgcauccacguugacgaaccggaugagcugacggugcaugucaagucuagcgaccccgauguggucgccgccuccaccagccucauggcucggaaacuggaauuuggaacagacuccauuuuuaaggccuucucugcgaugccuaaaaccagccuuuguuuuuacaucguggagagagaauauugcaaguccuguucugaggacgauacaaagaaaugcguugacaccaagcuggagcagccccagagcauccucauugaacacaaaggcacgaucauugggaagcaaaacgauacauguaccgcuaaagccuccugcuggcuggagucugucaagagcuucuuuuacggacucaagaauaugcugggcuccguguucggcaacuuuuucguggggauccuucuguuucuggccccuuucguucuccuggugcuuuucuucauguucggauggaaaauucuguuuuguuucaagugcugucgccggaccagaggccucuuuaaauaucgccaucugaaggacgaugaagagacaggguaccggagaaucaucgaacgccucaauagcaaaaagggaaagaaccggcugcuugacggcgagagacuggcugaucggaaaauugccgagcuguucucuaccaagacacacaucggguga

SEQ ID NO: 13606 - RNA, 5067 nt, Artificial Sequence
  derived and/or modified CDS sequence (opt5) from CCHFV(1231-CR/TI-2015)__KU161585.1__GP
augcccaucaacauuaugcacacccugcucgugugcuucauccuguaccuucagcugcucggccuugggggagcccaugagcaaagcaaugcuacagaccacaacagaacgaauaccauuacagccccuuccaccucucagaacccgaagcccccugcgagcacaaccccgccucauacacccgaauccucuaccaucaaacuuauuacgagcaccggcgaggcugaaggguccggagagacaaccccuccgcugaauacaacccagggccccuuuccucccgaaacgacaucugagcacccugccagcaccgccacaaacaccuccagcaccaauucuaugaacuccacaacgcagaugaccgauaagacacucaccagcacagucucuaccucccugagcaucucucccuccacgccgagcacaucccaagggauccauuauccuauucggucucugcucagcguuuccagcccccgcaccgcugccaccccuacacccaugucuaccagagagauguccagcgaaacaaauucucagcacagcgcugugucccggacgcccaccuuccacacagccacccaggugucuacagagaacgacaaucgcagcaccccuagacaguccgaaagcucugcgcaaccggccacgcagucccccaugaccagcccugcucagucuauccugcuugucuccgccgcucccacaaccauucagaacauccauccuagccccacaaaucgguccaaacgcaaccuggagauggagauuauccucacccugccgcaaggacuuaagaaauacuauggcaagauucugaagcuccugcaccugacgcucgaagaggauacagaaggccugcuugagugguguaaaagaaaucuggggucuaacugcgacgaugaauuuuuccagaagcggaucgaggaguuuuucaucaccggagaaggcuacuuuaacgaggugcuccaguucaaaacacugagcacccuuuccccuauggaacccucucaugcccgcccucccaccgcggagccuuuuaagagcuauuucgccaaaggguuucuguccauugacagcggauacuucucugcuaaguguuaucccagauccucuagcuccggccuccaacugaucaauauuacacagcacccggcccggaucgcugaaacgccugggcccaagaccacaagccugaaaaccauuaacugcaucaaucuccgcgccucuguuuuuaaggagcacagagagguggaaaucaacguccugcuuccccagauugccgugaaucugagcaacugucauguugugaucaauucccacgucugcgauuacagccucgacacagauggaccugugcggcugccgcgcauuuaccaugagggcaccuucauccccggcacguauaaaauugugaucgacaagaaaaacaaacuuaaugauagauguacacuggucaccaacugcguuaccaaggggcgggaagugagaaagggacagucugugcuccgccaauacaagacagagaucaaaauuggcaaggcuuccaccgggagccggaaacugcuguccgaggaaccuggagacgauuguaucucuagaacacagcuccugcgcacggagaccgcggaaauucacgacgacaauuauggcgggcccggagauaagaucacaauuugcaacggcagcaccaucgucgaccagcggcuuggcuccgagcugggguguuacacaauuaauagagugaaaucuuucaagcucugcgaaaacagcgccaccggaaagacgugcgagaucgauuccaccccuguuaaaugucgccagggcuuuugccugaagaucacacaagaggggcggggacaugugaaacugucuagaggcagcgaagucgugcuugacgcuugugauuccagcugcgagguuaugauucccaaggggaccggcgacauccucguggauuguucuggaggccagcagcacuuccugaaagacaaucugauugaucucgggugcccucacaucccccugcuuggaaagauggccauuuauaucugucgcauguccaaccauccgcggacaaccauggccuuucuguucugguuuagcuucggcuacgucaucacaugcaucuuuuguaaggcucucuucuauucucugauuauuaucgggacccuggggaaaaagauuaaacaguacagagaacuuaagccucaaacgugcacaaucugugagaccgcccccgugaacgcgaucgacgcugaaaugcacgaucucaauugcuccuacaacauuugcccuuauugugccagccgccugaccucugacggccuggcccggcaugucacacagugccccaaaagaaaggagaagguggaggaaaccgagcucuaccugaaucuugaacggaucccguggauuguucgcaaacugcuccagguguccgagagcacgggggucgcucugaagagauccagcuggcugaucgugcuucucguucugcugacagugucucucagcccuguccaguccgcccccgugggccacggaaaaaccauugaaacauaucaaacccgggagggcuuuacaucuaucugucuguucaugcuugggagcauccuguuuauuguguccugccucguuaagggacuggucgagucugugagcgacuccuucuuuccuggccugucuguguguagaaccugcagcaucggguccauuaacggauucgaaaucgagagccacaaauguuacugcucucuuuucuguugccccuauugucgccauugcuccgcugaucgggaaauucaccagcuccaucugagcaucugcaagaaaagaaagacgggcucuaaugucaugcuggccguguguaagcgcaugugcuuuagagcgaccauggaggccucccggcgcgcucuccugauuagaagcaucaucaacacaaccuucguuauuuguauccuuacacugaccauuugcguggucuccacgucugccguggaaauggagaaucuccccgcugggacaugggagcgggaagaggaccugaccaacuuuugucaccaggaaugccaaguuacagagaccgagugucugugcccuuacgaagcccuugugcugcgcaaaccccucuuccuggauagcaucgucaagggcaugaaaaaucuccugaacuccaccagccuugagacaucucuguccauugaagcgcccuggggagccaucaaugugcagagcacguuuaagccuaccguuucuacagcuaacaucgcccucagcugguccucuguggagcauagaggcaauaaaauucuggucaccgggcggagcgaauccaucaugaagcuggaggagcgcacaggagugucuugggaccuuggcguggaagaugcuagcgaguccaagcugcucaccgucagcauuauggaccugucucagauguauucccccguuuucgaauaccucagcggggauagacagguggaggaauggccuaaagccacguguacaggagacugccccgagcgguguggcugcaccuccucuaccugccugcacaaggaguggccucacagccgcaacuggagauguaauccgacauggugcuggggagugggcaccggauguacaugcuguggcgucgaugugaaagaccuuuuuacggaucauauguucguuaaguggaaaguggaauacaucaagaccgaggccauugucugcguggaacugacaucccaagagcggcaguguucucucaucgaagcugggaccagauuuaaccugggacccguuacaaucacccugagcgagccucgcaacauucagcagaaacuucccccugagaucauuacgcugcaccccaagaucgaagagggcuucuuugaccucaugcaugugcaaaagguccuguccgcgagcaccgugugcaaacuccagucuuguacacacgggauuccgggagaucugcagguuuaucauaucggcaaucuucugaagggcgaccgggugaacgggcaccugauucacaaaaucgaaccucauuucaauaccuccuggaugagcugggacggaugcgaucucgacuacuauuguaacaugggcgauuggcccucuugcacauacaccggggucacacagcacaaucaugccgcuuuugugaaccugcuuaauaucgagacggacuauaccaagacauuccacuuccacuccaagagagugaccgcccauggagauacaccccaacuggaccucaaagcccgcccuaccuacggcgcuggggagauuacgguccugguugaaguggccgauauggagcuccacaccaagaaaguggaaaucagcggacugaaguuugcgucucuugcuugcacaggcuguuaugccugcagcuccggcauuucuuguaaaguccggauccauguggacgagcccgaugaacugaccguucacgucaagagcuccgacccugaugugguggccgcuagcacaucccugauggccagaaaacucgaguucgggaccgacucuacguuuaaggcguucagcgcuaugccgaagacaucccugugcuuuuacauuguugagcgcgaauacuguaaaucuugcagcgaggaugacaccaagaaauguguggacaccaaacuugaacagccccaguccauccugaucgagcauaagggaacaauuaucggcaagcaaaacgauaccugcacagccaaggccucuuguuggcucgaaagcgucaaauccuucuuuuaugggcugaagaauaugcucggaagcguguucggcaacuuuuucauugggauccugcuuuuucuggcuccuuucguccugcucgugcuguucuuuauguucggauggaaaauucuguuuugcuucaaguguugccggagaacccgcggccuguuuaaauaccggcaccucaaggacgaugaggagacgggcuauagacggaucaucgaacgccugaauaacaagaaagggaagaauagacuccuggacggagagcggcuugccgaucgcaaaauugcugaacuguucucuacaaagacccacaucggcuga

SEQ ID NO: 13607 - RNA, 5067 nt, Artificial Sequence
  derived and/or modified CDS sequence (opt5) from CCHFV(1-CR/HU-2015)__KU161584.1__GP
augcccaucaacauuaugcacacccugcucgugugcuucauccuguaccuucagcugcucggccuugggggagcccaugagcaaagcaaugcuacagaccacaacagaacgaauaccauuacagccccuuccaccucucagaacccgaagcccccugcgagcacaacacccccucauacccccgaauccucuaccaucaaacuuauuacgagcaccggcgaggcugaaggguccggagagacaaccccuccgcugaauacaacccagggccccuuuccucccgaaacgacaucugagcacccugccagcaccgccacaaacaccuccagcaccaauucuaugaacuccacaacgcagaugaccgauaauacacucaccagcacagucucuaccucccugagcaucucucccuccacgccgagcacaucccaagggauccauuauccuguucggucucugcucagcguguccagccccaagaccgcugccaccccuacacccaugucuacccgcgagauguccagcgaaacaucuagccagcacuccgcuaugucuagaacgcccaccuuccacacagccacccaggugagcacagagaacgcgaaucgguccaccccucgccagagcgaaucuuccgcccaaccggcuacgcagagccccaugaccucuccugcccaguccauuuuucuggucagcgcugcccccacaaccauccagaacauucauccuucccccacaaauagaucuaaacggaaccuugagauggagaucauucugacccucccgcaaggacugaagaaauacuauggcaagauccuuaagcugcuccaccugacgcuggaagaggacacagaaggccuccuggagugguguaaacgcaaucuugggagcaacugcgaugacgaguucuuucagaagagaauugaagaguucuuuaucaccggagaaggcuacuucaacgaggugcugcaguuuaaaacacucuccacccugucuccuaccgaacccagccaugcgcggccucccacagccgagccuuucaaguccuauuuugcuaaaggguuccuuagcaucgauucuggauacuuuuccgccaaguguuauccccgcagcucuacguccggccugcaacucauuaauaucacccagcacccggcuagaauugccgaaacaccugggcccaagaccacaagccugaaaaccaucaacugcauuaaucugcgggccucuguuuucaaggagcaccgcgagguggaaaucaacguccuccugccccagaucgcugugaaucuuagcaacugucauguugugauuaauucccacgucugcgacuacagccuggauacggacggaccugugagacucccgcggaucuaccaugagggcacauucauucccggcaccuauaaaaucgugauugauaagaaaaacaagcugaaugaccgcuguacccuugucacaaacugcguuaucaaagggagagaagugcggaagggacagucugugcugagacaauacaagaccgagaucaaaauuggcaaggcguccacagggagccgcaaacuccuguccgaggaaccuggagaugacuguaucucucggacgcagcugcucagaaccgagacagccgaaauucacgaugacaauuauggcgggcccggagacaagaucaccauuugcaacggcagcacaaucgucgaucagcgccugggcuccgagcuuggguguuacaccauuaaucgggugaaaucuuuuaagcugugcgaaaacagcgcuacgggaaagaccugcgagaucgacuccacaccuguuaaauguagacagggcuucugccucaagaucacccaagaggggcgcggacaugugaaacugucucggggcagcgaagucgugcuggaugccugugacuccagcugcgagguuaugauucccaaggggacaggcgauauccuuguggacuguucuggaggccagcagcacuuucucaaagauaaucugauugaccuggggugcccucacaucccccuccugggaaagauggccauuuauaucuguagaauguccaaccauccgcgcaccacaauggcuuuccuguuuugguucagcuuuggcuacgucauuaccugcaucuucuguaaggcccuguuuuauucucucaucauuaucgggacgcuggggaaaaagauuaaacaguaccgggaacugaagccucaaacaugcaccaucugugagaccgcgcccgugaacgcuaucgaugccgaaaugcacgaccuuaauugcuccuacaacauuugcccuuauugugccagcagacucacaucugauggccuggcucgccaugucacccagugccccaaacggaaggagaagguggaggaaacggagcuguaccucaaucuggaaagaaucccguggauuguucggaaacuucuucagguguccgagagcacaggggucgcccucaagcgcuccagcuggcugaucgugcugcuuguucuccugaccgugucucugagcccuguccaguccgcucccgugggccacggaaaaacaauugaaaccuaucaaacaagagagggcuucaccucuaucugucucuuuaugcuggggagcauccuuuucauuguguccugccugguuaagggacucgucgacucugugagcgacuccuuuuucccuggccugucugugugucggacgugcagcaucggguccauuaacggauucgagaucgaaagccacaaauguuacugcucucuguuuuguugccccuauuguagacauugcuccgccgaucgcgagauucaccagcuucaucucagcaucugcaagaaacggaagaccggcucuaaugucaugcuggcgguguguaagagaaugugcuuccgcgccacaauggaggcuuccagacgggcccugcucauucgcagcaucaucaacaccacauuuguuauuuguauccugacccuuacgauuugcguggucuccacaucugcuguggaaauggaaaaucugcccgccgggaccugggagagagaggaagaccucacaaacuucugucaccaggagugccaaguuaccgaaaccgagugucugugcccuuacgaggcgcuggugcuucggaaaccgcuguuucucgauagcaucgucaagggcaugaaaaaucugcucaacuccacaagccuggaaacgucucuuuccauugaggcccccuggggagcuaucaaugugcagagcaccuucaagccuacaguuucuaccgccaacaucgcucugagcugguccucuguggaacaucgcggcaauaaaauucucgucacagggagaagcgaguccaucaugaagcuggaggaacggaccggagugucuugggaccugggcguggaggaugccagcgaauccaaacuucugacggucagcauuauggaccucucucagauguauucccccguuuuugaguaccugagcggggaucgccagguggaagaguggccuaaggccacauguaccggagacugccccgaaagauguggcugcaccuccucuacaugccuccacaaggaguggccucacagccggaacuggcgcuguaauccgaccuggugcuggggagugggcacaggauguacgugcuguggcgucgaugugaaagaccuguucaccgaucauauguuuguuaaguggaaaguggaguacaucaagacagaagcuauugucugcguggagcuuaccucccaagaaagacaguguucucugaucgaggcggggacacgguucaaccucggacccguuaccaucacgcugagcgaaccuagaaacauucagcagaagcugcccccugagaucauuacccuucaccccaaaaucgaggaaggcuuuuucgaccugaugcaugugcaaaagguccucuccgccagcacagugugcaaacugcagucuuguacccacgggauuccgggagaucuccagguuuaucauaucggcaaucugcuuaagggcgaccgcgugaacgggcaccugauucacaaaaucgagccucauuuuaauacauccuggaugagcugggacggaugcgaucuggacuacuauuguaacaugggcgauuggcccucuugcaccuacacaggggucacgcagcacaaucaugcugccuucgugaaccuccugaauaucgaaaccgacuauacaaagaccuuccacuuucacuccaagcgggugaccgcccauggagauacaccccaacuugaccugaaagcuagaccuacguacggcgccggggagauuaccguccucguugagguggcggauauggaacugcacacaaagaaaguggagaucagcggacucaaguucgcuucucuggccugcaccggcuguuaugccugcagcuccggcauuucuuguaaaguccgcauccauguggacgaacccgaugagcuuacaguucacgucaagagcuccgacccugaugugguggcugccagcaccucccugauggcgcggaaacuggaauuugggacggacucuacauucaaggcuuuuagcgccaugccgaagaccucccucugcuucuacauuguugagagagaguacuguaaaucuugcagcgaagaugacaccaagaaauguguggacacaaagcuggagcagccccaguccauccuuaucgaacauaaaggaaccauuaucggcaagcaaaacgauacaugcaccgccaaggcuucuuguuggcuggagagcgucaaauccuuuuucuaugggcucaagaauaugcugggaagcguguuuggcaacuucuuuauugggauccuccuguuccuugccccuuucguccugcuggugcucuuuuucauguuuggauggaaaauucuguucugcuuuaaguguugccgccggacgagaggccuuuucaaauaccgccaccugaaggacgaugaagagacaggcuaucggagaaucaucgagcggcucaauaacaagaaagggaagaaucgccugcucgacggagaaagacuggcugaucggaaaauugccgagcuguuuucuaccaagacacacaucggcuga

SEQ ID NO: 13608 - RNA, 5067 nt, Artificial Sequence
  derived and/or modified CDS sequence (opt5) from CCHFV(V42/81)__GU477490.1__GP
augcccaccaacacaaugcacacgcugcucgugugcuucauccuguaccuucagcugcucggccuugggggagcccauguccaaccuaaugcuaccgagcacaacagaacaaauaccacaaccgccccgggcacaagccauucccuuaagccccugguuucuaccacgccuccccaggcgccugaaagcuccaccauuaaacccacaaccccuacaucugagaccgaagggagcggagaggcuacgccgcucuccaacacaauccaggcccccucuagcccugaaaccacauccgagcggcccgccaccgcugugauuagcaccucuggcacagacuccacgaauagcaccacacagaccacagauaacaauccuaccacgacaguggggaccucucccuccagcucuccguccaccccuagcacaccccaaggaauccaccaucacgcccgcucccugcugucugucaccagcccugagacagugacgacccccaagcccacauccccuagagaaaugagcucugagaccuccaaccagcacagcgcuaugucucggacaccgacccaucacacgguuacccaggugagcacagaaaauaccucccauucuacaccccgccagccugagagcuccgcccaacccaccuccucuuccccuaugacgagccccgcgcagucuacacuccugauguccgccgcuccgaccgccguccagagcauucacccuucccccacaaacagaucuaaacggaaucuugagaccgaaaucauccugacccucagccagggccugaagaaauauuacggcaagauucuuaagcugcuccaccugacacuggaggaagacacggaggggcuccuggaaugguguaaacgcaaccuuggauccaauugcgaugacgacuuuuuccaaaagagaaucgaggaguuuuucaugaccggcgaaggguauuuuaacgaggugcugcaguucaaaacaccuucuaccguuagccccacagaaccuucccaugcucggcuccccaccgccgagccguuuaagagcuacuucgcgaaaggauuucugucuauugacuccggcuauuucagcgccaaguguuacucucgcuccagcacgucugggcuucagcugaucaaugugacacaacacccugcuagaauugccgaaacccccggacccaagaccacaagccucaaaaccaucaacugcauuaaccugcgggcuuccgucuuuaaggagaaucgcgagaucgaaaucagcgugcugcucccucagauugccgugaaccugucuaauugucaugucguuaucaacucccacgugugcgauuauagccuugacacagauggcccggugagacugccccggauuaaucaugagggcacguucaucccugggaccuacaaaauugucaucgacaagaaaaacaagcucaaugaucgcuguacacuggugaccaacugcguuaucaaaggaagagaagugcggaagggccaguccguccuuagacaguacaagacagagauuaaaaucgggaaggccucuaccggaagccgcaaacugcucuccaaggaacccggcgacgauuguauuucucggacgcaacugaugagaaccgagacagcugagauccacgacgacaauuaugggggaccuggcgauaaaauuaccaucugcaacggcagcacaaucguggaccagcgccugggguccgaacucggauguuacaccauuaaucggguuaagucuuuuaagcugugcgagaacagcgcgacaggcaaagccugcgaaguggauuccacccccgucaaguguagacagggguucugccuuaaaaucacgcaggagggacgcggccacgugaagcugagccgggggucugaggucgugcucgacgcuugugauuccagcugcgaaguuaugauuccuaaaggcacaggagacauccugguggauuguucuggcgggcaacagcauuuccugaaggacaaucuuauugaucucgagugcccccacaucccgcugcugggaaagcucgccauuuauaucuguagaauguccaaccauccucgcaccaccauggccuuucuguucugguuuggcuucggguacgucaucacaugcauucuuuguaaagcucuguuuuauagccucaucauuaucggaacccugggcaagaaaauuaagcaguaccgggaacugaaaccccagacgugcacaaucugugagaccgccccugugaaugcgaucgacgcugaaaugcacgaucuuaacugcucuuauaacauuugccccuacugugccuccagacucacaagcgacgggcuggcccgccacguuacccaaugcccgaagcggaaggagaaaguggaggaaacagagcuguaccucaaucuggaaagaaucccuuggauuguccggaagcugcuccagguguccgagagcaccggcgugguucugaaacgcucuagcuggcugaucguccugcuugugcuccugacggugucccugucucccguccagagcgcuccugugggacauggcaagaccauugaaacauaucagaccagagagggguucacauccaucugucucuuuaugcugggaucuauccuuuucauuguuagcugcaucgugaaaggccuggucgacuccgugucugauagcuuuuuccccgggcucuccguuuguaagaccugcagcauuucuuccaucaacggauuugagauugaaagccacaaauguuacugcucucuguucuguugccccuauugucggcauugcuccgccgacagagagauccaccaacugcaucuuagcaucugccgcaagcggagaacgggcuccaaugugaugcucgcugucuguaagcgcaugugcuuuagagccacaauugaagugucucggcgcgcgcugcugaucagaagcauuaucaacaccacauucguuauuuguauccucacccugaccauuugcguggucuccacaagcgccguggagauggaaaaucuuccugcugggacgugggagcgggaggaagaucugaccaacuucugucaccaggagugccaggugacagaaaccgagugucucugcccguacgaggcccugguccugcgcaaaccccuuuuucuggacucuaucguuaagggcaaaaagaaucuccugaacuccacaagccucgaaaccucucugagcaucgaggcuccuuggggagccauuaauauccaauccacguucaaacccacagugucugcggccaacauugcucuuagcugguccucuguggaacacagaggcaauaagauccuggucagcgggcgguccgagagcauuaugaagcucgaggaacgcaccggagugucuuggaaccugggcguugaggaugccuccgaaagcaaacugcuuaccguguccaucauggaccugucucagauguauagcccugucuuugaguaccucuccggggauagacagguggaagaguggcccaaggcuacauguaccggagacugcccugaacgguguggcugcacaucuagcacgugccugcauaaagaguggccgcacucccgcaauuggagauguaaccccaccuggugcuggggcguugggacaggauguaccugcuguggcguggaugucaaggaccucuucaucgaucauauguuugugaaauggaagguugaguauauuaagacagaagccaucgugugcgucgagcugaccagccaggaacggcaauguucucuuauugaggccgggacgagauucaaucugggaccugugaccaucacacucuccgaaccccgcaacauucagcagaaacugccucccgagaucaucacccugcacccgaagauugaggaaggcuuuuucgaccuuaugcaugugcagaaaguccugagcgcuucuacaguuugcaagcuccaauccuguacccacgggaucccuggagaucuccagguguaccacauuggcaaccugcugaaaggcgaccgggugaaugggcaucuuauccacaagauugagccccauuuuaacacaagcuggaugucuugggacggaugcgaucuggacuacuauuguaauaugggcgauuggcccagcugcacguacaccggggucacacagcacaaccacgcggccuucgugaaucugcucaacaucgaaaccgacuauaccaagacauuucauuuccacuccaaaagaguuacggcucauggagagaccccucagcuggaucuuaaggcccgccccgccuacggcgcuggggagauuacagugcuggucgaaguggccgacauggagcuccacaccaaaaagguugaaaucucuggacugaaauuugcgagccucgcuugcacaggcuguuaugccugcuccagcggcaucuccuguaaggugcggauucaugucgaugagccugacgaacugaccgugcacgucaaaucuaaugauccggacgugguugccgcuagcacgucccuuauggccagaaagcuggagucugggacagauagcaccuucaaggcguucuccgcuaugcccaaaaccucucugugcuuuuacaucguggagcgcgaauauuguaagagcugcuccgaggacgauacacaaaaaugugucgaaaccaagcucgagcagccucagagcauucugaucgaacacaaaggaacaauuaucggcaagcaaaacgauaccugcacggccaaggccucuuguuggcuugaguccgugaaaucuuucuuuuacgggcugaagaauaugcucggaagcguuuucggcaacuuuuucaucgggauucugcucuuucuggcucccuucgugcuucugguccuguuuuucauguuuggauggaaaauccucuucugcuucaaguguugccggagaacacgcggccuguuuaaauaccggcaucuuaaggaggacgaagagaccggcuauagacggauuaucgaacgccugaauagcaagaaagggaagaacagacuccuggauggagagcggcucgccgaccgcaaaauugcugaacuguucagcacaaagacccacaucggcuga

SEQ ID NO: 13609 - RNA, 5067 nt, Artificial Sequence
  derived and/or modified CDS sequence (opt5) from CCHFV(ROS/HUVLV-100)__DQ206448.1__GP
augcccaccaacaucaugcacacacugcucgugugcuucauucuguaccuucagcugcucggccuugggggagcccauagacaaagcaaugcuacggagcacaacggcaccaauacaaccacagccccuuccaccucucagagcccgaagccccuugucuccacagcgccuccccaugcucuggaaucuagcaccaucaaaccuacgacccccguuuccgagacagaagggucuggagagaccacaccuccgcccaacaccacgcagggcccuagcccucccgaagccacacccgagcggccgaccacaaccgccaccuccacaccuagcacggacaauaccaacucuacaacccacgugacagauaauaaccccaccuccacgauuagcacaucuccuuccagcucucccuccacccccagcaccccucaggggauccaucacccggcucgcaaucuccuguccgugucuagccccaagacagccaccacaccuacgcccaccuccccuggagagauuagcucugaaacauccagccugcacucugcuaugagcagaaccuccacacucuauaccgccacgcaagucucuaccgagaacgcgaaucauagcgcuccccggcaguccgaaagcucugcccagcagacaaccacauccccgaugaccagcccugcccaaucuauccuggugauguccgcugcccccacggcgauccagaacauucacccuagccccacaaaucgcuccaaaagaaaccuugagauggagaucauucugacccucucucagggccugaagaaauacuauggcaagauccuuaagcugcuccaucugacacuggaagaggacaccgaagggcuccuggagugguguaaacggaaucuuggaagcaacugcgaugacgacuuuuuccagaagcgcauugaagaguuuuucaugaccggcgagggguacuuuaacgaaguucugcaauucaaaacacucuccacgcugucuccuaccgagcccagccacgccagaccgccuacaguggaacccuuuaaguccuauuucgcuaaaggauuucuuagcaucgauucuggcuacuucuccgccaaguguuauccccggcugagcaccucugggcuccagcugauuaaugucacacagcacccugcucgcaucgccgagaccccgggacccaagacgacaucccugaaaaccaucaacugcauuaaucucagagccagcguguuuaaggaacaucgggagaucgagauuaacguucugcuuccucaaaucgcugugaaucugucuaacugucacgucgugauuaauagccaugugugcgauuacucccucgacaccgauggccccguccgccugccucacaucuaccaugaaggcacauucauccccgggaccuauaaaauuguuaucgacaagaaaaacaaacuuaaugauagauguacacuggugacgaacugcgugauuaagggacgggagguccgcaagggccagagcgugcucagacaguacaagaccgaaaucaaaauugggaaggcgucuacaggaucccggaaacugcugagcgaggaaccuggcgacgauuguaucuccagaacccagcuccugcgcacagagaccgccgagauccacgacgacaauuaugggggacccggcgauaagauuacgaucugcaacggcucuaccauuguugaccaacggcuugggagcgaacugggauguuacacaaucaauagagugaaauccuuuaagcucugcgagaacucugcuaccggcaagacaugcgaaauugauagcaccccggucaaaugucgccagggguucugccugaagaucacacaggagggacggggccacgugaaacuguccagagggucugagguugugcuugacgccugugauagcuccugcgaagucaugauuccuaagggcaccggagacauccucguggauuguagcggcgggcagcaacauuuccugaaagacaaucugaucgaucucggaugcccccacauuccucugcuuggcaagauggccaucuauauuugucgcaugucuaaccauccccggacgacaauggcuuuucuguucugguuuuccuucggguacgucauuaccugcaucuuuuguaaggcccucuucuauagccugaucaucauuggaacccugggcaaaaagaucaaacaguacagagagcuuaagccgcagacaugcaccauuugugaaacggcgccugugaacgcuaucgacgccgagaugcacgaucucaauugcucuuacaacauuugccccuauugugccucccgccugacaagcgacgggcuggcucggcacguuccucagugccccaaaagaaaggaaaagguggaggagaccgaacucuaccugaaucuugagcgcauccccuggaucguccggaaacugcuccaagugucugaauccacaggcguugcccugaagagaagcuccuggcugauugugcuucucguccugcugaccgugagccucucuccugugcagagcgcuccgguuggacauggcaaaacaaucgagaccuaucagacgcgggaaggguuuaccuccauuugucuguucaugcuuggaucuauccuguuucucgucagcugccuggugaagggccugguggacuccgucucugauagcuucuuucccgggcuuuccguguguaaaacaugcucuauuggaagcaucaacggcuucgagaucgagucccacaaguguuacugcagccucuuuuguugcccuuauugucgccauugcucugccgacagagaaauucaccagcugcaucuguccaucugcaaaaagcggaagaccgggagcaauguuaugcucgcgguguguaaaagaaugugcuuccgcgccacaauugaggcuucucggagagcccugcuuauccgcuccauuaucaacaccacguucgucauuuguauccugacacucaccaucugcgugguuagcacauccgcuguggaaauggagaaucugcccucuggcaccugggaaagagaggaggaucugaccaacuuuugucaccaagaaugccaggucacagagacggaaugucuuugcccuuacgaggcccuggugcuccggaagccccuguuccucgacagcauuguuaaaggaaugaagaaucugcuuaacuccaccagccuggagacaucucucuccaucgaagcgccuuggggcgccauuaaugugcagagcaccuuuaaaccgacagucucuaccgcuaacaucgcccugagcugguccucuguggagcaccgcgggaauaagauucuggugacgggaagaagcgaauccaucaugaaacuugaggaacggacaggcgucucuugggaucuggggguugaggacgcuagcgaguccaagcuccugaccgugagcaucauggaucucucucaaauguauucccccguguucgaauaccugagcggagaccgccaggucgaggaauggccuaaggccaccuguacaggcgauugccccgagagaugugggugcaccuccucuacaugccuucauaaagaauggccucacagccggaacuggcgcuguaaucccacguggugcuggggcgugggaaccggcuguacaugcugugggguugacgugaaggaucuguuuaccgaccauauguucgucaaauggaagguggaguacauuaagacagaggccaucguuugcguggaacucaccucccaggagagacaguguucucugauugaagcuggaacgcgguuuaaccugggcccggucaccaucacacuuagcgagccucgcaacauucaacagaaacugccucccgaaaucaucacccuccaccccaagguggaggagggguucuuugaucugaugcauguucagaaagugcucuccgcgagcacagucugcaagcugcagucuuguacccacggcauucccggagaccuucaaguguaucacaucggcaaucugcugaaaggggacagagugaacggacaucucauucacaagaucgaaccucauuucaauacauccuggaugagcugggauggcugcgaccuggauuacuauuguaacaugggggacuggccgucuugcacguacaccggagucacacagcacaaucacgccgcuuuuguuaaccuucugaauauugagaccgauuauaccaagacauuccauuuucacuccaaacgggugacggcccauggcgacacaccccagcucgaucugaaggccagaccuacauacggggcuggagaaaucaccgugcucgucgagguggccgacauggagcugcacaccaaaaagguugaaauuagcggccuuaaauucgcgucucuggcuugcaccggcuguuaugccugcagcuccgggaucucuuguaaggugcgcauccaugucgaugagcccgacgaacugacggugcacguuaaaagcuccgauccugacguggucgccgcuagcacaucccucauggcccggaagcuggaguucggaaccgauucuaccuuuaaggcguucagcgcuaugcccaaaacaucccuuugcuuuuacauuguggaaagagaguacuguaagucuugcagcgaggaagacacccagaaaugugucgacacaaagcuggagcaaccgcaguccauccucauugaacacaaaggcaccaucauugggaagcagaacgauacgugcacagccaaggccucuuguuggcuggagagcgugaaauccuucuuuuauggacucaagaauaugcugggcagcguuuucgggaacuuuuucaucggaauccuucuguuucuggcuccuuucgugcuccugguccuguuuuucauguucggcuggaaaauucuguuuugcuucaaguguugccgccggaccagaggccuccugaaauaccgccuccugaaggacgaugaagagacaggguaucggagaaucauugagcgccuuaauaacaagaaaggaaagaaucggcugcuggacggcgaaagacucgccgaucggaaaaucgcugagcuguuuucuaccaagacgcauauuggguga

SEQ ID NO: 13610 - RNA, 5067 nt, Artificial Sequence
  derived and/or modified CDS sequence (opt5) from CCHFV(5180-R-2011)__KR814874.1__GP
augcccaccaacaucaugcacacacugcucgugugcuucauucuguaccuucagcugcucggccugggaggagcccauagacaaagcaaugcuacggagcacaacggcaccaauacaaccacagccccuuccaccucucagagcccgaagcccccugucuccacagcgcccccuuaugcucccgaaucuagcaccaucaaaccuacgaccccggccuccgagacagaagggucuggagagaccacacccccucccaacaccacgcagggcccuagcccgcccgaagccacaccugagcggcccgcuaccacagccaccuccaccccuagcacagacaauacgaacucuaccacacaugcuaccgauaauaaccccacauccaccauuagcacgucucccuccagcucuccuuccacaccgagcacaccccaggggauccaccauccugcccgcaaucuucuguccguuucuagccccaagaccgcgaccaccccuacacccacguccccgggagacauuagcucugagaccuccagccuccacucugccaugagcagaacaccuacccugcacacagcuacccaagccuccacggaaaacgcuaaucauucugcgccccggcagagcgaguccagcgcccagcagaccacaaccucuccuaugacaucccccgcccaaccuauccuggugaugagcgcugcccccaccgcuauccagaacauucacccgucuccuacgaaucgcuccaaaagaaaccucgaaauggagaucauucugacacuuagccagggccugaagaaauacuauggcaagauccucaagcugcuucaucugacccucgaggaagauacagaggggcugcuggaaugguguaaacggaaucucggauccaacugcgacgaugacuuuuuccagaagcgcauugaggaauuuuucaugaccggcgagggguacuuuaacgaggugcugcaauucaaaacccuuucuacacugagccccacggaacccucccacgccagaccuccgaccgucgagcccuuuaagucuuauuucgccaaaggauuucucagcaucgauuccggcuacuucagcgcuaaguguuauccucggcugucuacauccgggcuucagcugauuaaugugacccagcaccccgcgcgcaucgccgaaacaccuggacccaagaccacgagccucaaaacaaucaacugcauuaaucugagagcuucuguuuuuaaggagcaucgggaaaucgagauuaacgugcugcucccucaaaucgccgucaaucuguccaacugucacgugguuauuaauagccaugugugcgacuacucucuugauaccgacggccccguccgccugccgcacaucuaccaugagggcaccuucaucccugggacauauaaaauugugaucgauaagaaaaacaagcucaaugacagauguacccuggugacaaacugcgucauuaaaggacgggaaauccgcaagggccagagcguucuuagacaguacaagacggagauuaaaaucgggaaggccuccaccggaagccggaaacugcucucugaggaacccggcgaugacuguaucuccagaacacagcugcugcgcaccgaaacagcugagauucacgacgauaauuaugggggaccuggcgacaagaucaccauuugcaacggcagcacgaucguggaucaacggcucggguccgagcugggauguuacaccauuaauagagugaaaucuuuuaaacuuugcgaaaacagcgccacaggcaagaccugcgagaucgacuccacacccgucaaaugucgccagggguucugccugaagauuacccaggaaggacggggccacgugaaacucucuagagggagcgagguugugcuggaugcgugugacacauccugcgaggucaugaucccgaagggcaccggagauauccugguggacuguucuggcgggcagcaacauuuccuuaaagauaaucucauugaccugggaugcccucacaucccccugcucggcaagauggcuauuuauaucugucgcaugagcaaccauccucggacgacaauggccuuucuguucugguuuuccuucggguacguuauuaccugcaucuuuuguaaggcccuuuucuauagccugaucauuaucggaacccucggcaaaaagauuaaacaguacagagaacugaagccccagacaugcaccaucugugagacggcucccgugaacgccauugaugcugaaaugcacgaccugaauugcucuuacaacaucugcccuuauugugccucccgccuuacaagcgacgggcucgcgcggcacgucccgcagugccccaaaagaaaggagaagguggaagagaccgagcuguaccugaaucucgaacgcaucccuuggauuguccggaaacugcuucaagugucugaguccacaggcguugcccugaagagaagcucuuggcucaucgugcugcugguccuucucaccgugucccugagccccguucaguccgcuccugugggacauggcaaaacaauugaaaccuaucagacgcgggagggguuuaccagcgucugucuguucaugcucggaucuauccuguuucuugugagcugccuggugaagggccucguugauuccgucucugacagcuucuuucccgggcuguccguguguaaaacaugcucuauuggaagcaucaacggcuucgaaaucgagucccacaaguguuacugcucucuguuuuguugcccuuauugucgccauugcagcgccgauagagagauucaccagcuucaucucuccaucugcaaaaagcggaagauggggagcaaugugaugcuggcugucuguaaaagaaugugcuuccgcgccaccauugaagcgucucggagagcccugcucauccgcuccauuaucaacacaaccuucgugauuuguauccugacgcuuacaaucugcguugugagcaccucugcugucgagauggaaaaucugccguccggcacaugggagagagaagaggaccucaccaacuuuugucaccaagagugccaggugaccgaaacagagugucugugccccuacgaagcccugguucuucggaagccucuguuccucgauagcauugugaaaggaaugaagaaucugcucaacuccacgucucuggagaccagccuuuccaucgaggcucccuggggcgccauuaauguccagagcacauuuaaaccuaccgugucuacagccaacaucgcucuguccuggagcucuguugaacaccgcgggaauaagauucucgugaccggaagaagcgaguccaucaugaagcuggaggaacggacgggcgucucuugggaccuggggguggaagaugcgagcgaguccaaacuucugacagugucuaucauggaccucagccaaauguauucccccgucuucgaguaccugagcggagaucgccagguugaagaguggccgaaggccaccuguaccggcgacugcccugaaagaugugggugcacaucuuccacaugccuccauaaagaguggccccacagccggaacuggcgcuguaaucccaccuggugcuggggcgugggaacgggcuguaccugcugugggguggaugucaaggaccuguuuacagaucauauguucgugaaauggaagguugaauacauuaagaccgaggcuaucgugugcgucgagcuuacaucccaggaaagacaguguucucugauugaggccggaacccgguuuaaccucggcccugugacgaucacccugagcgaaccccgcaacauucaacagaaacugccuccggagaucaucacacuucaccccaagguugaagagggguucuuugaccugaugcaugugcagaaaguccucuccgccucuaccgugugcaagcugcagagcuguacacacgggauuccuggcgaccuccaaguuuaucacaucggcaaucugcuuaaaggggauagagugaacggacaucugauucacaagaucgagccccauuucaauaccuccuggaugagcugggacggcugcgaucuggacuacuauuguaacaugggggauuggccuucuugcacauacacgggagucacccagcacaaucacgcugccuuugugaaccuccugaauauugaaacagacuauaccaagaccuuccauuuucacuccaaacgggugacagcgcauggcgauacgccccagcuugaccugaaggcuagaccgaccuacggggccggagagaucacaguccucguugaaguggccgauauggagcugcacaccaaaaagguggagauuagcggccucaaauucgcuucucuggccugcacaggcuguuaugcgugcuccagcgggaucucuuguaagguccgcauccauguggacgaaccugaugagcuuaccguucacgugaaaagcaacgaccccgaugucguggcugccuccacgucucugauggcccggaagcuggaauuuggaacagacagcaccuuuaaggcuuucuccgccaugccuaaaaccagccucugcuuuuacauuguugagagagaauacuguaaguccugcucugaggaggacacacagaaauguguggauaccaagcuggaacaaccccagagcauccuuauugagcacaaaggcacaaucauugggaagcagaaugauaccugcacggcuaaggccuccuguuggcuggaaucugucaagagcuucuuuuauggacucaagaacaugcugggcuccguguucgggaauuucuucaucggaauccuccuguuucuugcgccuuucguccugcuggugcucuuuuucauguucggcuggaaaauucuguuuugcuucaaguguugccgccggacaagaggccuucugaaauaccgccuccugaaggacgacgaggaaaccggguaucggagaaucauugagcgccucaacaauaagaaaggaaagaaccggcugcuugauggcgagagacuggccgaccggaaaaucgcugaacuguuuucuacaaagacccauauuggguga

SEQ ID NO: 13611 - RNA, 5067 nt, Artificial Sequence
  derived and/or modified CDS sequence (opt5) from CCHFV(5170-R-2011)__KR814873.1__GP
augcccuucaacaucaugcacacccugcucgugugcuuuauucuguaccuucagcugagcggccucgggggagcccauggccaauccaaugagacagaacacaacgggacgaauaccacaaccgucccuggaacaucucagagcccgaagcccccugcuuccaccacacugcagcauacccccgagucuagcacgguuaaacuuaccacaccuaccuccgaaacagagggcucuggggaaaccacgcccccuccgaacacaacccagggacugcccccucccggcacaaccccugagagaagcgccaccacagcgacguccaccagcucuacagacaauaugaacuccaccacacaagugaccgauaauacgcccacaagcaccgugucuaucuccccguccucuuccccuagcaugcccuccaccucucagggcauucacuauccuauccggagccuccuguccgucagcucucccaagacagugaccacacccacgccuauuuccccgggggagaugagccccgaaaccucuagccagcauuccgcuaugucucgcaucccuacacuguacaccgccacacagguuagcaccgagaacacgaauagauccacaccccggcaaagcgaaucuuccgugcagccugccacccagagccccaucaccucuccggcucagacaauucuccugauguccgccgcuccuaaagccauccaagacaugcaccccagcccuaccaaccgcuccaagagaaaucuugaggucgagauuauccugacgcucucucagggacugaaaaaguauuacggcaagauucuuaaacugcuccaccugacacuggaagaggauaccgaagggcuccuggagugguguaagcggaaccuuggaagcaauugcgacgaugacuucuuucagaaacgcaucgaagaguucuuuauuacaggcgagggguauuucaacgaagugcugcaauuuaagacccucuccacccugucucccacagagcuuagccauguuagacugccuacggcggaacccuucaaauccuacuuugccaagggauuccucagcaucgauucuggcuauuuuuccgcuaaguguuacccgcggagcucuaccuccggccugcagcugaucaaugugacacagcacccugcccgcauugcugagacccccgggcccaaaacaaccagccucaagacgaucaacugcauuaaccugagagccucugucuucaaagaacaucgggagguggagaucaaugugcuucugccucagauugcggucaaccucagcaauugucacguugugaucaacucccacgugugcgacuacagccuggauacagacggaccgguccgccuucccagaauccaucacgaaggcaccuuuauuccugggaccuauaagaucgugauugauaaaaagaauaaacugaacgaccgguguucucucguuacaaauugcgugaucaagggacgcgaggucagaaagggccaauccgugcugcggcaguacaaaaccgaaauuaagaucgggaaagccagcacaggauccagaaagcugcucucugaggaacccggcgaugacuguaucagccgcacgcagcugcuuaaaaccgagacagcugagauucaugacgauaacuauggcgggccuggagacaagaucaccauuugcaauggcuccacaaucguugaucagcggcuggggucugaacucggauguuacaccauuaacagagucaagagcuucaaacugugcgagaauagcgccacgggcaagaccugcgaaaucgacucuacacccgugaaaugucgccaaggguucugccugaagauuacccaggagggccggggacacgugaaacuuagcagaggcuccgaggucgugcucgauguuugugacagcucuugcgaaaucaugaucccuaaggggacaggagauauucugguggacuguuccggcgggcagcagcauuuucugaaggauaaccucaucgaccugggaugcccccacauuccgcuucugggcaaaauggcuaucuauauuugucgcaugagcaaucacccucggaccacaauggccuuccucuuuugguucucuuuuggguacgucauuaccugcaucuucuguaaggcccuguuuuauucccugaucaucauuggcacgcuugggaaaaagaucaaacaauacagagagcucaagccccagacaugcaccauuugugaaaccgcuccugugaacgcgaucgaugccgagaugcaugaccugaauugcagcuacaacaucugccccuauugugcuucucgccugacauccgaaggccucgcccggcacguuacccagugcccgaagagaaaagagaagguggaggaaacggagcuguaccuuaaccuggaacgcauuccuuggaucguccggaaacuccuucaggugagcgaguccacagggguggcccugaagagaagcucuuggcugauuguucuccugguccugcucaccgugagccugucccccgugcaaucugcuccugucggacauggcaaaacaaucgaaaccuaucagacacgggagggguucaccagcauuugucuuuuuaugcugggauccauccucuucaucgugucuugccugguuaagggccugguggacagcgucuccgauagcuuuuuccccgggcuuagcguguguaaaacgugcuccauuggcagcaucaauggauuugagauugaaucucacaaguguuacugcucccucuucuguugccccuauugucgccacugcagcgccgacagagagauccaucagcugcaccugucuauuugcaagaaacggaagaccggcuccaacguuaugcucgcgguguguaaaagaaugugcuucaaggcuacaaucgaagccagccgccgggcccugcuuauuagauccaucaucaauaccacauuugucauuuguauccugacccucgcuauuugcgugguuucuacgagcgccguggagauggaagaucugccugcugggacaugggagcgcgaggaagaccugaccaacuucugucaucaagagugccaggucacagaaaccgagugucuuugcccguacgaggcccuggugcucagaaaaccccuguuucucgauuccaucgugaagggaaugaagaaucugcuuaacagcaccucucuggaaacaucccucagcauugaggcgccuuggggcgccaucaauguccagucuacguucaaacccaccguuagcacagcuaacaucgcccuguccuggucuagcguggaacaccgggggaauaagauucuggugaccggacgcuccgagucuaucaugaaacuugaagagagaacaggcgucagcugggaccuggggguggaggaugcuuccgaaagcaagcuccugaccguuucuauuauggaccucucccagauguauagcccuguguuugaguaccuguccggcgaucggcaagucgaagaguggcccaaagccacguguacaggagacugcccugaacgcuguggcugcaccucuucuaccugccuucauaaggaguggccgcacuccagaaacuggcgguguaaucccacauggugcuggggagugggaaccggcuguacaugcugugggguugaugugaaggaccuguucacggaucacauguuuaucaaauggaaggucgaguacauuaaaaccgaagcgaucgugugcguugagcucacaucucaggaacgccaguguagccugaucgaggccggaaccagauucaaccugggcccugugacaauuacccuuuccgaaccccggaauauccagcaaaagcugccucccgagauuaucacgcuccauccgaaaauugaggaaggcuuuuucgaccugaugcacguccagaaggugcucagcgcuucuaccgugugcaagcugcaguccuguacacaugggaucccuggagaccuucagauuuaucacaucggcaaccugcugaaaggggaucgcgucaauggacaucucauccacaagauugagccccacuuuaacaccagcuggaugucuugggacggcugcgaucuggacuacuauuguaacaugggggauuggcccuccugcacauacaccggaguuacacaacauaaucacgccgcuuucgugaaccuucugaauaucgaaacggacuauaccaaaacauuucauuuccacagcaagagagugaccgcccacggcgauaccccucagcucgaccugaaagcccggcccacauacggcgcuggggagauuacgguccucguggagguugcggauauggaacugcauaccaagaaaguggagaucucuggacuuaaguucgccagccugacaugcaccggcuguuaugcuugcuccucugggauuagcuguaaggucagaauccacguggacgaaccugaugagcugacaguucaugugaaauccagcgacccggaugucguggccgccuccaccucucucauggcucgcaagcuggaauuuggaacggacagcacauucaaagccuuuuccgcgaugcccaagaccucucuuugcuucuacaucgucgagcgggaguacuguaaaagcugcuccgaagacgauaccaagaaguguguggacacaaaacuggagcagccucaaucuauucucaucgaacacaagggcaccauuaucgggaaacagaacgauacaugcaccgcuaaggccagcuguuggcuggaguccguuaagagcuuuuucuauggacucaaaaauaugcugggcucuguguuuggcuccuucuuugucgggauucuucuguuccuggcccccuuugugcuccugguucuuuucuucauguuuggauggaagauccuguucugcuuuaaauguugcagacgcacgcggggccucuucaaguacagacaucugaaagacgaugaagagacaggguaucgccggaucauugagagacucaacagcaagaaaggaaagaaucgccugcuugacggcgaacggcuggcugauagaaagaucgccgagcuguuuucuaccaaaacacacauuggguga

SEQ ID NO: 13612 - RNA, 5067 nt, Artificial Sequence
  derived and/or modified CDS sequence (opt5) from CCHFV(4701-ST-2009)__KR814872.1__GP
augcccaucaacauuaugcacacccugcucgugugcuucauccuguaccuucagcugagcggccucgggggagcccauggccaauccaaugcuacagagcacaacgggacgaauaccacaaccgccccuggaacaucucagagcccgaagcccccugcguccaccacacugccccauaccccugaaucuagcacggucaaacuuaccacacccaccuccgagacagaaggcucuggggagaccacgccuccgcccaacacaacccagggacugccucucacaggcaccacccccgaaagaagcgcuacaacggccaccuccacaagcucuaccgacaauaugaacuccacaacccagguuacggauaauacaccuaccagcaccgugucuauuucccccagcagcuccagcuccaugccgucuacaccucaaggcacccaccaucccgugcggagccugcuguccgucagcucuccuaagacagugacgacccccacacccauguccccuggggagaugagcccggagaccucuagccagcacuccgccaugucucgcguucccacacucuauaccgcuacccaggugagcacggaaaacacagacagauccaccccucggcagagcgagucuuccguccaacccgccacacagagcccuaucaccucucccgcucagacgauucugcuuauguccgccgcgccgaaagccauccaggauaugcacccuagccccacaaaucgcuccaagagaaaccuggaaguggagaucauucucacccugucucaaggacuuaaaaaguacuauggcaagauccugaaacuccugcaucugacacucgaggaagacaccgaggggcugcuugaaugguguaagcggaaucugggaagcaacugcgaugacgauuucuuccagaaacgcauugaggaauuuuucaucaccggcgagggguacuuuaaugagguucuccaguucaagacacuguccacgcuuucuccuaccgaacccagccacgugagacugccuacagcugagcccuuuaaauccuauuucgccaagggauuucucagcauugacucuggcuacuucuccgcuaaguguuauccgcggagcucuaccuccggccugcaacugaucaacgucacacagcauccugcccgcauugcggaaacccccgggcccaaaacgacaagccucaagaccaucaauugcaucaaccugagagccucuguguuuaaagagcaccgggaaguggagauuaacguccuucugccucagaucgcuguuaaucucagcaacugucacguggugauuaauucccaugucugcgauuacagccuggacaccgauggaccggugcgccuucccagaauccaccaugagggcacauucauuccugggaccuacaagaucguuaucgaccggaaaaacaagcugaaugaucgcuguucucucgugacaaacugcgucauuaaaggaagagaagugcggaagggccaguccguucugagacaauauaagacggagaucaaaauugggaaggccagcaccggaucccgcaaacugcucucugaagaacccggcgacgacuguaucagccggacacagcugcuuaagaccgaaacagcugagauucacgaugacaauuacggcgggccuggagauaaaaucaccaucugcaacggcuccacgguggucgaccagagacuggggucugagcucggauguuauaccauuaaucgcgucaagagcuuuaagcugugcgaaaacuccgccacaggcaaaaccugcgagaucgauucuacacccgugaagugucggcagggguucugccugaaaauuacccaagaaggcagaggacaugugaaacuuagccgcggcuccgagguugugcucgacgccugugauagcucuugcgagaucaugauuccuaaggggacaggagacauccuggucgauuguuccggcgggcagcagcacuuccugaaggacaaucucauugaucugggaugcccccacaucccgcuucugggcaagauggcuaucuacauuugucggaugagcaaccauccuagaaccacgauggcguuucucuucugguuuucuuucggguaugugaucacaugcaucuuuuguaaagcccuguucuacucccugauuauuaucggcacccuuggaaagaaaaucaagcaguaucgcgaacucaaaccccaaaccugcacaauuugugagaccgcuccuguuaaugccaucgacgccgaaaugcacgaccugaacugcagcuacaauauuugccccuacugugcuucucggcugacguccgauggccucgccagacaugugacacagugcccgaagcgcaaggagaaagucgaagagaccgagcuguaucuuaaccuggaacggaucccuuggauugugagaaagcuccuucaggugagcgaguccacagggguugcgcugaaacggagcucuuggcuuaucguccuccuggugcugcucaccgugagccugucccccguccagucugcuccugugggacacggcaagacaaucgaaaccuaccaaacgcgcgagggguuuaccagcauuugucuuuucaugcugggauccauccucuuuauuguuucuugccuggugaaaggccuggucgacagcguguccgauucuuucuuucccgggcuuagcguuuguaagacaugcuccaucggcagcauuaacggauucgaaaucgagucucacaaauguuauugcucccucuuuuguugccccuacuguagacauugcagcgccgaccgggagauccaccagcugcaucugucuauuugcaagaagagaaaaaccggcuccaaugugaugcucgccgucuguaagcgcaugugcuucaaagcuacaaucgaagccagccggagagcucugcuuauucgcuccaucauuaacaccacguucgugauguguauccugacacucgccauuugcguugugucuaccagcgcggucgagauggaagaucugccugccgggacaugggagagagaagaggaccugaccaauuuuugucaccaggagugccaagugaccgaaacagagugucuuugcccguaugaagcucuggugcuccggaagccccuguuccucgauuccaucgucaaaggaaugaagaaccugcuuaauagcacgucucuggagaccucccucagcaucgaggccccuuggggcgcuauuaacguucagucuacauuuaagcccaccgugagcacagccaauaucgcgcuguccuggucuagcguggaacaucgcgggaacaaaauucuggucaccggaagauccgagucuaucaugaaacuugaggagcggacgggcgugagcugggaccuggggguugaagaugccuccgagagcaagcuccugacagugucuauuauggaccucucccagauguacagcccugucuucgaguaucuguccggcgaucgccagguggaagaguggcccaaggcuaccuguaccggagacugcccugaaagauguggcugcacaucuucuaccugccuucacaaagaguggccgcacucccggaauuggcgcuguaaccccacauggugcuggggaguugggacgggcuguaccugcugugggguggaugucaaggaccuguuuacagaccauauguucaucaaguggaaaguggaauacaucaagaccgaggccauuguuugcguggagcucacaucucaagaaagacaguguagccugaucgaggcuggaacccgguuuaaucugggcccugucacgauuacccuuuccgaaccccgcaacauccagcagaaacugccucccgagauuaucacacuccacccgaagaucgaagagggcuucuuugaucugaugcaugugcaaaaagugcucagcgccucuaccgucugcaagcugcaguccuguacacacgggauuccuggagaccuucagaucuaccauauuggcaaucugcugaagggggauagaguuaacggacaccucauccacaaaauugagccccauuucaauaccagcuggaugucuugggacggcugcgaucuggacuauuacuguaacaugggggauuggcccuccugcacauauacgggagugacccagcacaaccaugccgcuuuugugaaucuucugaacaucgaaacagacuacaccaagaccuuccacuuucacagcaaacgggucacagcgcauggcgauacgccucaacucgaccugaaggccagacccaccuauggcgcuggggagauuacagugcucguugaaguggccgauauggagcugcacaccaaaaaggucgagaucucuggacuuaaauucgccagccugacaugcaccggcuguuacgcuugcuccucugggaucagcuguaaggugcgcauucauguugacgaaccugaugagcugacggugcacgucaaguccagcgacccggacguggucgccgcguccacaucucucauggcucggaaacuggaauuuggaaccgauagcaccuuuaaggccuucuccgccaugcccaaaacaucucuuugcuuuuauaucguggagagagaauacuguaagagcugcuccgaggacgauaccaaaaaguguguugacacaaagcuggagcagccucagucuauucucaucgaacauaaaggcaccauuaucgggaagcaaaaugauacgugcacagcuaaagccagcuguuggcuggaguccgucaagagcuucuuuuacggacucaaaaacaugcugggcucuguguucggcggguuuuucgugggaauccuucuguuucuggcgcccuucguucuccuggugcuguuuuucauguucggcuggaagauucuguuuugcuucaaguguugccgccggaccagagggcucuuuaaauaucgccaccugaaggacgaugaagagacaggauaccggagaaucauugaacgccucaauuccaaaaagggcaaaaaccggcugcuugacggggagagacuggcugaucggaagaucgccgagcuguucagcaccaagacgcacauuggauga

SEQ ID NO: 13613 - RNA, 5067 nt, Artificial Sequence
  derived and/or modified CDS sequence (opt5) from CCHFV(4574-ST-2008)__KR814870.1__GP
augcccaccaacaucaugcacacacugcucgugugcuucauucuguaccuucagcugcucggcccugggggagcccauggccaaccgaaugcuacggagcacaacagaaccaauacaaccacagcccccagcaccucccagucuccuaagcccccugucagcacagcgcccccucaugcucuggaauccccgaccaucaaaucuacgacccccacaagcgagaccgaaggguccggagagacaaccucuccucccaacacgacacagggcccuagccuucccgaaaccacaccgaagcggccugccaccaccgccacauccacgcccagcaccgacaauacaaacucuaccacacacguuaccgauaauaacccuacguccacaauuagcaccucucccuccagcucucccuccaccccuagcacaccgcgcgggauccaucaccccgcuagaaaucugcucuccgugucuagcccuaaaaccgccacaacgcccaccccuacaucccccggagagauuagcucugagaccuccagccugcacucugcuaugagccggacauccacccuguauacggccacccaggcgucuacagaaaacgccaaucauagcgcuccgcgccaauccgagagcccugcccagcccaccacaaccucucucaugacguccccugcucagagcauccuggugaugucugccgcgcccacagccauccagaacauucacccuucccccaccaauagaagcaagcggaaccuugaaauggagaucauucugacacucucccaaggccugaaaaaguacuauggcaagauccuuaaacugcuccaucugacccuggaggaagacaccgaggggcuccuggaaugguguaagcgcaaucuuggaucuaacugcgaggaugacuuuuuccagaaaagaauugaagaguuuuucaugacaggcgagggguacuuuaacgaaguccugcaguucaagacgcucagcacccuguccccgacagagccuucucacgcucggccucccaccguggaacccuuuaaaagcuauuucgccaagggauuucuuuccaucgauagcggcuacuucucugcuaaguguuauccgcgcuccagcacaucugggcugcagcucauuaauguuacccaacaccccgccagaaucgccgagacgccuggacccaaaacaaccucccugaagaccaucaacugcauuaaucugcgggcuagcguguuuaaagaacaucgcgagaucgagauuaacguccuccugccucagaucgcggugaaucuuucuaacugucacguugugauuaauagccaugucugcgacuacucccuggauacagacggccccgugagacucccucacaucuaccaugaaggcaccuucauccccgggacauauaagauugugaucgauaaaaagaacaaacugaaugaccgguguacgcuugucaccaacugcguuauuaagggacgcgaggugagaaagggccagagcgugcugcggcaauacaaaacagaaaucaagauugggaaagucucuaccggauccagaaagcuccugagcgaggaauccggcgaugacuguaucucucgcacacagcugcuccggaccgagacggccgagauccacgaugacaauuaugggggaccgggcgacaaaauuaccaucugcaacggcagcacaauuguggaucagagacugggguccgaacuuggauguuacaccaucaaucgcguuaagucuuuuaagcugugcgagaacagcgcuacaggcaaaaccugcgaaauugacuccacaccugugaagugucggcagggguucugccucaaaaucacccaagagggaagaggccacgucaagcugucucgcgggagcgaggugguucuggaugccugugacuccagcugcgaagugaugauucccaaaggcacgggagauauccuugucgacuguucuggcgggcagcagcauuuccucaaggauaaucugaucgaccugggaugcccucacauuccccuccugggcaagauggccaucuauauuugucggauguccaaccauccgagaacaaccauggcuuuucuuuucugguuuagcuucggguacgugauuaccugccuguuuuguaaagcccucuucuauucucugauuaucaucggaacacugggcaagaaaauuaagcaguaccgcgagcuucggccucaaaccugcacgaucugugaaacagcgcccgucaacgcuauugaugccgagaugcacgaccucaauugcuccuacaacaucugcccuuauugugccagcagacugaccucugaugggcuggcucgccacgugccccagugccccaaacggaaggaaaagguugaggagacagaacucuaccugaaucuugagagaaucccuuggaucgugcggaaacugcuccaggucuccgaaagcaccggcguggcccugaagcgcuccagcuggcugaucguucuucucgugcugcugacagucucucucagcccggugcaguccgcucccgugggacauggcaaaaccauugagacguaucaaaccagagaaggguuuacaucuaucugucuguucaugcuuggaagcauucuguuucucguuuccugccuggucaagggccugguggacucugugagcgacuccuucuuuccugggcuuucugucuguaaaaccugcagcaucggauccauuaacggcuucgagaucgagagccacaaguguuacugcucucuccuguguugccccuauugucggcauugcuccgccgauagagaaauccaccagcugcaucucagcauuugcaaaaagcgcaagacagggucuaaugugaugcuggcgguuuguaaacggaugugcuuuagagccaccaucgaggcuucccgcagagcccuucugauucggagcaucauuaacacgacauucgugaucuguauucucacccugacaaucugcgucguguccaccucugcuguugaaauggagaaucugccuagcggcaccugggaaaaggaggaggaccuuacaaacuucugucaccaggaaugccaggugacggagaccgaaugucugugccccuacgaggcccucguccugcgcaaaccucucuuucuggauuccaucgugaagggaaugaaaaaucuucugaacagcacaucucucgagaccucccugagcauugaagcgccguggggcgccaucaauguucaaucuacauucaagcccaccgugagcacggcuaacauugcccuguccuggucuagcgucgagcacagagggaauaagauccuugugacaggacgguccgaaucuauuaugaaacuggaggaacgcaccggcgugagcugggaccucggggucgaggaugcuuccgagagcaagcugcucaccguuucuaucauggaccugucccagauguauagcccuguguuugaauaccuuuccggagauagacagguggaggaauggcccaaagccacauguaccggcgacugcccugagcggugugggugcacaucuagcacgugccugcauaaggaauggccccacucccgcaacuggagauguaauccgaccuggugcuggggcgucggaacaggcuguaccugcugugggguggauguuaaagaccucuucacagaucauauguuugugaaguggaaggucgaguacaucaaaaccgaggccauugugugcguugaacugacgucucaagagcggcaguguagccugaucgaagcuggaacccgcuucaaccuuggcccugugacaauuacccuguccgagcccagaaacauccagcagaagcugcccccugaaauuaucacacuccaccccaaagucgaggagggguuuuucgaccucaugcaugugcaaaagguucugagcgcgucuaccgugugcaaacuucaguccuguacacacggaaucccuggcgaucugcaggucuaucacauuggcaaucugcucaagggggaccgggugaacggacaucugauccacaagauugaaccgcauuuuaauacgagcuggaugucuugggacggcugcgaucuugacuacuauuguaacaugggggauuggcccuccugcaccuacacaggagugacccagcacaaucacgccgcuuucgucaaccugcucaauaucgagaccgacuauacaaaaacguuucauuuccacagcaagagaguuaccgcccauggcgauacaccucaacuggaccucaaagcccgccccaccuacggggcuggagaaauuacagugcugguggaggucgccgauauggagcuucacaccaagaaaguggaaaucucuggccugaaguuugcgagccuggcuugcacgggcuguuaugccugcuccucugggauuagcuguaaaguucggauccauguggacgagccugaugaacucacaguccacgugaaguccagcgaccccgauguuguggccgcuuccaccucucugauggccagaaaacuugaguucggaaccgacagcacauucaaggcguuuuccgcuaugccgaagaccucucugugcuucuacaucgucgaacgcgaguacuguaaaagcugcuccgaggaagauacacagaaguguguggacaccaaacucgagcagccucagucuauucugaucgaacacaagggcacgauuaucgggaagcaaaacgacacaugcaccgccaaagccagcuguuggcucgaguccgucaagagcuuuuucuauggacugaaaaauaugcuuggcucuguguuugggaacuucuuuauuggaauccugcuguuccucgcucccuuuguucugcuugugcuguucuuuauguucggcuggaagauccucuucugcuuuaaauguugccggagagcccgcggccugcucaaguaccggcaucugaaggaugacgaagagacaggguauagaaaaauuaucgagcgccuuaauaacaagaaaggaaagaaucggcugcuggauggcgaaagacucgcugaccggaaaauugccgagcuguucuccaccaagacgcacaucggguga

SEQ ID NO: 13614 - RNA, 5067 nt, Artificial Sequence
  derived and/or modified CDS sequence (opt5) from CCHFV(4495-ST-2008)__KR814869.1__GP
augcccaccaacaucaugcacacacugcucgugugcuucauucuguaccuucagcugcucggcccugggggagcccauggccaaccgaaugcuacggagcacaacagaaccaauacaaccacagcccccagcaccucccagucuccuaagcccccugucagcacagcgcccccucaugcucuggaguccccgaccaucaaaucuacgacccccacaagcgagaccgaaggguccggagagacaaccccucccccuaacacgacacagggccccucuccgccugaaaccacacccgagcggccugccaccaccgccacaagcacgcccuccaccgacaauacaaacagcaccacacacguuaccgauaauaaccccacgucuacaauuuccaccagcccuucuuccagcccgucuacccccuccacaccucgcgggauccaucaccccgcuagaaaucuucugagcguguccucuccuaagaccgccacaacgcccaccccgacaagcccuggagagauuuccagcgaaaccucuucccuccacagcgcuaugucucggacaagcacccuguauacggccacccaggcguccacagagaacgccaaucauucuacaccccgccaaagcgaauccccugcucagcccaccaccacgagccugaugacaucuccugcccaguccauccucgugaugagcgcugcccccaccgcgauccagaacauucacccgucuccuacaaauagauccaaacggaaccuggagauggagaucauucuuacccugagccaaggccucaagaaauacuauggcaagauccugaaacuucugcaucucacccuggaagaggacacagaagggcugcucgagugguguaagcgcaaucugggauccaacugcgaugacgacuuuuuccagaagagaauugaagaguuuuucaugacgggcgagggguacuuuaacgaaguccuucaguucaaaacccugucuacacucagccccaccgagcccucccacgcccggccuccgacaguggaacccuuuaagucuuauuucgcuaaaggauuucugagcaucgauuccggcuacuucagcgccaaguguuauccuagaucuuccaccagcgggcuucagcugauuaauguuacgcaacaccccgcuagaaucgccgagacaccuggacccaagaccaccucucucaaaacaaucaacugcauuaaucugcgggccuccguguuuaaggaacaucgcgagaucgagauuaacguccugcucccucagaucgcugugaaucugagcaacugucacguugugauuaauucucaugucugcgauuacagccuugacaccgauggccccgugagacugccgcacaucuaccaugaaggcacauucaucccugggacguauaaaauugugaucgacaagaaaaacaagcucaaugaucgguguacccuggucacaaacugcguuauuaaaggacgcgaggugagaaagggccaguccgugcuucggcaauacaagaccgaaaucaaaauugggaaggucagcacaggaucuagaaaacugcucuccgaggaaagcggcgacgauuguaucucccgcacccagcugcugcggacggagaccgcggagauccacgacgacaauuaugggggacccggcgauaagauuacaaucugcaacggcucuaccauuguggaccagagacucgggagcgaacugggauguuacacaaucaaucgcguuaaauccuuuaaacuuugcgagaacucugccaccggcaagacaugcgaaauugauagcaccccugugaagugucggcagggguucugccugaagaucacgcaagagggaagaggccacgucaaacucucccgcgggucugaggugguucuggacgcuugugauagcuccugcgaagugaugauucccaagggcacaggagacauccuggucgauuguagcggcgggcagcagcauuuccuuaaagacaaucucaucgaucugggaugcccgcacauuccucugcucggcaagauggccaucuauauuugucggaugucuaaccaucccagaaccaccauggccuuucuguucugguuuuccuucggguacgugaucacaugccuguuuuguaaggcucuuuucuauagccucauuaucaucggaacccugggcaaaaagauuaaacaguaccgcgagcugcggccucaaacgugcacaaucugugaaaccgcccccgucaacgcgauugacgcugagaugcacgaucuuaauugcucuuacaacaucugccccuauugugccuccagacucacaagcgacgggcuggcccgccacgugccucagugcccgaagcggaaagaaaagguugaggagaccgaacuguaccucaaucuggagcgcauucccuggaucgugcggaaacuucugcaggucucugaauccacaggcguggcucucaagcgcagcuccuggcugaucguucugcuugugcuccugaccgucagccugucuccugugcagagcgcccccgugggacauggcaagacgauugagaccuaucaaacaagagaaggguuuaccuccaucugucucuucaugcugggaucuauucuuuuucugguuagcugccucgucaaaggccugguggacuccgugucugauagcuucuuuccugggcuguccgucuguaagacaugcucuaucggaagcauuaacggcuucgagaucgagucccacaaauguuacugcagccuucucuguugccccuauugucggcauugcucugcugacagagaaauccaccagcugcaucuguccauuugcaagaaacgcaagaccgggagcaaugugaugcucgccguuuguaagcggaugugcuuuagagcgacgaucgaggccucucgcagagcucugcuuauucgguccaucauuaacacaaccuucgugaucuguauucugacacucaccaucugcgucgugagcaccuccgccguugaaauggagaaucugccuucuggcacaugggaaaaagaggaggaucugacgaacuucugucaccaggaaugccaggugaccgagacagaaugucuuugcccguacgaggcucugguccuccgcaagccccuguuucucgacagcaucgugaaaggaaugaagaaucugcuuaacuccaccagccuggagacaucucucuccauugaagccccuuggggcgcgaucaauguucaaagcaccuucaaacccacggugucuacagccaacauugcucugagcugguccucugucgagcacagagggaauaagauccuggugaccggacggagcgaauccauuaugaaacuugaggaacgcaccggcaucucuugggaucuggggguggaggacgccagcgaguccaagcuccugacagucagcaucauggaucucucucagauguauuccccuguuuuugaauaccugagcggagacagacagguggaggaauggcccaaggcuaccuguacaggcgauugcccggagcggugugggugcacguccucuaccugccuucauaaagaauggccucacagccgcaacuggagauguaaucccacauggugcuggggcgugggaaccggcuguacaugcuguggggucgacgugaaggaucuguucaccgaccauauguuuguuaaauggaagguggaguacauuaagacggaggccaucgucugcguggaacucaccucccaagagcggcaguguucucugauugaagccggaacacgcuucaaccugggccccguuaccaucacacuuagcgagccuagaaacauucagcagaaacugcccccugaaaucaucacccuccacccgaagguggaggagggguuuuucgaucugaugcauguccaaaaagugcucuccgcuagcacaguuugcaagcugcagucuuguacgcacggcauucccggagaccuucagguguaucacaucggcaaucugcugaaaggggaccgggucaacggacaucucauucacaagaucgaaccucauuuuaauaccuccuggaugagcugggauggcugcgaccuggauuacuauuguaacaugggggacuggcccucuugcacauacaccggagugacccagcacaaucacgcggccuucgugaaccuucugaauauugagacagauuauacgaagaccuuucauuuccacuccaaaagagucacagcucauggcgacaccccucaacucgaucugaaggcccgccccacauacggggccggagaaaucaccguucucguggagguggcugacauggagcugcacacgaaaaaggucgaaauuagcggccuuaaauuugccucucuggcgugcacaggcuguuaugcuugcagcuccgggaucucuuguaaggugcggauccauguugaugagccggacgaacugaccgugcacgucaaaagcuccgauccugacgugguugccgccagcaccucccucauggcuagaaagcuggaguucggaacagauucuaccuucaaggccuuuagcgcgaugcccaaaacaucccuuugcuucuacauuguggaacgcgaguacuguaagucuugcagcgaggaagacacccagcggugugucgacacgaaacuggagcagccucaguccauccucauugaacacaagggcacaaucauugggaaacaaaacgauaccugcacagcuaaggccucuuguuggcuggagagcgugaaguccuuuuucuauggacucaaaaauaugcugggcagcgucuuugggaacuucuuuaucggaauccuucuguuccuggcccccuuugugcuccugguucuuuucuuuauguucggcuggaagauucuguucugcuuuaaauguugcagacgcgcucggggccuccugaaguacagacaucucaaagacgaugaagagaccggguaucgcaagaucauugagcggcugaauaacaagaaaggaaagaauagacuucuggacggcgaacggcuggccgaucgcaaaaucgcugaacucuucucuacgaagacccacauuggguga

SEQ ID NO: 13615 - RNA, 5067 nt, Artificial Sequence
  derived and/or modified CDS sequence (opt5) from CCHFV(3809-ST-2007)__KR814867.1__GP
augcccaccaacaucaugcacacacugcucgugugcuucauucuguaccuucagcugcucggccugggaggagcccaaggccagagcaaugcuacggagcauaacgaaaccaauacaaccacagccccuuccaccucucagagcccgaagcccccugucuccacaacaccccuucacgcgcuggagucuagcacgaucaaaccuaccacacccgcuagagaaaccgagggguccggagaaacaaccccuccgcccaacacgacacagggcccuucucccccugaggccacccccgagcggccggccacaaccgcuaccagcgccccuuccacagacaauacgaacagcaccacacauguuaccgauaauaaccccacaucuaccauuuccacgagcccuucuuccagccccucuacacccuuuaccccucaagggauccaccauccggcucgcaaucuccuguccgugagcucccccaagaccgccacaaccccuacacccacgucuccuggagaacugagcuccgagaccagcucucuccacuccgcgauuagcagaacaucuacccuguauacagccacccaggugagcacggaaaacgcuaaucacuccgcuccccggcagucugagagcuccgcccagccgaccacaaccagcccuaugacaucucccgcccaauccauccuugucaugagcgcggccccuaccgcuauccagaacauucaucccucuccuacgaaucgcuccaaaagaaaccuggagauggaaaucauucucacacugagccagggccuuaagaaauacuauggcaagauccugaagcuccugcaccugacccucgaggaagacacagaggggcugcuugaaugguguaaacggaaucugggauccaacugcgaugacgauuucuuucagaagcgcauugaggaguucuuuaugaccggcgaaggguacuucaacgaggugcuccaauuuaaaacccugucuacacuuagccccacggaaccgucccaugccagaccucccgcuguugagcccuucaagucuuauuuugccaaaggauuccugagcaucgacuccggcuacuuuagcgccaaguguuauccucggucuuccaccagcgggcuccagcugauuaaugugacacagcacccggcucgcaucgcggaaacccccggaccuaagacaaccucucugaaaacgaucaacugcauuaaucucagagccuccgucuucaaggagcaccgggagaucgaaauuaacgugcugcuuccccaaaucgcuguuaaucugagcaacugucauguggucauuaauucucacgugugcgauuacagccucgacacagauggcccugugcgccugccccauaucuaccacgagggcaccuuuaucccugggaccuauaaaauugucaucgacaagaaaaacaaacuuaaugauagauguacacugguuaccaacugcgugauuaaaggacgggaagugcgcaagggccaguccguccucagacaguacaagacagagaucaaaauugggaaggccagcacgggaucucggaaacugcuguccgaggaacccggcgacgauuguaucagcagaacccagcuccugcgcacagagaccgccgaaauccaugacgacaauuaugggggaccgggcgauaagauuacaaucugcaacggcuccaccauuguggaccaacggcuugggucugagcugggauguuacacgaucaauagaguuaagagcuucaagcucugcgaaaacuccgcuaccggcaagacaugcgagauugauucuaccccugugaaaugucgccagggguucugccugaagaucacacaggagggacggggccacgucaaacugagcagaggguccgaagugguucuugacgccugugauucuagcugcgaggugaugauucccaagggcaccggagacauccucgucgauuguuccggcgggcagcaacacuuucugaaagacaaucugaucgaucucggaugcccucauauuccccugcuuggcaagauggcgaucuauauuugucgcaugagcaaccacccgcggacaaccauggcuuuccuguuuugguucucuuuuggguacgugaucacgugcauuuucuguaaggcccucuuuuauucccugaucaucauuggaacacugggcaaaaagaucaaacaguacagagaacuuaagccucagaccugcaccauuugugagacagcccccgucaacgcuaucgacgccgaaaugcaugaucucaauugcagcuacaacauuugcccuuauugugcuucucgccugaccuccgacgggcuggcccggcacgugccccagugccccaaaagaaaggagaagguugaggaaacggagcucuaccugaaucuugaacgcaucccuuggaucgugcggaaacugcuccaagucagcgagucuacaggcguggcgcugaagagauccagcuggcugauuguucuucucgugcugcugaccgucucccucagcccggugcagucugcccccgugggacacggcaaaacaaucgaaaccuaucagacacgggagggguucaccagcauuugucuguuuaugcuuggauccauccuguuccucguuucuugccuggucaagggccugguggacagcguguccgauagcuuuuucccugggcuuucugucuguaaaacgugcuccauuggaucugugaacggcuuugagaucgaaagccauaaguguuacugcucccucuucuguugccccuauugucgccacugcagcgcugacagagagauccaucagcugcaccugucuguuugcaaaaagcggaagaccggguccaaugugaugcucgccgucuguaaaagaaugugcuuccgcgcuacaauugaagccagccggagagcgcugcuuauccgcucuauuaucaacaccacauuugugauuuguauccugacccucacgauuugcguuguguccacaagcgccgucgagauggaaaaucugccugcuggcaccugggagagagaggaagaucugacaaacuucugucaucaagagugccaggugaccgaaaccgagugucuuugccccuacgaggcccugguucuccggaagccucuguuucucgacuccaucgugaaaggaaugaagaaucugcuuaacucuacaagccuggaaacgucccucagcaucgaggcuccguggggcgccauuaauguccagucuaccuucaaacccacaguguccaccgccaacaucgcucugagcuggucuagcguggaacaccgcgggaauaagauucuggucacaggaagauccgagucuaucaugaaacuugaggaacggaccggcguuagcugggaucuggggguggaggacgcguccgaaucuaagcuccugacggugagcauuauggaucucucccaaauguauagcccugucuuugaguaccugucuggagaccgccagguggaagaguggcccaaggccacauguaccggcgauugcccugaaagaugugggugcaccuccagcacaugccuucacaaagaguggccccauucccggaacuggcgcuguaauccgaccuggugcuggggcguuggaacaggcuguacgugcugugggguggacgucaaggaucuguucaccgaccacauguuugugaaauggaagguugaguacaucaagacagaagcuaucgugugcgucgagcucaccucucaggaaagacaguguagccugauugaggccggaacacgguucaaccugggcccugugaccaucacgcuuuccgaaccccgcaacauucaacagaaacugcccccugagaucauuacccuccaucccaagguugaggaaggguuuuucgaucugaugcacgugcagaaaguccucucugccagcacagugugcaagcugcaguccuguacccauggaaucccuggcgaccuucaaguguaucacaucggcaaucugcugaaaggggacagagucaacggacaccucauucauaagaucgagccgcacuuuaauacaagcuggaugucuugggauggcugcgaccuggauuacuauuguaacaugggggacuggcccuccugcaccuacacaggaguuacgcagcauaaucacgcugccuucgugaaccuucugaauauugaaaccgauuauacaaagaccuuucacuuccauagcaaacgggugaccgcgcacggcgacacaccucagcucgaucugaaggcuagacccacguacggggccggagagaucaccguccucguggagguugccgacauggaacugcauaccaaaaagguggagauuucuggccuuaaauucgcuucccuggccugcaccggcuguuaugcgugcagcucugggaucagcuguaagguccgcauucacguggaugaaccugacgagcugacaguucaugugaaauccucugaucccgacgucguggcugccagcaccucccucauggcccggaagcuggaauuuggaacggauagcacauucaaggcuuuuuccgccaugccgaaaaccucucuuugcuucuacaucgucgagaaggaguacuguagaagcugcuccgaagaggacacccagaaauguguggacacaaagcuggaacaaccucagucuauccucauugagcacaaaggcaccaucauugggaagcagaacgauacaugcaccgcuaaggccagcuguuggcuggaauccguuaaaucuuucuuuuauggacucaagaauaugcugggcagcguguuugggaacuucuuuaucgggauucuucuguuccugacgcccuuuguccuccuggugcuuuucuucauguuuggcuggaaaauccuguucugcuuuaaguguugccgccggacaagaggccuccugaaauaccgccaccucaaggacgaugaggagaccggguaucggagaaucauugaacgccugaauaacaagaaaggaaagaaucggcuucuggacggcgagagacuggcggaucggaaaaucgccgaacucuucuccacaaagacccauauuggguga

SEQ ID NO: 13616 - RNA, 5067 nt, Artificial Sequence
  derived and/or modified CDS sequence (opt5) from CCHFV(3756-ST-2007)__KR814866.1__GP
augcccaucaacauuaugcacacccugcucgugugcuucauccuguaccuucagcugagcggccucgggggagcccauggccaauccaaugcuacagagcacaacagaacgaauaccacaaccgucccugggacaucucagagcccgaagcccccugccuccaccacacugccccauaccccugaaucuagcacgguuaaacuuaccacacccaccuccgagacagaaggaucuggcgagaccacgccuccgcccaacacaacccaggggcugccucuccccggaacaaccccugaacggagcgcgaccacagcuacguccaccagcucuacagacaauaugaacaccacaacccaggugacggauaauacacccaccuccaccgugagcauuucuccguccagcucuccuuccaugcccagcacaucccaaggcauccacuauccuguccgcucucugcugagcguguccagccccaagaccguuacaacgcccaccccuaugucuccgggcgagaugucccccgagacaagcucucagcauagcgccaugucccgcauuccuacccucuacacagccacccaggugucuacggaaaacaucaaucggagcacccccagacaguccgagagcucuguccaaccugcuacacagucccccaucaccagcccggcccagacaauucugcuuaugucugcugccccuaaagcgauccaggacaugcaccccuccccuaccaacagaagcaagcggaaucuggaaguggagauuauccucacgcugucccaagggcuuaaaaaguauuacggaaagauucugaaacuccugcaccugacacucgaggaagauaccgagggccugcuugaaugguguaagcgcaaccuggggucuaauugcgacgaugacuuuuuccagaaaagaaucgaggaauuuuucauuacaggagagggcuauuuuaacgagguucuccaguucaagacccugagcacccuuucccccacagaaccuucucaugugcggcugcccacggccgagccguuuaaaagcuacuucgcuaagggguuucucuccaucgauagcggauauuucucugccaaguguuacccucgcuccagcaccucuggccugcaacugaucaaugucacacagcaccccgcuagaauugccgaaacccccggcccuaaaacaaccucccucaagacgaucaacugcauuaaccugcgggcgagcguguuuaaagagcaucgcgaaguggagaucaauguccuucugccgcagauugccguuaaccucucuaauugucacguggugaucaacagccacgucugcgacuacucccuggauacagacgggcccgugagacuuccucggauccaucacgagggaaccuucauucccggcaccuauaagaucguuauugaucgcaaaaauaagcugaacgacagauguagccucgugacaaauugcgucaucaaagggcgggaagugagaaagggacagucuguucugcgccaauacaagaccgagauuaaaaucggcaaggcuuccacagggagccggaaacugcucuccgaggaaccuggagaugacuguaucucuagaacgcagcugcuuaagaccgaaacagccgagauucaugacgauaacuauggcggccccggggacaaaaucaccauuugcaauggaagcacaaucguggaucagcgccugggcuccgagcucggguguuacaccauuaaccgggucaagucuuuuaagcugugcgaaaauagcgcuacgggaaaaaccugcgagaucgacuccacaccugugaaguguagacagggcuucugccugaaaauuacccaagaagggcgcggccacgucaaacuuucucggggaagcgaggugguucucgaugccugugacuccagcugcgagaucaugauccccaaaggcacaggggauauucugguggacuguucuggaggccagcagcauuuccugaaggauaaccucaucgaccuggggugcccgcacauuccucuucugggaaagauggccaucuauauuuguagaauguccaaucacccccgcaccacaauggcuuuucucuucugguuuagcuucggcuacgucauuaccugcaucuuuuguaaagcgcuguucuauucucugaucaucauugggacgcuuggcaagaaaaucaagcaguaccgggaacucaaaccucaaacaugcaccauuugugagaccgcccccgugaacgcuaucgaugccgaaaugcaugaccugaauugcuccuacaacaucugcccguauugugccagcagacugacaucugacggacucgcucgccacguuacccagugcccuaagcggaaggagaaaguggaagagacggagcuguaccuuaaccuggaacggauucccuggaucgucagaaagcuccuucagguguccgagagcacaggcguggcccugaaacgcuccagcuggcuuauuguucuccugguccugcucaccgugucucugagcccugugcaguccgcgcccgucgggcauggaaagacaaucgaaaccuaucaaacaagagagggcuuuaccucuauuugucuuuucaugcuggggagcauccucuuuaucguguccugccugguuaaaggacugguggauucugucagcgacuccuucuuucccggccuuucuguguguaagacgugcagcauuggguccaucaauggcuucgaaauugagagccacaaauguuacugcucucucuuuuguugcccuuauugucggcacugcuccgcugauagagagauccaucagcugcaccugagcauuugcaagaagcgcaaaaccggaucuaacguuaugcucgccguguguaagcggaugugcuucaaagccacaaucgaggcuuccagacgcgcccugcuuauuagaagcaucaucaauaccacauucgucauuuguauccugacccucgcuauuugcgugguuuccacgucugccguggaaauggaagaccugccggcgggcacaugggagcgggaagaggaucugaccaacuuuugucaucaggagugccaagucacagaaaccgagugucuuugccccuacgaagcccuggugcuccgcaagccucuguuccucgacagcaucgugaaagggaugaagaaucugcuuaacuccaccagccuggagacaucucucuccauugaggcucccuggggagccaucaauguccagagcacguuuaagccuaccguuucuacagcuaacaucgcccugagcugguccucuguggaacacagaggcaauaaaauucuggugaccgggcggagcgaguccaucaugaaacuugaggaacgcacaggagucucuugggaucugggcguggaagacgcgagcgaguccaagcuccugaccguuagcauuauggaucucucucagauguauucccccguguucgaguaccugagcggggacagacaggucgaagaguggccuaaggccacguguacaggcgauugcccggaacgguguggaugcaccuccucuaccugccuucauaaagaguggccccacagccgcaacuggagauguaauccuacauggugcuggggcguggggaccggauguacaugcuguggcguugacgugaaggaucuguuuacggaccacauguucaucaaguggaaagucgaauacauuaagaccgaggcuaucgugugcguugagcucacaucccaagaacggcaguguucucugaucgaggccgggacccgcuuuaaccugggacccgugacaauuacccuuagcgaaccuagaaauauccagcagaaacugcccccggagauuaucacgcuccauccuaagauugaagagggcuucuuugaccugaugcacguccaaaaagugcucuccgcuagcaccgugugcaagcugcagucuuguacacauggcauccccggggaucuucagauuuaucacaucggaaaccugcugaagggcgaccgggucaaugggcaucucauccacaaaauugagccccacuucaacaccuccuggaugagcugggauggaugcgaccuggauuacuauuguaacaugggcgacuggccuucuugcacauacaccgggguuacacagcauaaucacgccgccuuugugaaccuucugaauaucgaaacggauuauaccaagacauuccauuuucacuccaaaagagugaccgcucacggagacacaccccaacucgaucugaaggcgcgcccuaccuacggcgccggcgagauuacgguccucguggaaguugcugacauggagcugcauaccaaaaagguggagaucagcgggcuuaaauucgccucucugacaugcaccggauguuaugccugcagcuccggcauuucuuguaagguccggauccacguggaugaaccggacgagcugacaguucaugucaagagcuccgaucccgacgugguggcugccagcaccucccucauggcgagaaaacuggaguucgggacggacucuacauuuaaggcuuucagcgccaugccuaaaaccucccuuugcuuuuacaucgucgaacgcgaauacuguaagucuugcagcgaggaugacaccaaaaaguguguggauacaaagcuggagcagccccaguccauucucaucgaacacaaaggaaccauuaucggcaagcaaaacgacacaugcaccgccaaggcuucuuguuggcuggagagcguuaaguccuucuuuuaugggcucaaaaauaugcugggaagcguguucggcuccuuuuucgucggcauucuucuguuucugacgccuuucgugcuccugguucuguuuuucauguucggguggaagauccuguuuugcuucaaguguugccggagaacacgcggacucuuuaaauaccggcaucugaaggaugacgaagagaccggcuauagacgcaucauugaacggcucaacucuaaaaaggggaaaaauagacugcuugauggagagcggcuggccgaccgcaagaucgcggagcuguucagcacaaagacccacauuggcuga

SEQ ID NO: 13617 - RNA, 5067 nt, Artificial Sequence
  derived and/or modified CDS sequence (opt5) from CCHFV(81-R-2014)__KR814865.1__GP
augcccaccaacaucaugcacacacugcucgugugcuucauucuguaccuucagcugcucggccugggaggagcccauggccaaagcaaugcuacggagcacaacgggaccaauacaaccacagucccuuccaccucucagagcccgaagccccuuguuuccacaaccccuccccaugcccuggaaucuagcacgaucaaaccuaccacacccaccuccgagacagaaggaucuggcgagaccgcgccucucccgaacacgacacaggggcccccucccccugaaaccacacccgagagaccggcuaccaccgugacaagcacgccuuccaccgacaauacaaacagcaccauucacgugacagauaauaaccccaccucuacgaucuccacaagcccuucuuccagccccucuacccccuccaccccucaggggauucaucacccggcccggagccugcuguccgucucuagccccaagacagccaccacaccuacgcccaccuccccuggcgagaucaauagcgaaacaucuucccuccacagcgcuaugucucgcacccccacacugcauaccgccacgcaagugagcaccgagaacgcuaaucacuccgccccgagacagucugaaagcuccgcgcagccuacaaccacaagccuuaugaccucucccgcccaguccauccugcucaugagcgcugccccuacggcuauucaaaacacacaucccucuccuaccaaucgguccaaacgcaaccuggagauggagaucauucuuacacugagccagggccucaagaaauauuacgggaagauccugaagcugcuccaccugacccuugaagaggacaccgaaggacugcucgagugguguaaaagaaaucugggcuccaacugcgaugacgauuucuuccagaagcggauuggggaauuuuucaugacaggagagggcuauuuuaacgagguucuucaguucaaaacgcugucuacccucagccccacagaaccgucccacgcccgccugccuaccguggagcccuuuaagucuuacuucgcgaaaggguuucugagcaucgacuccggauauuucagcgccaaguguuaccccagaucuuccacaagcggccuccaacugauuaaugucacccagcauccugcucggaucgccgaaacgccgggccccaagacaaccucucuuaaaaccaucaacugcauuaaucugcgcgcuuccguguuuaaggagcacagagaaaucgagauuaacguucuccugccucagaucgccgugaaucuuagcaacugucaugucgugauuaauucucacgugugcgauuauagccuggacacagaugggcccguccggcucccucauaucuaccacgagggaaccuucauccccggcacauacaaaauuguuaucgacaagaaaaacaagcugaaugaucgcuguacgcuggugaccaacugcgugauuaaagggagagaaguccggaagggacaauccgugcuccgccaguauaagacagagaucaaaauuggcaaggccagcaccgggucuagaaaacugcuuuccgaggaaccuggagacgauuguaucagccggacacagcugcucagaaccgaaacggcugagauccacgacgacaauuacggcggccccggggauaagauuaccaucugcaacggauccacaauuguugaccagcgccugggcucugagcugggguguuauaccaucaaucgggugaaauccuuuaaacuuugcgaaaacagcgcgacaggaaagaccugcgagauugauucuacaccggucaaguguagacaaggcuucugccucaagaucacccaggaagggcgcggccaugugaaacugagccggggauccgagguugugcuggacgccugugauucuagcugcgaggucaugauuccuaagggcacgggggacauccucguggauuguuccggaggccagcagcacuuccugaaagacaaucuuaucgaucuggggugcccccauauuccucuccugggaaagauggcuaucuacauuuguagaaugagcaaccacccccgcacaaccauggccuuucuguucugguuuucuuucggcuaugucauuaccugcaucuuuuguaaggcccuuuucuacucccucaucaucauugggacacugggcaaaaagaucaaacaauaucgggaacugaagccgcagaccugcacgauuugugagacagcuccugugaacgccaucgacgcggaaaugcacgaucucaauugcagcuacaacauuugccccuacugugcuucuagacugaccuccgacggacuugcccgccauguuccucagugccccaaacggaaggagaagguggaagagacagagcuguaucucaaucuggaaagaauccccuggaucguccgcaaacugcuucaggugagcgagucuaccggcguugcccucaagcgguccagcuggcugauugugcugcucguccugcuuacagugucccugagcccugugcaaucugcuccgguugggcacggaaaaaccaucgaaacguaccagaccagagagggcuuuacaagcauuugucucuucaugcugggguccauccuguuucuugucucuugccucgugaagggacugguggacagcgucuccgauucuuucuuucccggccugagcguguguaaaaccugcuccauugggucuaucaacggcuucgaaaucgagagccauaaguguuauugcucccucuuuuguugcccuuacugucggcacugcagcgccgaccgcgagauucaucagcugcaccuuucuaucugcaaaaagagaaagacaggauccaauguuaugcuggcuguguguaaacggaugugcuucagagccaccauugaagcgagccgccgggcccuccugaucagaucuauuaucaacacgacauucgucauuuguauccugacccuuacaaucugcgugguuuccaccagcgcuguggagauggaaaaucugcccgccggcaccugggagcgcgaagaggaucucacaaacuuuugucaccaggagugccaagucacggaaaccgagugucugugcccuuaugaagcucucgugcugagaaagccccuuuuccuggacuccauuguuaaagggaugaagaaucuccugaacucuacaagccuggagaccucccuuagcaucgaggccccuuggggagcgauuaaugugcagucuacauuuaaaccgaccgucuccacggccaacaucgcucugagcuggucuagcguggaacaucggggcaauaagauucucgugacagggcgcuccgagucuaucaugaagcuggaagagagaaccggagucagcugggaucucggcguugaagacgccuccgagucuaaacugcuuaccgugagcaucauggaucugucccagauguacagccccguguucgaguaucucucuggggaccggcaagucgaagaguggccuaaggcuacauguaccggcgauugccccgaacgcuguggaugcacauccagcacgugccugcacaaagaguggccucauuccagaaacuggcgguguaaucccaccuggugcuggggcguggggacaggauguaccugcuguggcguugacgugaaggaucuguuuacagaccacauguucgucaaauggaagguggaauacauuaagaccgaggccaucguuugcguggagcuuacgucucaggaacgccaguguagccugauugaggccgggaccagauuuaaccucggaccggucacaaucacccuguccgaaccucggaacauucagcaaaaacucccucccgagaucaucacacugcaucccaagguggaagagggcuucuuugaucuuaugcacguucagaaagugcugucugcuagcaccgucugcaagcugcaguccuguacacacggcauucccggggaccuccagguguaccauaucggaaaucugcuuaaaggcgaccgcauuaacgggcaccugauccauaagauugagccucacuucaauacgagcuggaugucuugggauggaugcgaccucgauuauuacuguaacaugggcgacuggccguccugcaccuauacaggggugacccaacacaaucaugcggccuuugucaaccugcucaauaucgaaaccgauuacacaaagacguuccacuuucauagcaaaagaguuaccgcucacggagacacaccccagcuggaucuuaaggcccggccuaccuauggcgccggcgagauuacagugcugguggaagucgcugacauggagcugcauaccaaaaagguggagaucucugggcucaaauucgccucccuggcgugcacgggauguuacgcuugcagcucuggcaucagcuguaagguucgcauucacguggaugaacccgacgagcuuacaguccacgugaaauccucugauccugacguuguggccgccagcaccucccugauggcuagaaagcucgaauuugggaccgauagcacauuuaaggccuucuccgcgaugcccaaaaccucucugugcuuuuauaucgucgagcgggaauacuguaagagcugcuccgaggaggacacacagaaauguguggacaccagacucgaacagccgcaaucuauucugaucgagcauaagggaacgauuaucggcaaacagaacgauacaugcaccgcuaaggccagcuguuggcuugaauccgucaagucuuucuuuuacgggcugaaaaauaugcugggaagcguguucggcaacuuuuucaucggcauucuccuguuucuugccccuuucguucugcucgugcuguuuuucauguucggguggaagauccucuuuugcuucaaauguugccgccggacaagaggacugcuuaaguaucgccaccugaaagacgaugaggaaaccggcuaccggagaauuaucgagcgccugaauaacaagaaggggaaaaaucggcuccuggacggagagagacuugcugaucggaagauugccgaacuguuuuccacgaaaacccauaucggcuga

SEQ ID NO: 13618 - RNA, 5067 nt, Artificial Sequence
  derived and/or modified CDS sequence (opt5) from CCHFV(75-ST-2010)__KR814864.1__GP
augcccaccaacaucaugcacacacugcucgugugcuucauucuguaccuucagcugcucggcccugggggagcccauggccaaccgaaugcuacggagcacaacagaaccaauacaaccacagcccccagcaccucccagucuccuaagcccccugucagcacagcgcccccucaugcucuggaauccccgaccaucaaaucuacgacccccacaagcgagaccgaaggguccggagagacaaccccucccccuaacacgacacagggccccucucuuccggaaaccacaccugagcggcccgccaccaccgccacaagcacgccuuccaccgacaauacaaacagcaccacacacguuaccgauaauaaccccacgucuacaauuuccaccagccccucuuccagcccuucuaccccguccacaccccgcgggauccaucacccugcuagaaaucugcucagcguguccucucccaagaccgccacaacgccuacccccacaagcccgggagagauuuccagcgaaaccucuucccugcacagcgcuaugucucggacaagcacccuguauacggccacccaggcguccacagagaacgccaaucauucugcuccucgccaaagcgaaucccccgcccagccuaccacaaccagccucaugacgucucccgcucaguccauccuggugaugagcgccgcgccuacagccauccagaacauucaccccucuccgaccaauagauccaaacggaaccuugagauggagaucauucugacacucagccaaggccugaagaaauacuauggcaagauccuuaagcugcuccaucugacccuggaagaggacaccgaagggcuccuggagugguguaaacgcaaucuuggauccaacugcgaugacgacuuuuuccagaagagaauugaagaguuuuucaugacaggcgagggguacuuuaacgaaguccugcaguucaaaacgcucucuacccugagcccuacagagcccucccacgcucggcccccuaccguggaaccguuuaagucuuauuucgccaaaggauuucuuagcaucgauuccggcuacuucagcgcuaaguguuaucccagaucuuccacaagcgggcugcagcucauuaauguuacccaacacccugccagaaucgccgagacgcccggaccuaagacaaccucucugaaaaccaucaacugcauuaaucugcgggcuuccguguuuaaggaacaucgcgagaucgagauuaacguccuccugccccagaucgcggugaaucuuagcaacugucacguugugauuaauucucaugucugcgauuacagccuggacacagauggcccugugagacucccccacaucuaccaugaaggcaccuucaucccggggacauauaaaauugugaucgacaagaaaaacaagcugaaugaucgguguacgcuugucaccaacugcguuauuaaaggacgcgaggugagaaagggccaguccgugcugcggcaauacaagacagaaaucaaaauugggaaggucagcaccggaucuagaaaacuccuguccgaggaaagcggcgacgauuguaucucccgcacacagcugcuccggaccgagacggccgagauccacgacgacaauuaugggggaccuggcgauaagauuaccaucugcaacggcucuacaauuguggaccagagacuggggagcgaacuuggauguuacaccaucaaucgcguuaaauccuuuaagcugugcgagaacucugcuacaggcaagaccugcgaaauugauagcacacccgugaaaugucggcagggguucugccucaagaucacccaagagggaagaggccacgucaaacugucccgcgggucugaggugguucuggacgccugugauagcuccugcgaagugaugauuccuaagggcacgggagacauccuugucgauuguagcggcgggcagcagcauuuccucaaagacaaucugaucgaucugggaugcccccacauuccgcuccugggcaagauggccaucuauauuugucggaugucuaaccauccuagaacaaccauggcuuuucuuuucugguuuuccuucggguacgugauuaccugccuguuuuguaaggcccucuucuauagccugaucaucaucggaacacugggcaaaaagauuaaacaguaccgcgagcuucggccccaaaccugcacgaucugugaaacagcgccugucaacgcuauugacgccgagaugcacgaucucaauugcucuuacaacaucugccccuauugugccuccagacugaccagcgacgggcuggcucgccacgugccccagugcccuaagcggaaagaaaagguugaggagacagaacucuaccugaaucuugagcgcauuccguggaucgugcggaagcugcuccaggucucugaauccaccggcguggcccugaaacgcagcuccuggcugaucguucuucucgugcugcugacagucagccucucucccgugcagagcgcuccugugggacauggcaagaccauugagacguaucaaaccagagaaggguuuacauccaucugucuguucaugcuuggaucuauucuguuucucguuagcugccuggucaaaggccugguggacuccgugucugauagcuucuuucccgggcuuuccgucuguaagaccugcucuaucggaagcauuaacggcuucgagaucgagucccacaaauguuacugcagccuccuguguugcccuuauugucggcauugcucugccgacagagaaauccaccagcugcaucucuccauuugcaagaaacgcaagacagggagcaaugugaugcuggcgguuuguaagcggaugugcuuuagagccaccaucgaggcuucucgcagagcccuucugauucgguccaucauuaacacgacauucgugaucuguauucucacccugacaaucugcgucgugagcaccuccgcuguugaaauggagaaucugcccucuggcaccugggaaaaagaggaggaucuuacaaacuucugucaccaggaaugccaggugacggagaccgaaugucugugcccuuacgaggcccucguccugcgcaagccgcucuuucuggacagcaucgugaaaggaaugaagaaucuucugaacuccacaagccucgagaccucucuguccauugaagcgcccuggggcgccaucaauguucaaagcacauucaaaccuaccgugucuacggcuaacauugcccugagcugguccucugucgagcacagagggaauaagauccuugugacaggacggagcgaauccauuaugaagcuggaggaacgcaccggcgugucuugggaucucggggucgaggacgcuagcgaguccaaacugcucaccguuagcaucauggaucugucucagauguauucccccguguuugaauaccuuagcggagacagacagguggaggaauggccuaaggccacauguaccggcgauugccccgagcggugugggugcacauccucuacgugccugcauaaagaauggccgcacagccgcaacuggagauguaauccuaccuggugcuggggcgucggaacaggcuguaccugcugugggguggacguuaaggaucucuucacagaccauauguuugugaaauggaaggucgaguacaucaagaccgaggccauugugugcguugaacugacgucccaagagcggcaguguucucugaucgaagcuggaacccgcuucaaccuuggccccgugacaauuacccugagcgagcccagaaacauccagcagaaacucccucccgaaauuaucacacugcacccuaaggucgaggagggguuuuucgaucucaugcaugugcaaaaaguucuguccgcgagcaccgugugcaaacuucagucuuguacacacggaaucccgggcgaccugcaggucuaucacauuggcaaucugcucaaaggggaccgggugaacggacaucugauccacaagauugaaccccauuuuaauacguccuggaugagcugggauggcugcgaccuugauuacuauuguaacaugggggacuggccuucuugcaccuacacaggagugacccagcacaaucacgccgcuuucgucaaccugcucaauaucgagaccgauuauacaaagacguuucauuuccacuccaaaagaguuaccgcccauggcgacacaccccaacuggaucucaaggcccgcccuaccuacggggcuggagaaauuacagugcugguggaggucgccgacauggagcuucacaccaaaaagguggaaaucagcggccugaaauuugcgucucuggcuugcacgggcuguuaugccugcagcuccgggauuucuuguaagguucggauccauguggaugagcccgacgaacucacaguccacgugaaaagcuccgauccggacguuguggccgcuagcaccucccugauggccagaaaacuugaguucggaaccgauucuacauucaaggcguuuagcgcuaugccuaagaccucccugugcuucuacaucgucgaacgcgaguacuguaagucuugcagcgaggaagacacacagaaauguguggacaccaagcucgagcagccccaguccauucugaucgaacacaaaggcacgauuaucgggaagcaaaacgauacaugcaccgccaaggccucuuguuggcucgagagcgucaaauccuuuuucuauggacugaagaauaugcuuggcagcguguuugggaacuucuuuauuggaauccugcuguuccucgcuccuuuuguucugcuugugcuguucuuuauguucggcuggaaaauccucuucugcuuuaaguguugccggagagcccgcggccugcucaaauaccggcaucugaaggacgaugaagagacaggguauagaaagauuaucgagcgccuuaauaacaaaaagggaaagaaucggcugcuggacggcgaaagacucgcugaucggaagauugccgagcuguucucuaccaaaacgcacaucggguga

SEQ ID NO: 13619 - RNA, 5067 nt, Artificial Sequence
  derived and/or modified CDS sequence (opt5) from CCHFV(75-R-2012)__KR814863.1__GP
augcccaccaacauuaugcacacccugcuggugugcuucauucuguaccuucagcugcugggacucggcggggcucauagacaaagcaaugcuacggggcacaacgggaccaauaccaccacagccccuuccaccucucagagcccgaagccccuugucuccacagcgccuccccaugcucuggagucuagcaucauuaaacacaccacgccuguuuccgaaaccgagggaucuggcgaaacaacacccccuccgaacacaacccaggggcccagcccucucgagacgacacccgaacggccugccaccacagccaccuccacccccagcacagauaauacgaacucuaccacacaugugaccgauaauaacccgacauccaccaucagcacgucuccuuccagcucucccuccacaccuagcacaccccagggcauucaccaccccgcucgcaaucugcuguccgugucuagccucaagaccgccacaaccccuacaccgacgucccccggcgagaucagcucugagaccuccagccugcauucugcuaugagcagaacauccacccuuuauacagccacccaagucucuacggaaaacgcgaaucacagcgccccucggcaguccgagagcucugcucagcagaccacaaccucccccaugacaagcccugcccaaucuauccuggugauguccgcugcccccaccgcgauucagaacacgcauccgagcccuacaaaucgcuccaaaagaaaccucgaaauggagaucauucugacccuuucucagggccugaagaaguacuaugggaagauccucaagcugcugcaccucacacuggaggaagacaccgagggacuucuggaaugguguaagcggaaucucggcagcaacugcgaugacgacuuuuuccagaagcgcauugaggaauuuuucaugaccggggagggauacuuuaacgagguucugcaauucaaaacacuuuccacgcagucucccaccgaaccuagccacgccagacccccuacaguggagcccuuuaaguccuauuucgcuaaaggcuuucugagcaucgacucuggguacuucuccgccaaguguuauccgcggcucagcaccucuggacugcagcugauuaaugucacacaacauccugcucgcaucgccgaaacccccggccccaagacgacaucccucaaaaccaucaacugcauuaaucugagagccagcguguuuaaggagcaccgggaaaucgagauuaacguucuucugccucagaucgcugugaaucucucuaacugucaugucgugauuaauagccacgugugcgauuacucccuggacaccgauggcccgguccgccuuccccauaucuaccacgaggggacauucaucccuggaaccuauaaaauuguuaucgacaagaaaaacaagcugaaugauagauguacacucgugacgaacugcgugauuaaaggccgggaaguccgcaaggggcagagcgugcugagacaguacaagaccgagaucaaaauuggaaaggcgucuacaggcucccggaaacugcucagcgaagaacccggggacgauuguaucuccagaacccaacugcuucgcacagaaaccgccgagauccacgacgacaauuauggaggcccuggcgauaagauuacgaucugcaacgggucuaccauuguugaccagcggcugggaagcgagcucggcuguuacacaaucaauagagugaaauccuuuaagcugugcgaaaacucugcuaccgggaagacaugcgagauugauagcgcccccgucaaaugucgccagggauucugccugaagaucacccaggaaggccgggggcaugugaaacuuuccagaggcucugagguugugcucgacgccugugauagcuccugcgaggucaugauuccuaagggaacaggcgacauccugguggauuguagcgggggacaacagcacuuccugaaagacaaucucaucgaucugggcugcccccauauuccgcuucuggggaagauggcuaucuauauuugucgcaugucuaaccacccucggaccacgauggccuuucucuucugguuuuccuucggauacgucaucacaugcaucuuuuguaaggcgcuguucuauagccugaucaucauuggcacccuugggaaaaagaucaaacaguacagagaacucaagccccagaccugcacaauuugugagaccgcuccugugaacgccaucgacgccgaaaugcacgaucugaauugcucuuacaacauuugccccuauugugcuucccgccugacgagcgacggccucgcccggcauguuccgcaaugcccuaaaagaaaggagaagguggaagagacagagcuguaccuuaaucuggaacgcauccccuggaucguccggaaacuccuccaggugucugaguccaccggaguugcucugaagagaagcuccuggcuuauugugcuccugguccugcucacagugagccugucuccugugcagagcgcccccguuggccacgggaaaaccaucgaaacauaucagacccgggagggauuuacguccauuugucuuuucaugcugggcucuauccucuuucuggucagcugccuggugaaggggcuugugaacuccgucucugacagcuucuuucccggacucuccguguguaaaaccugcucuauuggcagcaucaauggguucgaaaucgagucccauaaguguuacugcagccuguuuuguugcccuuauugucgccacugcucugcggauagagagauucaucaacugcaccucuccaucugcaaaaagcggaagacaggcagcaacguuaugcuggccguguguaaaagaaugugcuuccgcgcuaccauugaagccucucggagagcccuucugauccgcuccauuaucaauacaaccuucgucauuuguauccucacgcugacaaucugcgugguuagcaccuccgccguggagauggaaaaccugccgucuggaacaugggagagagaagaggaccuuaccaauuuuugucaccaggagugccaggucaccgaaacagagugucugugccccuacgaagcgcucgugcugcggaagccucucuuccuggauagcauuguuaaaggcaugaagaaccuucucaauuccacgagccucgagaccucucuguccaucgaggcccccuggggagcuauuaacgugcaaagcacauuuaaaccuaccgucucuacagccaauaucgcucugagcugguccucuguggaacaucgcggaaacaagauucuugugaccggcagaagcgaguccaucaugaagcuggaggaacggacgggggucucuugggaccucggaguugaagaugccagcgaguccaaacugcucacagugagcaucauggaccugucucagauguauucccccguguucgaguaccuuagcggcgaucgccaggucgaagaguggccuaaggccaccuguaccggggacugcccggaaagauguggcugcacauccucuaccugccugcacaaagaguggccccauagccggaauuggcgcuguaacccuacauggugcuggggagugggcacgggguguaccugcuguggaguugaugugaaggaccucuuuacagaucacauguucgucaaauggaagguggaauacauuaagaccgaggcuaucguuugcguggagcugacaucccaggaaagacaauguucucugauugaggcgggcacccgguuuaaccuugggcccgucacgaucacccugagcgaaccucgcaauauucagcagaaacugcccccggagaucaucacacugcauccuaagguggaagagggauucuuugaccucaugcacguucagaaagugcuguccgccagcaccgucugcaaacuucaaucuuguacacacggcauucccggcgaucuccagguguaucauaucgggaaccugcucaaaggagacagagugaauggccaccugauucauaagaucgagccccacuucaacaccuccuggaugagcugggacgggugcgaucuugacuacuauuguaauaugggagauuggccuucuugcacauacacgggcgucacccagcacaaccaugcugccuuuguuaaucugcucaacauugaaacagacuauaccaagaccuuccacuuucauuccaaacgggugacagcccacggggauacgccccagcuggaccucaaggcuagaccuaccuacggagccggcgagaucacagugcuggucgaaguggcggauauggagcuucauaccaaaaagguugagauuagcggccugaaauucgcuucucuggccugcacaggguguuaugccugcagcuccggaaucucuuguaaggugcgcauccacgucgacgaaccggaugagcucaccgugcacguuaaaagcuccgaccccgauguggucgcugccagcacgucccugauggcgcggaaacuugaguucggcacagacucuaccuuuaaggcuuucagcgccaugccuaaaaccucccugugcuuuuacauuguggagagagaauacuguaagucuugcagcgaggaggauacacaaaaaugugucgacaccaagcucgaacagccccaguccauccugauugagcauaaagggacaaucauuggaaagcaaaaugauaccugcacggccaaggcuucuuguuggcucgaaagcgugaaauccuuccuguauggccuuaagaacaugcuggggagcguuuuuggaaauuucuuuaucggcauccugcuguuccuggccccuuuugugcuucugguccucuucuuuauguucggcuggaaaauucuguucugcuuuaaguguugccgccggacaagagggcuccugaaauaccgccuucugaaggacgacgaggaaaccggauaucggagaaucauugagcgccugaacaauaagaaaggcaagaaccggcuccuggauggggagagacuugcugaccggaaaaucgccgaacuguucucuacaaagacccacauuggauga

SEQ ID NO: 13620 - RNA, 5067 nt, Artificial Sequence
  derived and/or modified CDS sequence (opt5) from CCHFV(52-R-2014)__KR814862.1__GP
augcccaccaacaucaugcacacacugcucgugugcuucauucuguaccuucagcugcucggccuugggggagcccauagacaaagcaaugcuacggagcacaacggcaccaauacaaccacagccccuuccaccucucagagcccgaagcccccugucuccacagcgcccccucaugcucccgaaucuagcaccaucaaaccuacgaccccggccuccgagacagaagggucuggagagaccacacccccucccaacaccacgcagggcccuagcccgcccgaagccacaccugagcggcccgcuaccacagccaccuccaccccuagcacagacaauacgaacucuaccacacacgcuaccgauaauaaccccacauccaccauuagcacgucucccuccagcucuccuuccacaccgagcacaccccaggggauccaucacccugcccgcaaucuucuguccguuucuagccccaagaccgcgaccaccccuacacccacguccccgggagacauuagcucugagaccuccagccuccacucugccaugagcagaacaccuacccugcauacagcuacccaagccuccacggaaaacgcuaaucacucugcgccccggcagagcgaguccagcgcccagcagaccacaaccucuccuaugacaucccccgcccaaccuauccuggugaugagcgcugcccccaccgcuauccagaacauucauccgucuccuacgaaucgcuccaaaagaaaccucgaaauggagaucauucugacacuuagccagggccugaagaaauauuacggcaagauccucaagcugcuucaccugacccucgaggaagauacagaggggcugcuggaaugguguaaacggaaucucggauccaacugcgacgaugacuuuuuccagaagcgcauugaggaauuuuucaugaccggcgagggguauuuuaacgaggugcugcaauucaaaacccuuucuacacugagccccacggaacccucccacgccagaccuccgaccgucgagcccuuuaagucuuacuucgccaaaggauuucucagcaucgauuccggcuauuucagcgcuaaguguuacccucggcugucuacauccgggcuucagcugauuaaugugacccagcaucccgcgcgcaucgccgaaacaccuggacccaagaccacgagccucaaaacaaucaacugcauuaaucugagagcuucuguuuuuaaggagcaccgggaaaucgagauuaacgugcugcucccucaaaucgccgucaaucuguccaacugucaugugguuauuaauagccacgugugcgacuauucucuugauaccgacggccccguccgccugccgcauaucuaccacgagggcaccuucaucccugggacauacaaaauugugaucgauaagaaaaacaagcucaaugacagauguacccuggugacaaacugcgucauuaaaggacgggaaguucgcaagggccagagcgugcuuagacaguauaagacggagaucaaaauugggaaggccuccaccggaagccggaaacugcucucugaagaacccggcgaugacuguaucuccagaacacagcugcugcgcaccgaaacagcugagauccacgacgauaauuacgggggaccuggcgacaagauuaccaucugcaacggcagcacgauuguggaucaacggcucggguccgagcugggauguuauaccaucaauagagucaaaucuuuuaagcugugcgaaaacagcgccacaggcaagaccugcgagauugacuccacacccgugaaaugucgccagggguucugccugaagaucacccaggaaggacggggccauguuaaacucucuagagggagcgaggugguccuggaugcgugugacacauccugcgaggugaugauuccgaagggcaccggagauauccugguugacuguucuggcgggcagcaacacuuccuuaaagauaaucucaucgaccugggaugcccucaugugccccugcucggcaagauggcuauuuacaucugucgcaugagcaaccacccucggacgacaauggccuuucuguucugguuuuccuucggguaugucauuaccugcaucuuuuguaaggcccuuuucuacagccugauuaucaucggaacccucggcaaaaagauuaaacaguauagagaacugaagccccagacaugcaccaucugugagacggcucccgugaacgccauugaugcugaaaugcacgaccugaauugcucuuacaacaucugcccuuacugugccucccgccuuacaagcgacgggcucgcgcggcaugucccgcagugccccaaaagaaaggagaagguggaagagaccgagcuguaucugaaucucgaacgcauuccuuggaucguucggaaacugcuucaagugucugaguccacaggcgucgcccugaagagaagcucuuggcucaucgugcugcugguucuucucaccgugucccugagccccguccaguccgcuccugugggacacggcaaaacaauugaaaccuaccagacgcgggagggguuuaccagcgugugucuguucaugcucggaucuauccuguuucuuguuagcugccuggucaagggccucguggauuccgugucugacagcuucuuucccgggcuguccgucuguaaaacaugcucuauuggaagcaucaacggcuucgaaauugagucccauaaguguuauugcucucuguuuuguugcccuuacugucgccacugcagcgccgauagagagauccaucagcuucaccucuccaucugcaaaaagcggaagauggggagcaaugugaugcuggcuguuuguaaaagaaugugcuuccgcgccaccauugaagcgucucggagagcccugcucauccgcuccauuaucaacacaaccuucgugauuuguauccugacgcuuacaauuugcgucgugagcaccucugcuguugagauggaaaaucugccguccggcacaugggagagagaagaggaccucaccaacuuuugucaccaagagugccaggugaccgaaacagagugucugugccccuaugaagcccugguccuucggaagccucuguuccucgauagcaucgugaaaggaaugaagaaucugcucaacuccacgucucuggagaccagccuuuccaucgaggcucccuggggcgccauuaauguucagagcacauuuaaaccuaccgugucuacagccaacaucgcucuguccuggagcucugucgaacaucgcgggaauaagauucucgugaccggaagaagcgaguccaucaugaagcuggaggagcggacgggcgugucuugggaccugggggucgaugacgcgagcgaauccaaacuucugacaguuucuauuauggaucucagccaaauguacucccccguguucgaguaucugagcggagaccgccagguggaggaauggccgaaggccaccuguaccggcgauugcccugagagaugugggugcacaucuuccacaugccuccacaaagaauggccccauagccggaacuggcgcuguaaucccaccuggugcuggggcgucggaacgggcuguaccugcugugggguggacguuaaggaucuguuuacagaccacauguucgugaaauggaaggucgaguacaucaagaccgaagcuaucgugugcguugagcuuacaucccaggagagacaguguucucugauugaagccggaacccgguuuaaccucggcccugugacgaucacccugagcgagccccgcaacauucaacagaaacugccuccggaaaucauuacacuucaucccaaggucgaggaaggguucuuugaccugaugcacgugcagaaaguucucuccgccucuaccgugugcaagcugcagagcuguacacacggaaucccuggcgaucuccaagucuaccauaucggcaaucugcuuaaaggggacagagugaacggacaccugauucauaagaucgagccccacuucaauaccuccuggaugagcugggauggcugcgaccuggauuauuacuguaacaugggggacuggccuucuugcacauauacgggagugacccagcacaaucaugcugccuuugucaaccuccugaauauugagacagauuacaccaagaccuuccacuuucauuccaaacggguuacagcgcacggcgacacgccccagcuugaucugaaggcuagaccgaccuauggggccggagaaaucacagugcucguggaggucgccgacauggaacugcauaccaaaaagguggagauuagcggccucaaauucgcuucucuggccugcacaggcuguuacgcgugcuccagcgggaucucuuguaagguucgcauucacguggaugagccugacgaacuuaccguccacgugaaaagcaacgaucccgacguuguggcugccuccacgucucugauggcccggaagcuggaguucggaacagacagcaccuuuaaggcuuucuccgccaugccuaaaaccagccucugcuuuuauaucgucgaaagagaguacuguaaguccugcucugaagaggauacacagaaauguguggacaccaagcuggagcaaccccagagcauccuuauugaacauaaaggcacaaucauugggaagcagaaugauaccugcacggcuaaggccggauguuggcuggaguccgucaaaucuuucuuuuacggccucaagaacaugcuggggagcguguucggaaacuuuuucaucggcauucuccuguuucuugcgccuuucguucugcuggugcucuuuuucauguucggcuggaaaauccuguuuugcuucaaguguugccgccggacaagagggcuucugaaauaucgccuccugaaggacgaugaagagaccggauaccggagaaucauugaacgccucaauaauaagaaaggcaagaaccggcugcuugacggggagagacuggccgaucggaaaaucgcugagcuguuuuccacaaagacccacauuggauga

SEQ ID NO: 13621 - RNA, 5067 nt, Artificial Sequence
  derived and/or modified CDS sequence (opt5) from CCHFV(47-ST-2013)__KR814861.1__GP
augcccaucaacauuaugcacacccugcucgccugcuucauccuguaccuucagcugagcggccucgggggagcucauggccaauccaaugccacagagcacaacgggacgaauaccacaaccgugccuggaacaucucagagcccgaagcccccugcguccaccacacugccccauaccccugaaucuagcacggucaaacuuaccacacccaccuccgagacagaaggcucuggggagaccacgccuccgcccaacacaacccagggacugccucccccuggcacaacccccgaaagaagcgcuaccacagccacguccaccagcucuacagacaauaugaacuccaccacacagaugaccggcaauacgccgacaccuaccguuaacaugagccccucuuccagcccuucuaugcccuccaccagccaagggauucacuaucccgugcggucccuccugucugugccuagcccgaagacagccaccacacccacgccugucucccccggagagaugagcccugagaccucuucccagcauagcgcuacaucucgcauccccacccuguacacagccacccaggugagcacggaaaauaccaacagauccacaccgcggcagucuaaaagcuccguucaaccugcuacccagagccccauuacaccucccgcccagaccauccuccugaugucugcggccccuaaggcuauccaggauaugcaccccuccccgacgaaucgcagcaaaagaaaccuugagguggaaauuauccugacacucucucaaggccugaagaaguauuacgggaaaauucuuaagcugcuccaccugacccuggaggaggacacagaaggacuccuggagugguguaaacggaaucuuggcuccaacugcgaugacgacuuuuuccagaagcgcaucgaagaguuuuucauuaccggggaaggauauuuuaaugagguccugcaguucaaaacccucagcacacuguccccuacggagcccucucaugugagacuucccaccgccgaaccuuuuaagagcuacuaugcuaagggcuuccugucccucgacucuggcuacuuuagcgccaaauguuacccgcgguccagcacaucugggcugcaacugaucaacguuacccagcaccccgcgcgcauugccgagacaccuggacccaagaccacgucccucaaaacaaucaacugcaucaaucugagagcuagcguguucaaggaacaucgggaggucgaaauuaacgugcuucugccucagaucgccgugaaucucucuaacugucacgucguuauuaauucccacgugugcgauuauccccuggacaccgauggcccugugcgccuucccagaauccaucacgaggggaccuuuauuccgggaacauacaaaaucgucaucgacaagaaaaacaagcugaaugaucgguguagccucgugaccaacugcguuauuaagggccgcgaggugagaaaagggcagucuguccugcggcaauauaagacagaaaucaaaauuggaaaggcuagcacgggcuccagaaaacugcucagcgaggaaccuggcgacgauuguaucucucgcacccagcugcuuaagacagagaccgccgaaauucaugacgacaauuacgggggacccggcgauaagaucacaaucugcaacggguccaccauuguggaccagcggcugggaagcgagcucggcuguuauacgaucaauagaguuaaauccuucaagcugugcaaaaacucugccaccgggaagacaugcgagauugauagcaccccugugaaaugucgccagggcuuuugccugaagaucacacaagaaggacggggccacgucaagcucuccagagggucugaggugguccucgacgcuugugauagcuccugcgaaauuaugauccccaaaggaaccggcgacauucugguggauuguucugggggacagcagcauuuccugaaggacaaucucaucgaucugggcugcccgcacaucccucuucuggggaaaauggcgauuuacaucugucgcaugagcaaccacccccggacaaccauggccuuccucuuuugguucuccuuuggcuauguuauuacgugcaucuucuguaaggcucuguuuuacagccugauuaucaucggaacacuuggcaaaaagauuaagcaguacagagagcucaaaccucaaaccugcaccaucugugagacagcccccgugaaugccauugacgcugaaaugcaugaucugaacugcucuuauaacaucugccccuacugugccucccgccugaccagcgacgggcucgcgcggcacgucacgcagugcccuaagagaaaagagaagguggaagagacagaacuguaucuuaaucuggagcgcauuccguggaucguucggaaacuccuucaggugucugaguccaccggagucgcucugaagagaagcucuuggcuuaucgugcuccuggugcugcucacaguuucccugagccccguccaguccgccccugugggccaugggaaaaccauugaaacauaccaaacccgggagggauucacgagcaucugucuuuuuaugcugggcucuauucucuucaucgugagcugccuggucaaggggcugguggacuccguuucugauagcuuuuuccccggccuuuccguguguagaaccugcucuauuggaagcaucaacggcuuugaaaucgagucccacaaguguuauugcucucucuucuguugcccuuacugucgccacugcagcgccgaccgggaaauucaucagcugcaccuguccaucugcaaaaagagaaaaacagggagcaaugucaugcucgcuguguguaagcgcaugugcuuuaaagccaccauugaggcuucucggagagcccuguucauccgcuccauuaucaacacaaccuucguuacguguauucuuacacuggcgaucugcguggucagcaccucugccguggagauggaagaucuccccgcuggaacaugggagagagaagaggaccugaccaauuuuugucaucaggaaugccaaguuaccgagacagagugucugugcccuuaugaagcccuugugcugcggaagccgcuuuuccuggauuccaucgucaagggcaugaaaaaccuccugaauagcacgucccuugagaccucucugagcauugaagcucccuggggagccaucaacgugcaguccacauuuaagccuaccgugagcacagcgaauauugcccucucuugguccagcgucgagcaccgcgggaacaaaauccugguuaccggcagaucugagagcauuaugaagcuggaggaacggacggggguguccugggaccuuggcguggaagaugcuucugagagcaaacugcucacagucuccaucauggaccugucucagauguacagccccguguucgaauaccucuccggagaucgccagguugaggaguggccuaaggccaccuguaccggcgaaugccccgagagaugugggugcacaagcucuaccugccugcauaaggaauggccgcacucccggaauuggcgcuguaacccuacauggugcuggggagugggcacgggguguaccugcuguggagucgacgugaaagaucuuuuuacagaccacauguucaucaaguggaaaguugaguauauuaagaccgaagcuaucgugugcgucgagcugacaagccaagagagacaguguucccucauugaagccggcacccgguuuaaucugggccccgugacgaucacccugucugagccccgcaacauucagcagaaacuuccucccgaaaucaucacacugcauccuaagauugaggaaggguucuuugaucucaugcacguucaaaaggugcugagcgccuccaccgucugcaaacuccagucuuguacacauggaaucccgggcgaccugcagauuuaccacaucgggaaucuucugaagggagacagagugaacggccaucugauucacaaaaucgagccccacuucaacaccagcuggauguccugggaugggugcgaccucgauuauuacuguaauaugggagacuggccuagcugcacauauacgggcgugacccagcauaaccacgcugcguuugucaaucugcuuaacauugagacagauuacaccaagaccuuccauuuucacucuaaacggguuacagcccacggcgacacgccccaacuggaucucaaggcuagaccuaccuauggggccggagaaaucacagugcugguggaggucgccgacauggaacuccauaccaaaaagguggagguuuccggccugaaguucgcuagccuugccugcacaggguguuacgcguguucuuccggaaucagcugcaaagugcgcauucacgucgaugagcccgacgaacugaccgugcauguuaagucuagcgauccggacguggucgcugccuccacgucucugauggcccggaaacucgaguucggcacagauagcaccuuuaaggcuuucuccgccaugccuaaaaccagccugugcuuuuacaucguggaaagagaguauuguaaguccugcucugaagacgacacaaagaaaugugucgauaccaaacuugagcagccccagagcauucugaucgagcacaaagggacaauuaucggaaagcaaaaugauaccugcacggcgaaggcuuccuguuggcucgaaucuguuaagagcuucuuuuacggccugaagaacaugcucggcuccguguucgggaauuucuuugugggaauccugcuuuuucuggccccuuucguccugcucgugcuguuuuucauguucggcuggaaaauucuguuuugcuucaaguguugccgccggacaagagggcuguuuaaauaucgccaucucaaggaugacgaggaaaccggauaccggagaaucauugagcgccugaacucuaaaaagggcaagaaucggcuccuggauggggaaagacuugccgaccggaaaaucgcugagcuguucagcacaaagacccacauuggauga
